United States Patent 9,567,581 (SELECTIVE REACTIVATION OF GENES ON THE INACTIVE X CHROMOSOME) - sequence listing, part 3

SEQ ID NO: 316 - DNA, 279269 bp, mus musculus
cacacccagccctgcctctagccagagcatcctcagcagctgccactgaagcagcctcctccttctcgtcgtcgtcctcctcctaccactgctgctgctgtgatcgcctatcccctcatccttcttccttgccaattcctgttcctcctccccgcatcccggctcctcctgcccagcagctaaaggcagaatcgtcggcagcagctttccttctctcctgcctcaaagaggttgaaacaggtctgtgctgggggcgctttgttgcgggttgctggaacaccggtggctcccagagccactgggaggagctccgggcaggcagaaggggggattatttcccagttttctgtgttcctgtatgaatagattgggggagatagtgtagagaggcacctctgtccctttgccatttcttctcccttggttcatggcgagagagagcactgaagctactcggactcctgctcccgcccatccctaaagctctttctttgcgcccccacttccagcatccacttcccaaagctgagcttccccttgttctgggagctgagggatgggggcggggagagatggatggagtcatccagccgggcacctgggggtctggggctttgttacacaggacaaaaccagtccttagcagcttctagagcctggctaggctgctgtcttctagtgatgtggggtgtgggcccctgcacattagggaagtaagagaatgtgagggggcactccctgtatgtgactgggcatacaggaatgcagtactgtgtgccagggacgtggtgtagattttgtgtggaattttgtatgagttggactggtgcatttgactctctttctctctctctctctctctctctctctctctctctgtctctctctctctgtctctctctctctctgtctctctctctctctctctctctctctctctctctgtctctctctctctctctttctctctctctctctctctctctctctctctctctctctctctctctctctgtgtgtgtgtgtgtgtgtgtgtgtgtgtgtgtgtgtgtgtccctgtgtgttctacgccatggggctgggctactcttggcatttcatgtccttgggtctcatcccatgccaaaccagactgcagcaacatgcaggcaggctgatcaggtccaacctgttttgcccacattcgaatgggtgatgatgacttcaaagtgatggaaatcccccgccccacgctgggtcagttacttagtacattctgcatgagaaattgtcacctaggttgaccaaaccctggtggacattttacaccctacccacagaatattcggaactttcttaagcaggttctcttctctcagccaataagattccaatgctcttaacagtgaaccctgagtgcctcccctacctcttgtaattagtggatcctcatgtctttactgcaaggaagtttgtgttgtgctaggacgaaagttgcacgcttagagcaaaggaagccaatcaagtgcacttattaattgatggcgaaatttcaatacagggtcgtttctgttttctggtaacacaagataaagtgtgtagccattttgtttttaatcaaagaaagatccgtaaaaatgaacaaaactccttaacgtttcttgaccatttctatatgtgcttttccagtcccccagataagcagttaaagattgtgatcaaaggacccaacatttattgcatacctgccatgtgtcagtagtaatgttaggcactggaaatatggaaatgaataaaacatcagatcagttctcaaggagtgcaggctgttatgcaagctagagcttggaaactggatgactagggatgggcagagtacagtggaagcacagaggagggggggtgcccggttgggggtgggggttctgatcaaggcaggcttcactgggaaagtgacatttgagtcaagcaagtcttgcagaattaattcaccaggtggctaagtggagaatgacatcctaagctcaaggagcagcatgtgcaaaggcagagaggttatagttaagtaaaactgcagggaatctgaagtattactgtcaaactctctgcaatttcagaacgtgtctccatggattagaatgatgattaagggtgaatctgaaaagagccagtattgcagattgatgcatccccaccttaagacacgtctgcctcatttattaatctaagtgtgttttgctttaagcaaatctgatatatgggaatgtagctttgcaatgcaaatgaccttaatgggacacattcaagtagcagaattggttgctttacaaaagggctcacaaccaaatactcttaaaataattaaatataatagcagtcaccatctgatctttatagtgaacttgcttttaccaaaattgcatttctacagatttcttttttcacatagtcagtggataaagacagatatatctatctttattaccttgatttcttatgcaacaagttcccaatttccatgcaggaatttcccctcatgctgttaatgtttaataaacactaaaggaaaatatgaaaatgatagcaataaatatcaaatccattagctgtgatcttttgtcatttggctcgtatgaaattaatcacggcagaatcttcagggactcttacattttaggtacttttagtagtgtcactggtaattaacggtagagcaagatttctgtgctctatattggctttgaaatggatatataatgactactctaatactcatgcaattaagatacagcagaagctcatttggagttttccgttttactgtattggtgctgattgcataggttgatgaatagtagtaaaagtaagcttggaggttgatgattttcattcaaagtgcctgatggcccacgattatgctggtgatgagtatgaactctgatgatatggcttggcaccatgaatgcatcctcccttaaatgaagcctcctgtagccctaggctctgtttgaaagaaatataagcagaagtagataggagtagaatcagcttcttaggccatttggccaatgccctgcagtacaaaagggtgtcctgggctcctttggtcacatagaggttctttgctcattagctgtggataccagaatgtatcagacagtatctctactaagaaaagagcgtactccagtgcctcattagcttgggttggaatggagctgataggcctgctgtgctaatactcagatcaacccaatcctaatccaacccttcttgatgtgagttccaaacaagacagagtgcccacaggtcagatagagtgagagggcaggagaaagaaagaagagtgagggttttgtagtcaacttagagaaattattgcttcaagtgcataggtttggtaattccagagcttctaaaagattctaccgggttactgcatattgtgactctccagaaaaaaaaaaaggagtatatgtttgtctataaagccagtcctaccacttgatcggttggtcttaagagtatttgaggactatgctggtcaaatagactcttctgctgagttcagaggcagttggtatcttgttgggtaaacttggataaaatatgagctgactgactggcttcaccagtctcaatcagactttcttccctcctcctcctcctcctcctcctcctcctcctcctcctcctcctcctcctcctcctcctcctcctcctcttctgtcttggttattgttctattgctgtaaaaaggcaccatttttttttggtcagggaaggtttttatagattgtaggtgaaggaaaatgatgtgtctgccacacacttggtttgtgccaaggtatggtcatctagggcaagggcttgggtagctggtgacatcagatgagtgggattgggacagctgtcaggaatgtttggcacctttttatatttggaggaatggaatttactggaccatgtatgtgtgtgtgttggggggcagttataagccagggattccaaccaaacaagagggttagtttattattgtaaaggctaggagcttggtggcaggtagacaggcaggtatggtgcctcctccttctcctactcctcctcctgtaaaatgaagctgatagtaatcatcagactcactgactgcgatggtgggatgacaactaagatatctttgcaaagtattttgagctccttagaagaaaggctgtctatgacctcaaggttattatgaaggggaagctaagatgtcaggtaatcattcctgactattcaggcccaaatcttgtttaccttttgcacttggggcagctgacctcagttctctactgtgctttgactatgaggacctatcgtcattcaacctctgtgagtcagttctctgagcttatttcctttcacatcctggacatttcactatgccctttaatttcctgatctgcagttgccatcagaacagattcagcaaaactcatcagtctgagcacaccctgctgaccagagaacactggaggtgggaattaaatttggttggaaagttgcttttattcttcacactaattatctttcagaaacagttctgaagggtcatttctgagagtttacggctgcggagctcctttccagtgactcaagtttccattcagggctagactcctgtttacaagccagacctcttaaatatttatttaggagtccattttgacaagatggaagccatctttaaggtaatttagatacaaataaaatagtatttacatgggcactgaactttcctgattaccttgatgttgtaaattcttttctttacaaacttccttcagtggagaatggaattattatcctcttgagaattaataaataatcaccatagcaaactcagcttgagattgaatctgatagacagttgttggacatattgattttagagtcttccgtgcaatgattagttagttcttcaccacgtgaaagcaataagctacagctgcaataggaaagatgtctgttagccatacataaaagaagtcttttcgacttgaggacaatgtgatgctggaaagtgagcaaagctatcccgtgtactgggacacatagtgaagatgttatactaggaggagagagccgtggaacaggagatctgtggaaggttcatgtttggatggtgaaaaaaagggcaagtcacatagctaccaagtaatacaagccatcctaatagataagaaaacacagtttattatttggggtaggggtgggcacacatatggaggtcacacaccaacttgcaggaaatggttctctccttctaccttgtgggtcctggagactgaactcatattgtcaggcaaatgcctttacttgttgagaataaactatcctgccaacctactatactgtcactttatgtgcttcaggggcgtttgggttgatttgttcaatgaaacttgagaatcacatctaggtctaagcttggtagggctctcataaagcagaattaacagagggataggcatctagtgaactctgcccctccccccaaaaaccccaagactttgctctgtctttctccactactagtgactcaccaagccaagcagccaaccaaagtgtgagaattgggtactcattagatttcatagggatctttgtcttacaaaaatctagtatctacagaagtatagaaactgggattttttttttaaagcatccactgagaacctagagcagatgtcccctcccctccagaagcagggacagaaggactgtcagaaccatagatccaggacacccaaattgcccccagagttgagaggaaaaatgtattcatgaaatttcaacagtatagttacctgaacaatcccagcaaaatgacattaccaattgacacgttaacatggaaaagaaaaattctacagtgtcccactcctgcaggaatacctgtaggtgatcaattgttacagagagatgtaggaccagtttactccaaggattagcttctacataggttatcctatcccaagtagttatctctgaacacatgtacatacaaatataaatgccttgggatgtacatgtatgtgcataaatatacatacaggtgtgtatacatatgtatgtatacatgtagcaataataatttggctacatgagttttggagggaaagggtgaacatgggagtagttgtatcaggaaggcagaggtgatgaagatggagattcagtattcatgtatgaagttctacaccatactgaagggcaggccctgtgccttgcagtagatggcaaacataaaacgaactctggtatttcttcagacttgttgtctcagattgctttgctttggcactgttttgttcttgctggtcttttgcttatattatgtttgccaatattgtgggtttatggttgtgtggggtttttttgtattcttttttccaattatggtttgcttgttttgattgcttatatgagagagagagagggagagagagagagagagagagagagagagagagagagagagagaggtgatgaagaccttaggaagatttgagagggagggcatcctgatcaaaatacatcgtataaattttttcaattaaaaaaaaagaagcaaaagaaaaacttttgcacagcctgtctcattggaaatatgaatataacataggcagagaatgcacatccttatcctttacccttacacgtctctctcccatctcttcccatccttttcctgtcccctaagtagtctttcccttagactttcacatataatgtttattacaaaaacagaaatacaatgtaggttgttagttgcttcttaaaccttgattaactgccatgttcacaatttattgtgtgtatttgtgcaggctgttttttaaaaatatatgtgcatatccacatcgttttcactaaactacatttgggtacttttttgaaagtgtgcaggagctactttgttctttttaatagtcgtacagtattccattatacaattataacataatttctttaattcaaacttttatgatgaatttctacattatttcctatttttatgctgttaaatattggtgcactatactttatgggatataaatctcaggatactttgcaaacattctgttgtatagattgacaaccataaaattggtagttcaaagggttggtttgtacatatatgattttaatagctcttaccaaactattattcaaaatggctattatcctatacttccatcaatagtgaccatttattaacatgattccctcaccaatcccacaattactctatttttatttattctctcatacaatctatccggaacagtttcccctccctcctcccctctataactcccccttttctcgccaccagatccattcctccttcagttcctacagaaaagagtggtaacaacggaacatggtgtaacaagagtttctcctttaatctttgataatgtaagagttaaataacatttattcataatcagttttatgaattatttgagaatttcatgcaatgtattttgaatatattaactctccgcaacttttttctttaaacactctctcatcacccccatctctttccacccaacattgacataatgttttttccttctttcctgatcaaatttagtttgtgttgcctagctattcctgggactggggcatgtctgtcctgtgtagcctgccaggggtcatattgtcaaaacttcaggcttcttaatcaaacactaggcagaaacacatgctagatctcataaaagaagagatgcaagaaaccctaacaatgtgtggaatatatgtaatatatgttcacctttaattatttaaggaaatatgttttttttaagatttatttatttttatgtatatgatacactgtagctgtcttcagacacacatcagaagagtgcatcagatctcattacagatggttgtgagccactgtgtgattgttgggaattgaactcaggacttctggaagaacagtcagtgctcttaactgctgagtcatctctccagcccaagaaatatgttttaaagtatatttctaactacaactattttgaaagaattttccaaatcaaatccctgtaaagtcattttgaaatagatggccttttcagcttatctctgctgccagtgaccaaaacaccagccagtggcagactgactttagagctatacattgcattaagaaatatgaagcagcaagcacaagaccagcacagtctcagaccagatgacatcatgaaatctcagcaaggagaagggctaagtgagcacaaagcccccgcccacccgggacaaaaatctatttgtaattgctagctactgggagagaaaaaaaaatcagtttttgtcaagaaaagtgacaccagatttatcaaatacacaccatggcagaccccatactcaggagtagttggataggtagaggaagataaagacctgggagaggataaagaaatgtaatgaatggcattctcaagaagtaaattaagaaaatttaatgcctttggttttgcaaactttatatgccccagtacaggggaatgccagggccaagaagcgggagtgggtgggtaggggagcagggcagggggagggtataggggactttcaggatagcatttgaaatgtatataaagaaaatatctaataaaaataaataagtaagtaaataaataaataggaaaaaaaagaaaatttaatgccaaacaaacaaacttgggaaaatgtcattgctgcatgtgcactgacctttaagattagtacaatagattctagaattttctggatgttgagtgttcagtgttaatcagcagctgcctaactgtgcttgctgcaaagaggcgaatttgaggccttcccctgagaagcatttagggagaaataaacagtgatgtcactctctgcaaagggaatagtggcaagcaggcacaggtgtggtgttctctcttgactgccctgaccttgcttcctctgctcagtcccctcctctgccagcattcagatgtggtcaaaaggactctgttgtttgctttagatgtggggtagggtctgtgactgagaggaagatagaaatgagggtgatcatttgagggagttaggattgtctgaagagcagggctgtagcattaacgtccttaaggtgtggcagaaccatgggagagcatgaaagctgcgacagtgtttgcttactcgttctatagatgctgaatgtgtcagaaaaggcaaagcactcagagttaggcattaccaggaatgactctgacactctcactagcacttgctacctaacaatttgccagcctttctcccctagagaggaatataggtgcccttaaagtgaagcttctcatttaatagacctaggagtgccctttgcagtgttatccgtcattcactccctctactgtggcattagcccatcctgcttttgaaatctttccaagctgttggaaaatgggtgggttattgccctcaaaggaatgattggggctacttgagttattgacaattatgaattgtggtttctcactttaaaatcttggtatttggcaaacggttttaggtcttatttaatacattttctttttaatttttcttcagagagatcagactagagtagggaaagttgagaggagagcttatgggcagatattgtcattattcatctttgttgtgttaaaaaacttgcttcagttgttaagctaatgaatgtcctggtttcaagctaggttgatgctttgtcagtgctgaatgttttaaaatttcagcacaaaaacccccagctatggtttctacagataaatctatatgatgcatttttttatcttttgtgtttgcacattgtgtgtatgggtgtgtgtgtgtgtgtgtgtgtgtgtgtgtgtgtgtgcacacgcgcgcgccataacatttgtgtggaagtcacaggataacttcaggtgactgtcctcatctttccaccttgtttttttttatgtttttgtttttgttgttttgttttgagacagattcttttattactcagcgcacactgggcttgctgacctgtgagcttccagagaatcttctatgcctgcatgtcatctcaccataggattggtgggttattggcacctactactgtgtccagcttacatgggttctgggaaactaactcaagtcttcacagtgagtgatttacccattgtggccctgtgttgtttgttttggacattatttcactaacttagctccagctggcttggaacatgtgattctttaagtccccagatgttgagattggaagcatgtactaagatatctgacttttcttttactttaaatgttatacctggtgctttcgatagagctaggaaaatcacagaattttgtgaatgtaagattgttttttaaaattctgaataaaaccaagaataaatatttatttacaaatataacagaaacagagaaaaagaaataaagaaggaaggaaagatagatggaaattcacagtaaagacactgaaaatgctgtttacagtgaattgggaggcagaagacctgggtttcagttctcattttgttagtaattactcatgatttaaaaatgactgtgtaaatgtctctgcattcctcacatataaaatatggatgatagttagcaagataatctttactgtgtttccttaagtttttaatgaaatattttcatctctaaaatgaaaggcaaccttgtgatagaaacacttgggacacttttgaaaaatatatagcaagatccaccccaaccagcagattgtgaatctccgggtggagactcggtggtctacttgggaactaacttccttagtgattctggaggagatgggaccctgccctaggggaacttgcaggaggcagattctctgaggttttctggcccaagggaatacaagcattttccaaaggtggaggaggctgtgtttcagctaattcccgggggtgggtttctccagaggtgaatgcagagctgcctgctcttggtcatcccctcaactttggatgaacaaactgactgcttgcttaccaatgtgagcatttttacatttcagggtggatgtaggcagaaacaatcattctgtcaaaagcattattgagaaaaggccatattgcatccatagctcttagacctaaggatttgacactcttcttttgcttctcttctgagttaccatatccttgacctgtttcaactttggtttctcttgcaattatgaaacccacagtgttgcagtgaatctctgctgttccacaggatctcaacagcctagattgtcattccttagctgcctccagcctctagagacttggtatgtccctcctggatcacatcactggtttggtttccttctgctatcggtactgtttcaatatcagcctgcccttaagacaccagagggaaaggagtcagtatcagccttacctagctagtaccttgtgtcatggtgtcttagcctttgtcttcactacagggaaaggtggagctaaggaaattcttcagaagacagtcttcctttttatatatagttcccaatttattgaaaatggattatatgccaagtactgcactactctgcatgtctcgtgtaattctctctacagtgctatatagtcaatattattagcatttccatttcacggaggctgaaaatgaggcccggaacagttgagtaacttgcacacattttcaaagatgaggaagtagcactgtgaatttatctgtgttgtcctggggcatcaagagtcaaggctattctgctatcagagcccccactggtaatacagttatgttataccaaaagaaaatgcgtgaaggaatagatagaatctattctggacccagaaataactttaaagaatgggaaagaaagcaaaggatttcttttgaatggtagcatgttttcagggctatttttatgtattattgtagggatagggctacaagactgctttgaaggcttgagatctgctaataaaatagatctgtacccatcgtcagtgaaaggtcagtccccaaaggctcctgtgattattgttagtttctcagatcatagaaagggaaacattttgtttccttctacttccatcagaaacctggtgcaaaggatctagaggcccgtagggaggtcaagaatgcatttctggatgttttaattgacagaggagtaaattgaagggagagctagaataaagtcccagaaataagatgtcaagagtctttttggcttggattcttgggtatgtgagagggtttggagggaggaacaagaggagagaaatgtaattataacctgaaaaaagaaacaataaatgcatatagaaaaataattttacagcacatacacaggccatttggtttcttttccttggctctctctggaaatattttgtgctaggtattatttctctaaaaatccccttcgatttgaagtcctcgggagagtacttgcagctgttttctgcagtgtctgtcatctttattgccattttcaatcatgatagtcaatagatatcaggaaccagggtctttcttgtaacaaggtcagtagtttgctccatgtttaatgctgacaagtcactctgcttctctaggcttgttcttccatctgtcatgatccttagtctccgttcctctaggagatattgaagtagtcaaatcattacatacagactgctgtgaaaggaatgtggtccaaaatatagacactctgttggggccaactagatggctcagtggggaaaagtgctagctgagcaagtctaaggatttgatattgagcccagtacctagataacctagcatctacctacaaagctagatttggtagcatacatctgtaattctattactcctatgtgaatatgggaggcagaaacatgagagttgccttttaactcacaggccagcaatggactatgtactgcaacagcaaaaacatcaagaaagaccttgccttagcaagatgaatggcaagaagcagttcttgaaagatatcctctgacctctacatgctcactatgtcatattcatgtcagccccccaagtacacaataaagaaatagttttcattaaaaagaaaaacttctagaagtttccactaaaaaacaaaacaaaaccaagtaaagaaaaaacacaaaacacaaaacctggggccgttgagatggcttagtacataaaggtgcttggagacaaggctgatgacctgagttcaatccccagaactcacaggataggagagaaccacctcctacaaattgtcctctgacctccacatgggcacatggcaaaatgcaagtatactcattcaacacacacacacacacacacacacacacacacacacacactgtacatgtttaaatagtaagacacctggcctatcggagtatcatagtttagtcttaaatagacccccaacactgaacttagtatatacttagacaaggtcaccaaagagaattgtttagcaagaaagtgttaaaaatctcatgtagtttcttgattgctcgtgtcccaaaccactggcaatgcacgacctcatagagactggtgctgtcttgcaatcacgcgtctgtgtaagaagtagaactctttttatttatttatttattttttttggtttttcgagatagggtttctctgtatagccctggctgtcctggaactcactttgtagaccaggctggccttgaactcagaaatctgcctgcctctgcctcccaagtgctgggattaaaggcgtgcgccaccatgcccggcagaagtagaacccttgtgttgcctaatattgcaagagtgttagactgcatattgttagattcaaagcctgtattctagtgaatgctcttcattttagtactatttattttactattgtcaagtaaaaagtccatcttagtcaatgccaataccatggcaactcttacaaaggaaaatatttgactgaggatggcttgcaggttaaaggtttagtccactggcatcatgacagaaagcacggtggcacccaggcagacatagtacaggagaggtcattgagagttctacatatcgatccacagggaacaggaagtgacctgggttgagcatatgaaaccctcaagctcacccctagtcacatactttccctgaaaaagcgacacccactccaacaaggccatgcatcctaatgtctgtcaagtgtcattattccctaatgaccatgtattcaaatatatggatctgtggggccatttctatccaaaccagtgcaaatccttaaagtaaaatgtttgtatctgaatgtgttgtatttaggtttcctctagtgaaacatctgtcttgaggaaaaccacaatgcagggatagctgtaacgctcccactaggtgatcctaggatatttctttttcttgtttgtttttgcaataccagatagggagccaactcagtcttatgcacaccagactagtgctctgccactaagctatatttctagcccttgaaatattccttaatcacctaatttccttaactctgtgaaaggaaaggcacaccaaaaagaagagcttacctcctcatggaattgcggtatggactcagagataatttatacatgcctatggatggtgcttgtcttcgtacttccttttctggcagccagccttccttgtaataagatttcatgaagttttgtggagatagttgaccagtcccttggccttgttaaacctttgtttcttcaccaaagcaatggggacagtgatgatatttagtcttaagacgttcttttttgtttgtttgttttagaacaagtgaggtgactcctgcaaagctcatgggacacttcccagagtattattcctgctagtgctgtcattgttctgttgctatcctaaatgcctctctgggtttcttggctcttgactttccagtgggccaacccatcccagctgagacttttgatacctgggatgtatccactgttgaaggtgagcagaagggatgggctttttgcatgagggagctcctgacatggtgagggctttctacaaaagcactgtacaaataggaatagacatcagtcaactcctgcagaacagctgattctctggacctgaaaacggttctcatggtgacaaaaacggggacaaagaagagctgcttaacaatttccccaggacactgggcccacgctgcatgaggttctgtcagttccccctccttactaccaagcctccactgtcagccctgccagccatgtattcccttctggcattcctccaagacaacaggctggagagccctttgtctcctccccaagtaatacaaggagttcagcaactgcatgctgccatagttacaattcctacctgatcaatagaactgggaattgagccctggtgacaagacctgccttaaacagtgccacctcccagggcatcatctgcttcatcttggtgatcaacctgccctattcatcaccagctgtgtaccacactgtggacctttcataatgtgttagtctttgtattgagggactcacaaggcaactgattgatgaaaatttctgcttcttgggttactcaatgtttctatcttaattttttcttgcctgaactattcaattttacactgcagatgtgttttatatggtatatatatatatatccatagtaatggctaatgtattgttctatttctttataaatttaaccttttacctacaggaaacatgttggacatctgttatatgttaggcaactttttaggcacatagaatatgagtataagaaaaatagacatagattaccctaatgaagctcatatactagtagaagagacatacagggggaaattaattcagatacttataaattataataaggtctaaagctaaaacaagatagtctgaaaggctgtaacaaaggaggcctaatagagattgggatatcatgaagaaaggactttctgagggaaatgattttctaaaccgtgtcctgaaatatgaatgcctagaaacagggaatgttccacacagagggaacaatgtgtccagaggccttaatgtaggtccttgaagtattcatatgactcaaattgatagttacacaggaagaaaacgatgttcactgtggcgagaaaccctacagagagtcttgctgggcatacagtaatgagttctctatgttgaacatagtggaaagccacttaagtgaagaatctaattaatgcaatttatatttaaagcatcactcaggcacctatataaaaccgggctgaaaaattgcaaggagagaaatcaggatagttagaaggccatgataatagtttagaaagatatactggtggcttaagccagggttgtagtggccatgaaggcaactgaggagatttactatacattttaaagttagaacaaaaatgactttctgatggactggctttggagattgagggcagattagagtcaggaaagacatgtcacttgagccacttgttaagtagtgctaacagttgtggatatatggatgtatcctgaagcatacagagtttaactttcttcctgggtggcatttggtctacagtgcacatttagtgtctgcatcagaaaacctgactttgatcaaaaggtcgttactatgaatgtacttgttggcttctttggtaggatttaaattatttgggaagactgattatgttttactcatctacatatccaataaagtgcctgagatatgatacatcaaatactattaaatagggaaaatggtttctttctctttcagctagctttttcttgtgaaatatatgcatatatctttggatttaactttgtagaagacagatatgacactcaacggaacgtgtgcttttaaacaacctttgagcttcatttaatcattaattggctttcacaaattattagcatgtccctgatgcataaaacatacttaacttcagtttatatccttcagcaatatagtaaaggctgtgtggtcatcacagaaaaattggctcatgggaatgtttaggatagcctagactgggcatagcaataatgaagaagagcctatggtgcctgagctgtacaggcagatagatggctttgtggacctggggttgacaatgtgactcccaggaacatgtactacaaatagtgtgctacgaggtcttagatttggagttataaaattacaaaatataactgggctaccatgctcaaacaagacaaaatgaaatattccaaaaggattttggttgcttttatgtaactcattcaaaagatctacagagaattgtgtgatccttcaggtctgagatggagtctggaaatttgtattttataaacatactagagagttctcatacacatgtctcatgaatcatattttactatatcctggttttaaaggccaacccaggaactaaagatgggtatagatagctcctttggtgtagaaaatcaccaaattgtccctgttacttttacagttactctgaggagccccaggtacttcccatgcatttgtagacactgagagatgggtcagtaaagagaaaccataacagtccttatgaaagtgaaaagggcctaaagccatatgcataacacttcaggtatttctgataagtgcacaggcacagtagattcattttttgagacaacatcaagtttgtactggatgcaaggttaggcaagagagacatcatatgcagtgctggcaacctgctgaagttactttttaaaagagatgagcagggtcttgtcttgtgctctagccatcaaccagaggtgcttgagagtagcaagttatggaatggaatgacagggggtgtggctttagcctgccagtggggtgaagaatcactagacgtttcttgcttctatgttcaccttgtatggagcgtgctcctagcctggtaatcttaaccctcttcctaagcaaacatggctctgcatctacgggaaggtgtctgactaccacagagatgtatcttcttccaattgttcagagatgagctagagtatgctaaggaaagtggtcagctttaatcagagtgaaggactgaggctgcccacaccactatcttgtgggagaaaggcacagagagaacagcatgcactagatagcctgagagaggccatgaggaagcaactgtaagtggagctgagttagaagataaagtctgggagataacataaggacacatcttattggcctttgcaggaaattttaagtattgtggcttctctgaatgagtgacatggtgagctactggggagaagtttctggatacagaatgagataagggatgccttatccttgaagcttctttgacaactttagctctgcccactttcatttctactgtctttatcacctgtcccatttcctgaattgcatcctggtccctgtgatgattagttttgccaaagtgattggatgaggaaatgcctggtgcactgcaaaatacacccttaggattgtttgcaaggacatttcccgagatgactagatcatgagccatctacactagtataatccattggcagattcaaccttgagtattgtattagttgggtttttgatgttgctgtgataaaataaacaaaagcagcttttaagagaaagagtttatagtttggtttatcattccagagggctaagagcccaacgtggcagtgaggcatggcagcaagtggcaggcatggtcactagcataggaagctgagaggttaaatcttcacctgtgaacactaagcataaagagtgaattggaagcagagcatagttataaattctcaaagcccactcccagtgacataattacaccagcaaggtggcacctcccacaatcttcccaaacagcgccagcaactgggaaacaagtattgagaaactttgagctaacgggagatatttctcattcaaatttctgcaggtattttcttgggagatggtagaagctcctgcctagttagaaaaagtagttcactgcaggcatgtttttggaagctacagtcttggctaggttccttcctattgcttctctctgcttcctggacaccttaatgtggtcccttttgctctatcacacattccatgccataagatactgacatcgctggacccaggagccaaaaatacacctttcctatttttaatcatttttctagggtatttttggtctcatccatgagaaatgtattgatgatagctaccaaactgacctacctctcaaatcttgaatagaagtcttatgatggggcccaggtagagtttttgttaaagttctgtagatgaatctaatgagcaaccagtttgaaaacctctggagtaattcaaatacctgagcaaaaaaacaatctcaacagcgcattggaaaacatttgacaactctcatgtaactcattaaccagttttaaagtaacctctatcaccactgtctagcatccaaagccatcaatgtcactttgtctccatcaggatcttttcatcattgcctagagaaaatagaggctcccagagtctctggttttgtgtttcttcctcaagcctagaagtatatgggtctagactgattttcctctctcttctggctcttccaaaaattttttatgtctattcaacatcttattcactatttgcttccttcaaaacagctacagcttgttcttaaatgccttcttctcagttctatagtcttcatttctatctactgtcctaggtcttctctccacagctgagctacctccaaagacatctgctccttctatctctatgctttcactttccaatcactcttccctccagtaaagtctggttctctgctgttaaagaatgtccattgccatgagcaccggtgatttgctaactgacaaagctcctgagtaaatctcagtcttttagcttcctcagtgcatctgagtcaactctcatcactgtcttcctgaaaatgtgtctttcctcggactacatagcaccattatttctggattcacttttagttgtttcttcaagttttatttgtctaacacttgaaatatgggtatttctagtattctttcttttcttccttaatattgttttctgacaatttcatatgtgcttttagtttcaactgtcatccacatgtctacagccattgtatgtctctcttgatcccctcatctgtttatctatttctaccttgaaatgctataagcattccaaagtcaatgtgtccaaaactaaacttgatatactccactaaatgagacaactctctcagtctcctttgcctcacttacctttctttcaaaaggtttactttccccaagtctacatctcaaatctctaaatatcagttttctggttttgggggattatttgctttttttttgttgtttgtttgtttgtttgttttgcatcttgacagcacttgttttgttattcctcatttctcatttagaccactgttgcatctgaattgcctggtttcatagcatctattttaaagctgtcttccgaatgcacataatcttcctagcttctcatatttccattagtgatccccaggacttatggcaatggttttgagattatttcatggagtgctctttttttttttttcctgaaatgggctggtggagtagaccataccacaaggctaaatccctcatctcagtaacaaacttttggatctatttactgctctctgagcacctgagaagctcttcttttagagtgagaattctgcagtcagaggaaaagtttgaatgccattgaggtaaccctcaaaacaaactccaacaagtttattgtgtattagaaatggaagagactatttgtaatgtaaagagtctgaagggctggtagcttgttggcctgagaactatccttcagatgtattagtttgataacaatatccagtttaaagtctcagcctgatgtatccttctgatagtgttctaagttctttcttctgactttcaattcagggtttctagtgcctgtcagaggcatgaagtaagtcattgtgcctgagaatacccatggtctctgtgtaggcactggccttgattaacttcacatgtagagtgccacagcattgtgtagcttaacaattctatttaacatatctctagtattttactatgtgattaaagtaattttaaaattttctttttttttaatttttagaatttcatacttttacataatgaaatatagtcatatcactcaggcctacttctccctccaagttctctactgtgtccccacaacatgccaccttctaatttcatgttgttttcttttgataactgggtaagtccagtcagtgctgcccgtatacacacggttgtggagcaacccattacatcatgggaaacatgccagtacatatattatttaaaaaaaaaaactccaccacccactatccattgccaatagctcctcataagggatggaaacaggagatcatttatcccataaatgctgggggttgggctggttgacctgtgtaggtctaagaaatgggtctttttttctacacagaggaatctggctgttctggaacttgctctgtacatcaggctggcttctaatgcacaaaggtccacctgccttcccagtgctgggcttaaatatgtgtaccaccacttcgggctgaaagaatcatttctaaagctatagaaagtttgcttccatgctagtgaaatagaatgctcttattttcatcagaactgtgggaagccaagaaggagagcctatccagtcttggagtagcagcccctattgaacctgactctcaatgagctcttagtttggagagaagctcatagccttttttttttttttccattttttattaggtatttcgctcatttacatttgcaatgctataccaaaagtcccccatagccacccaccccctctcccctacccacccactccccttttatggccctggcgttcccctgtactggggcatacaaagtttgcgtgtccaatgggcctctctttccagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccctggatatgctagtgtctacatggtccatccttttatctcagctccaaactttgtctctgtaactccttccaagggtgttttgttcccacttctaaggaggggcatagtgttcacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactagctcatagcctttatatactcttccaaattgtgaagctcagagtgtaggcttttcaactgcgttcagaaactgtgcacactctcatcaataatcaagtttctaatttttctagctttgaaaagtttgtgatttaaataaaaactgttattgagtcaaagactggagctgggattccccaggtttctatcaagttctcatgctgagtgtctcacaagtttgcaacatgacttgcggcaacttgaagagtgcaaggataatcttggcccaaatggtctctcagttccctttcacttctgatgcttagaatcttttatgccagaagctaatcagagtgaaagtatgtatgtgtaaagatgacacaaatgaatgtgtgtgtgtatatatatatgcatggcactgtcagggagattaaaaataaaaaaagagcaggtaaaataggctatgtgggaatctataataatccacaatttcgaggaaactcaaatgattctagacttgaaggaagtacagattttggccaagttcataacaaaatgtttaaatttctttgtaaatatgaaaagttatgggggctggagagatgactcagcagttaagaacactgattgctcttccagaggtcctgagtttaattcccagcaaacacatggtggctcacaaccatccgtaatggcatctgatgccctcttcaggtgtgtctgaagacagctacagtgtactcatataaataaataaataaataaataaataaataaataaataaataaataaatctttaaaaaatatgaaatgttattaagtaatcttttgccttaaatttatatagcagaaaaagaagtgtttattcatcagtgtacaatgggacaagcccacatctgagtcctcagaggttggcataattgtgttatttgccaagttgactgataataacggtagtattagtagtaatagtaataataataataatatctttggtgtagatgctcataacatcaacatttggaaggctgagacaggaggtttgtgagttcaaggctagcctgagctgcagagcaagtgtcatgccaacatgagttacataggaacactttgtcttaaaactacaacaaacaagagaactatttattgagacatgatcatataccaaacagtgcactagtcacattaatgtacatttttatagtttgtcctcttactttacctataattgtggggtttgttcccctttaagaatgagagaacagattgaaagtgggtaagtgacttggtttttgtcacacccctaatagtgggtgaaactatgatctgaaggatgcttttttatcattggaaggcgtatttatgcactttaaagtatgaaaatgtattaaacccactctcttgttttctagtctagtatttctcaaacattgatatacacaagaatcatcattaaaaccttactaaactcagatagttgattccgtggtgctggggtctgagttcagcagctgcatttccaatgagttctaagtccctgctggtacagagggtccaagagagtcaagagggtagaggcctttctgcatcctaccctatttttgccccagaaaagggccccatgggctactttgtattcgtacagcatgtcactatttgctttgtatacatcattttctcctggaattgtatgtcatgagtacttgccttagagtgcaaacatgggaaatactgattctccctccacttgaacactgaagacagaaaactgctctttcacctacaaataaaatattgatcaatgcacaggtaaaaagatacctaaagcttgtctgcctacaatgagggtggcccatttggtcttccaggcaagatgtggaggaggggagaagagaactagctggctggcttgcaggctgactggctggcatggctgagccccattcttatgttaacaatgccctgattccagaccgcagctgctgtttgtgtggggccttgggccattcatagcagcttgctttctgagtgccagaccctcagaacaggtgcggccccacttgttattttgcacagccctgactgttcagacagggagctgattatcactgtgaatcagggattactgctgatttaccagcttctccggaacaaaggggccagcctccagacagctgtctcttctggccgcagtgagtctgatagctctgaaggccactcgggcctaagagataggtttgcattggaaataggacagaggacaatcagacccactgaagcagttctggcacaggtcaaagtgtccctgactcagaaagcttgtcattttaatcatagactcccaaagcaggagatgaaaaacctactgaaatatccctgaactcttctcaggttcgtggcatgctccttcttagcctgagatctatggccgtggccaaagtcaggagaagagcacctagctattgctgcctttgctgaatctccaacccaagctttgaaaataagaaaatcagctcaaagctacacaaggcagagccctgtagctttgtgcttgagaagtttggcttcggggagaagcagtttggatcaaggtcactacaatgattgctctctgcagggcttagtttttgtcacttttccttgataaatgatggcagtacttccttcacggagctgtgagggtttgccatttatagcaatgaaggcaaacacaaatgggaactactgaggactgggcacaagatgatcctctaaaagagaaatcgatatcaaccccactctccataggttgcccaggctgtctctgaactcagctatcctcctgcctcagccttccaatgtgactgtgattacaggcattcaccatagcatccttattatccccacagtttaggaaccaagagtggaaggagttaagcagctttcctaaggcacacagctaggaggcgctagagcagggaaatagccccaagctgtctactgcagaagcttatttcctccttcctcattgtacattactttacagactgagattatgcccagaaatcttgggaagtgaagaggattatgattcatgaaatggatctagactcatgctttcaatgattagccaaataggtagctgtatatgatttaatgtggaaggcgtttccctagctggagtctccacaaacaacagacaaattgtctttgttgccctcaaggttccagttccctcctcatgtacaaaggagagtgggacagttcattttgccacttgacttctagcagaccatttttgatgccgagagagcaacttttcatccttcgtcacccgagtttctcctcctccttttgtagctattttctagaacgctgctttccctcaaaatctgtatccttgtcaatgttctcttagtatgacacagatggaaggagagtaaaaaatgagagtgaggacagtgagagggagggggaaaggaggagaggggtaaggagaggaagagaaagagaaacagtcttctcaagaccaactctaatcttaaagtcagttgagactgctgttttagaattatttttattggcaaagaatgtctataatatacagttaagtaagagaaatgctacaaaatatatagtgctgaattattttgaaatgcatatgtgtatagtcaaatatagaaaagagactggaaggaactattttaaatgcctttttccttttaaagttttatatatatatatatatatatatatatatatatatgcattttgtatatgtatacaacaataaaaattagggaaaaggaagccataggtttcagagggagtgaggggggtatgtaaaaagagtaggagggagggaaagaaaggtgggaagacaatgtaattagtttttaatttaaactaaataatattgcttatttcttgtgaccactatattatctttacatctctattttgttcttgctctgattaaaaaaatcatcagtaatttcctatatgtatacaaagaaacataatcatatctaaccccatttgccttcagttcacccagatccctccttactcctctcccaacttcattgtgggtgctggaaagtaacccctggtcttctgcaagaacaatgcatgctcttaaacactgagccaactctccagccctgttaacatctttttttaggtatatctacattgcaatctcgatttatacttcatttcttcttgttgacggacactgccattaaatgcacattcatattttgtctatccatttatttgggttgtttccacttgcttggtgatgttttcctttaactgtgttttaacaaaaaatatatatatattccagacacaacttgaaaatattttcttcctttcagtgtgggctgtcttttaattttcttgatggtttcttgtaatataaacatttgttttattagtgttatatgaattgtgtattattttcattgctttctcatgcttttagtgtcactttaaggaactgtttattaatccaacgttattaactgtcatacctctcttctatgagttttatatttctagcttttatatttacatcacacatctctaattttatgtgatataaagtaggagtcccatttaattgtactgtgtgtgggtgtgcatttttcccaatgttttgaaaagaccagttttactcttgacacacttgtcaagaatgcaatgactataaacatgcagcttcaatttcaattcaagtctattgtcctgtgtacatatttatgccaatattagagcattatgactcttaaaatttaagtgagtttcaaacttaggaaggatttatgttccaattatgttattctttttaaagagtcttttgattattaacattcctttgcatttgcatataaaatttaaaattatcttgccaatttctacaaaataaatagctggaacattagtaggattattaacgcatctacagatgcacgtggagaacataggatatatttctgttatttagatcttacttaatttctctcaacactgtctcatactgttctggttcgctattttttaaatgctcatgcaacaaacatactgtgatcatattctttcctttccaccaactccttctgtctcctcccagttcctagtcattcagcctcatatattttcagtattttcagaataaaacgaacaaaacataaaagcatagaagcaaaaaaatggagtcttatttgtgttggctaactacttttgagcctgaggcctactcaggattgtttcatatgcacactacgttgaagaaatctgatttcccatctcctgtagccaccaatcacaaagaacttcctggttagagtaggccattgtgttagcctctcctccttgctgcgatttttgtctggattgagcttagacaggtcttgtgtgtgctttcatggtctctaaacttgtatgtgtatcaggtctgattgtgtgtggcaaagtttctttgctcaaagtcattcaccacttctggttcttaaaatctttctgcatccttttcatatagataccagagctttgagggaagggatgtggtgaagacctccttcgcatttagggctgtctgttccaaagtctctcacattctgtacaaggtccagttctgagtctaagtgcttattgccatctactgtgagaagaatcctgtctgttaagtgatgcacttagttatgggtgcagcaatatgtcattaatagtcatattattgttatgctaatttagcagattaacagtagtagggtttgcttagagttcatgaacaacctgatcttagatttttgggccctttagcagagtcaggtatggatttcatgtcattgaaaggctcttaaatccaatttttaaaacggtcctgtgacatttctgcctctatttcgccagtgggcacatgttgcaggcaggaatttattgcagcttgcagggttcttagctggatgagattgataactgcttctctcctccagtaatctgcatagcatcttccagtactatgagtacaagtcagtaggggagaagcttcttctagttgagcaataacacagtctctccacgcttgatgacatagggaagtggtgttgtcagcaataggatcttaatgtcaagtagtgaaggtatagcatttgaaataggctgtgatatttggggggagtttgtggtctatgatatctagttgaagtagtatctcttctatttatggtaactgcatttaaactcttttttatatgttcatattttagaaagatccctcctctatcctgtcctcctatccccctccaccttaaacttcctatctaatttctccattatcccttataacagtgcattctattttgccttccttctcctcccacccccagttctctgttctggtgatatggtttgcactaacatataacatttattcctagtcattttattatttttgtctactatgtatggaattagtctttagttttaatattttctttactcagactttgttttactcaattgccacaaatagaacttccaatacactgttgaatagaattagccaagataggaaagctttagtcttgtactactaagtacaaatggctctcaacaatgtcttacagttgccattatgattgtacaaaagtaataagcattcggtacaaagtgtactttctatttttagttctcacctttccttgagctggcaaaacacagtgtgataatttctcatgatgctgagcagcagtattgaagtgagtcacagattccagtcatccattgaagtcacagcagagcaacatatcctctgcagttcactgtgtccctacctatgacgtttgttagactggatataattaaatttatgttgcactcagggcatttcaacttacactgaatatagagatatttttgacagtggtttcagttgggtctccattgatgcaagaaagccacatgagcagtttacttcccttcccttccgagtcacagtccatcattgagggaaatcagggcaggagcagagacaggaagtgttgaatgtacatgatttttttttctcctggcctcgagctcccagaataacaactctgagacacaattatatttacacacacctttgccataagctttggctattctccaactagctcaaaagttagtcatcccattatttattctaagttctgccacatggctggttacctctgctcagctctaatgggtctgttctcctttatgtccttgggtaaatccctgcatttctctctattccagaattcagtctctttaccgtacgtcccaccttctatttcctgcctatgtttatatgccaatcaatattttattgacagatgcttcatctatacagtacacaagagattctctctacagggcgatcacacaggaatgctgtttactggatagctttctatggttcactcagctcactttttctacaaccagtaccatctacccactgggagcacttcccaaagttggctggctttcctatagtaatcattaatcaataaaatacctccacagtcatgctcatagttcaatctgatagacatactttctgagaaaagtttccatacttccaaatgaccccagtttgtagacaaatccaaccagcacagcaatgccaagaaaatttgattcttcccatagcttattgaatgttttgtcatgaagcgttagcaagttaacagattttgtttatgggtttttatttttggctattgaaataaccacatggttttcttcatccaactaatgaagtggtacattatattagtaaattttcacatatcaaagcaacattgattttatggaataaatcccaattggttaagctacataatactgttttattttcagttggattaagtgtgccaactgatttattcttgttatgttgttgagggttacacatttgttgtgagttttttggtttattcaagtaaaggaagccttctcttcctacttttctgaaaggaaaacgtttttttcttttgtcttatcatgaatgattatttgaaatggattcctgcataaattgatatgatcatatttttaaattttaatatgttgacatggtcagttgcaaaatctgtttttggcatactgagctaactttgtatccatggaataaatataagttggtcatggcatataattcttgaaaactagttataagttatgcttagctaatatgatattgagcataaaggatattgttttgtaatttgtttccttctacactctttccttccttttcttcttcctttcctctgccttttatatattatcattatttgattttggtgttagagtaatactagtctcataaattatgatagaaagtgttctcttggccatgtttggaaagtgatgtagtaaattagtatagattgtccttcaaatttttgatagaattcttcaaggaaaaccctcagcagactatggtggtggcatacactggtaattccagaatactgttgtatatttttcttcttgacacaatcatttacttttgatactgatggaacattctttgtgtcattgccattactgcatgctttcaaataacaaactcatttcaaatcaatggtccatttttataggccagtatgcttaatggtgtagctcaatataacttccttttgagttgttggtcagtacagttcaagagactcccaaaataatataagctactattttccccctttgaatgcctcccagaagttgaaggtaagttctaattgcttagggtaccacatataggacctgaaagatttgagctggatctgaactgaaagtctccttcttaaactctggcttttatagaaacagaaggtactttataagctgctaaagaagggaagtaatcacaagtcctacccagctgtgatgtatatgaacaacaatggccagaatggcaagacatccagaacgattcaacagtaacactcacatattggtagtaactgcctaattggacttaaatccttctcaataggaataaattcatgcttggcactagaaattcacttagctgagatatacagacccctcatcctttgccccaaatatttctgtatttaaaattaaagctcatgtccatactcaaaagatgggttcaaatgcttatttttttatatttctgaaatggctgtttagtcatataatctaacatatctattaaatcaatttcttataattttggtgcagttcacttatagagtaaaggtgattatgcaaaaatggtcatagaactgaatgtaaaatgtgaagtaatattgatactgttgagtctgtgatatgatggaaattttgagaaatgtttgagacccagtagaataaccctaaatttagaccctttcaaattttgtaactctgaagtcggggagtcagatgatgttttctttctactgtgacattgaaacttatagctagaaatggaggacagtgtattctttgaaaatgtcaaggtcttaaaagataagaaaaactgaaaaacagttctactttttaaaagaggactaaagtgaaattcagtatcaactctagaattgattcatgtttgactcctatactggataacttttgttgttgggttaattagttaaatttggaaaaagtatttagattacataaaaatattgtgtattaatttattcattctattcattgtcttggggcaatgaacaaaaatttccttcatatatagtatacattaaagtatctagggataaagaaatatgacattcaacttactctcaaatgatttagaagaagatctacatgctatgccatgtttgtttgatatccctgggagcctgcccaagggaaatggtggaggaatgggtcccaggaagaggggatgtggggaaaagactgggaggagtggagagaggggaaattgtagctgggcgaaacataaattaaataaaatattacatattataaaaagtatgtttagccaggcagaaaagctcaaggaaatgtcccaaaatgtcaaaatttggggaattggaacaaaaggttgtggaacttctttgaaaaataattttatattttactagtaaaactgattagaattgcagcctggaatggctgacccatgaaaactgttggaccgttagtctatgcagtgttaagtaaggcaaaagatgtattagagaaagttgaaatggcagaaaggtaaatttaagagatggtatggggggagggattcatcctctcttggtggtcagacagagaagagttaggaatgcttctgaaattggaagcctagaaactgggcttgcactggtagaaagaggcagatcaagagcaagctgtttgggatgccaaataagtttgtggatacacgagcacaaatgtaccatttagtaaaaagaaaaataaagatcagggctggagtccgtggtttggtaggcatttcaagacttttacaaatggagttcctctatttatagggaagaaagtatacttcttattttacaaggcatgcctagttagttgtaggcagttgcactgaagtcaaataaatttgagttcaaaccctcacttttcacctttctagccttgtgacctccatcaagtatccaaatttctcagagctttgattcttgcagctgtgaaatggtgaccttactcacagaaccaacataaagcacttacactagtcactggtgcataagtggaactgaagaccttggatctggttttaattggtagttcctttcccatgcttgcctgcattagacagtcctgtctctgtctgtctgtctgtctgtctgtctgtctgtctgtctgtctgtctccctttctctgtagccagtaaggatgacacaaggttaccacagcatgccatctttgacacacagaggacaagtctgtaaggcatcactggaaatgataattgctttcttcctctggcaatacaagcaggagaataggaagctctaaggggttacacgaaatgtaagtcacagccaaacacatggggcaagggcaggctctaaagactcatgtggatttccagaagtatttcctccattcaaagcctgtctgtctcaggtcatctagaatgtggtacttggaggtggtgaaaagaatgatctaaaatgacttaggggtgccatgtacaagagacagatttaaatttattaaaggtactaggggattccccacccctataatccctaccttaagaagtagtgagttacaggaaatgtggcttgcccaggcgtaaggactgacagtcacctgctagcatgtgtcatctctgaggaagatgcagctctgggtagccatgctgctaggctacatttgttcctctctgcaggagtattaatcaatctgtagacttctgctactacatgatactgcaatcaaagtgatcccaaggaccttaagagttcctgattaattctttcccctcagctgccccgtcaggtcagcattactttctttaatttctcagcacttggctcattgtctcagcttgacttggctctgcttcttgctccaagtaccttttttcttttatggaggagagggattggatgaagtcatggagttctgggctgcttggaactggtcctgggagcagcatccttgtccttgaatgaaggtacattccctacaaaggaaggccttggagccctgatttaaaaaaaaaaaagtcaaaaccaaaaccaaaacccaaaccaaaacccagaaagaaaggttggaaatggtaagagagaaactgaaagaaagagaggtatcaggatgctgtgaataagaaacctggagaaaccaataggaacaagttgagattattttaccttgggtcaaaaaggaacaggagaaagtgttgtgaagcagagtatctaaatatcaaggattactaatttcccagtggccccttgaatgacgcttttagatccacagtgaagttgtagctttttaaatgaggagcttgcaatattggttagctgtctacttaaatggaaagcttaaatcataacttgctcatatcaggacttctggaggaatttccacatggattctgctaacctgctttcttgcctcaaaccccaaattgttcccattttgtttttattccttttcacatcatatcctaggccctaggttatcctgttgactaccttcaaaacagatcccaatattggctccctttccccacctcttcagctataaccttgtgtggactaatgccatctttgtcttgggctagtgtgatggactcctactcacttccactcctttaggttgccacgtatggatgttcagggcaccatagctaagggtgtgccatttatatcacagacacatactaacttatataagattgtgcagattgatacagacattctgaatttcttggctctaagtataagaatgacagaagagattctgcttctacataaaagcaaccccctgtgtgttaccttgaacagacttgggaaagcccatgcaaatatgcatacttgtgggaacacacaatggttcagccttggccctgaggcacttctttcttccactgcctattgttctaccaggatgaagtcctatcttttccatcgacagttgtttcatctggggaagaggtaaaatattggagtacaaaatgccttgatgatacatgtattccagtgacaagaaatgtacgagtgggaagagtgtgtttgtgcatggtccagactgacacccaccatcattctgatggatgccctagggcaaaaattaaatggcatttagtactgactataagaaaccacctaaacactgttgttttcaatttgaggagggagcatctttatgtcagagtgtaatagtcctccagacattctcaactccaaacaatgatcagcacagactttaacaaacattggaaacattgaacatattaattctttgtttcaaatccaatttactttgcaatacacttaggatgaaggcacactacaacactagaatgatctgttccctgccttcctttgtggactcatctcatttcactgttcttctcactatattccctaaccccaaccccatgttctattcttaatgtcaccaagctcatcagtgacaataaattcatacagttcatttctgtcttcctcttttcgttcccccacttctagagtcctgattctactaaccaaggactttggccaccattatgtttttgtcacctaatatggtgcctggcatgcaatgggtagccaataagtatttgctgaggatgtacattatcaggaaaacagacaatttccatcaatttcctccctactaggggttttaagatgtatataatatatagccctgtgtctagtacacttttagatctcttggtagaaagagatgagcagaaaatacagtcatttgaaataaaaagcttaaagacccgtttagccaggaagaattacgatcagcataatcatcaattgttgagatattctctagactctaaaatcacttagtatcgatagtgaccttatgtggtacctcctaaaatcatcactatttgactgttagcacactcagtcccaggagacagagtgacatggattcagagacaggttgataagaatcactctgaagtactgcaaaagaatgtttcatttcctctcatttctttttttcccaaataccatgaaagcatccccaattctccaaatgcatctcattctcttgaaccgcagtgggaagcaggtgaaacaggggcacgtgctatgtaggcaagcaacagcaagcacagatctcgttagcaacaccactgggaaggagtcacttgggtaattgacaatacagattcagaagctggggtattttgtacattcatgatattaaaatctataaaagcatcaaatcctgagctagttttgccaaactggaagggaattgcaggcacaaagaaaatttaacacccctttggattttcttgatgtcacatggaatgcttctactgaggtgagaatggcagtagcttgaagctctacagggttgaaacctcagttattaaaaggctggattgtactcaccacctgcacatggagagagaaaatggcacacagagaagaggtaactgactagccaggctttatagcactgaatgccaatatagacaatgaaactgcaacattgggaataggcagtgcagttcttcatgagattatcagaattctcctgggaataataataataataataataataataataataataataatttgcctattatccaacaactcaattccccaccaacaaaaccagattgtttggggaaatagaaacataactcagttagcacactgcttacataccatggataaagcccttgggtttcacccctcagcaccaaacaaagtgagtttgatggtgcaagcctgtaatcccagtacttgggaaggtagaagatgtccaagatcatccttggctacagttggatttggaggttaatatcggttatagaccctgtttcaacacacacacacacacacacacacacacacacacacacacacacacacacagagagagagacagagagagagacagagagagagagagagagagagagagagattgattcatgcatgcatacattgaaattagcttactgagcttactgttaacaaactgtccctgaaataacctaaaagatctttagattaagtgtactcactttatagataggaatactgaggctaagataaagaaatcctgcttttatttttttatcgtgtgtgtgtgtgtgtgtgtgtgtgtgtgtgtgtgtgtgtgtgtgtttctgtgtgtatggaaggtttgcctgaagaaccgtaaagggaaaaaagaaaaaggtttacattgaaaggggaagggatgaaaaaaatgttagaattgatgcagtgtttaagaaataactagtcatttgtgacatgaccacatacaaactgtaaaaacacccctctctgtggcagaaacagaggagatattctcaatggagagaggtcctcagctgaagagactaaatgggggccatttatttccttctacctcctcttctgccatccagtccaccacagagtttggctgtgggtgtgcagcagtttgctccacagagacttccatgggctgctttgctcgtggctggtggcattttgcctctgtgggaggaacagagccttttccctttatcaagaaatctatgattttttctctttaaagcacagtgcagagctttttacaaattgcaagacagaaatagaaatgctgccagtcctcagcacagcctccttgaggtcggggcaacctgtccctcaggcagtgtatgaggagagctcatgcatttctgaaattggtggtataaattctctgtggaggaaggcagaaaacaagccatcttttcttctgacttaaagggagctaggcttaggagctcttgagaaagcccatctaagtgcactatcaggccagaagggagtcacagtgttgcagcttggctgtaacctactgtggggatttggataagttgtttctgctaagtgagtctgattttcttctctgtccttccacatttgcagtatgattgaaaggtctaagtggagacttgcatattccatggaaacaaaacaactcaatgaatggcatagttaagtattgttttgtatctgatctttaccttggatgattgagcaatttgagtgtgcaatttggggtagtagggcagatcaaatgcctttgaatatatattcttgggaggaatatgagagtgggtggtatgcatacaacagtagattcggaatccaatcatggaaagaaaatcacggggaaaaccttgtcttaactatcttccctgtgccttgcagaaaattaactgaagtgctctaagactcagcttccttgcttatgaagtgggggttgtcatgagggcttcagttagataaggaatggaaaactcttatgctgctaaggatggcataacagcaattactgttgatgtcatttgcctctgtttttgagaattggaatttttttggcagtgcacagctggtccttggtttaaaaaaatgtgtgtgtgtgtgtgtgtgtgtgtgtgtgtgtgtgtgttcacatgcacgtgcacgtgaagattcatagggtaaattcaaagaacttctcgttgattccataggtttggaaaggagttgtgctggaactggaggtacagataagtggtagaggatttacttacaggcatgagtcccctggttccattgtagcatgccctttcaacaaatcacattcagtaaagatcctaaccaattaggatgtgtggcagacttggccactgttggccaatagcagcattttcaaatgagatcatgactcaccaggaaatcaacttcaggagcaagaaggagcattaaaaccacttaccaacaacagtgaaaggaagtaacagtgtacactatatacagtaaagataaatatggcttcatggaatgcttgttccatgtatatttataattttatatggttatacatagattataaacatgtaattcctacatatatatgcatatatatgtacattgtatatacatattttgtgaagtaatcctttactgtagatcatagttaaacatgtttgaactattcacttttcatttgaatatacagagaaataatatgtcaagtcctaaagtagactagaaattattagcaagagaatgcaacatgattcatttcttttccctccctatctttgccatgctatgcttgggtcaagagagttggctattgtttaattagaattgaatcttaataccatgtaatggccttggcctaacgtataaggtcaagttaggagtttggttatgagtatcaggctaattgcattgaccccattacataggaaatgcatctggctttattggagtgttcaattggtgttcattagcaaggactttgtatacctctgccaaagattagtccaaagatcccttgtgcacaatcttctgtcttgtttccaggcattgatatatattttactataggaaacttcacctttgtgaaatcaaataacttgttaaaattatgtttgttaatcatgtgtatgtgagcttgtgcatgcgcacgcatacttgtgggtgcaatgtatgtgtgcacatgtttatgtgcatgaacacgtaggtgtgtgtgaacacatgtgtaggtctatctgcagacctgtgaagtatgaagaggttgatattggttgtcttcctctgtcattttccacattattttttgagacaaggtctctcactgaaactgggctttgctgatcttgcaaagccagatgtccagccataggaatcctcctgtctccacctccccagcgcttgtagtacaggtctacaccattatcagctttttacattggtgctggggattaaaactcggtttctcctgtttgtgttgcaagatttgtattgactgaaccatttactcagacttaaagatgtgttttgattcacatcggcacacacaatttatcttttcactgtgtacttggcatgtggaagatattaacatccttaactcttcatccataaagtccacataaaaagggcaagcaatgttacattcttattcccagggaacttctgactatgtgggcatttgatcattgaaaccccttgtacactgtctatacaactgttggctttgtaggatctctaaccataccatttcagaacccttgacttcctacctggctttcagtttcctccatagtacttatcatgcatacactttgctttaagcagtaaacagatgagtaaactttacatgtccagatcatttctctaggaagattaaaaatcaaactttattttaagtcttcctgtttgctttggtttgcttcccaccccactttgagacaggtatcagtagtagaatgggctagtcttgagttcctcatcttctgcttcaacctcccaagtgctgggaagacagccatgtgctaccaacacgagcttaaaagttccattttttaaaagcagatacatactttgacatctgcacgttgatacaaaatcattttaccttcccatgttagaatttgaaactatttttcacactgcaccaaagaaaaatctgtctacagtacaggtaggatccagtagatcctaaacttatgattatagatgtatgtatcttaaactttttaaacactcaagctatgagtggccttgcaaattggagtctcctagaaaggaagtacagcaacagacgggtttcagagccttcctcatagtcacatccatagttggtggcagaattagatcttgtacccaggtttctatcatcttagtgccctttcactgttatcataccatctgctagactgtttctaccaggggctaaagtagtttgccatgtggtagaagacaacagtcaccagtcctctccacacagattataactgagttatcaccattcaactgatgagccccaggcacatctctgtagagtggataagtttaccttccttcccggtctgcacagatgataatgcctcttggcattctgtattgcctttgttttatgccagtgacagaatgaagacaagacctttataggaaggttatttgcattgctcctaccagcagaatctttctgtggaatcagtgtggtctagtaaaaaaactccagggtgtaaagtcacagagggagtctcacttctcgggtatgtgacttaagacaaattattcaacttccctggctcccagttctgtcaactgtcaacaagagaaaaatcagacctgttcctcttatctctcaggtccactgtggggttatgtgagataatatgtgtggagtaccttgaaaagagaacatctgtacaactatgaggtcactgtaatatcataaaatcaacacaataattactgagggtctactatttacatgcacagtattgactcagggcattccaaggagcaaaggactcagctgttttctggagctggagtctaactgagacagacatagctgaatggaaagaaagccagccttacaaagctggcgataactgtagtgtatgaacttcatggtgagagggagagggagagggagagggagaggggagagggagagggagagggagagagatcatggcagaaaggccaaagaaggattcctagagaaaaatgaatttaaactatactttagggtgaaattggcaggataggggaagcaagctagggagaagtatattctcagatgggatgataggacacgtagagactgaaatcctcatctgttccagaggcctactcttcaggacacagagagacaagttagtgacaactttcctagcatcccagctgggatgtgctgaaagataagcaagcatgtctctaatgaaaccaaggcagatgctaaaaatgaatttatactatactttagggtgaaattgttgctagtaccttgaaatttgtctgatgttagtcatgaccttgaccagggcatacctcctggcttttcagtgtcatgatttttttattagatgttttcttcatttacatttcctagtttcctctctgaaaatcccctatacccttccccctccccctgttccccaacccacccactcctgcttcctgaccctggcattcccctatactggggcctagaatcttcgcaagaccaagggcctctcctcccactgatggctgactaggccagcctctgcaaccaccaaacctagacactattgcatataccaacaagattttgctgacaggaccctgatatagctgtcgcctgtgaggctatgccagtgcctggcaaatacagaaatggatgctcacagtgatctattggatggaacacagggtccccaatgaaggagctacagaaagtacccaaagagctgaaggagtctgcagccctataggaggaacaacaatatgaactaaccagtacgcccagagctcctgtctctcgctgcatatgcagtagtgtcatgatctttaagataggaattttaatagtaccaacttcagaggactatcatagcaactaaatatcttaatcaagtaaagtgtttatcacagttctaatactctgtagcactcagctgatatcagctactataattattatcatcagctgagaagtaatgtgccatagttgcatgataagtgaaagaaattgagaaaaatttaaaaaggcatctcaaatctaactacttagcattttaatttcttgttatcagttttgaggccagttttaaaagtgagatttctttttttttatttaacttaaactttatctttttactagcacatgattgtttgttgaaataagagtagacaatagcatggctctgggaggcagtctatcggacctttactgagcatctgtgtctatcggacctttactgagctgtggttcttgtcagtgtgctagaagccgagaaacacacacacacacacacacacacacacacacacacacatacaccagacacgagaactacatgtctacatgtaaagaacttacagaaccatagagagaggacatcaaatgaactagcaaaatggacatcaaatgaattatctaaatgcgtattgtgttatattgattaaagtggttggaactgtgtgtatatgtgtgtgtcactgtgtgtttctgtgtgtgtgtgtatatataaacttgtgcaacatagaatttaaacaagtggccaggaaaagctcactgagtaggtgatctgaattgagccttgaaggaagtgagagagtgaactgtgaggcatctcaagggaaatgtaagaagaaaaacacatgaagggaggaaacataaggggaaaggaaattagacaggtcactgagaccagatgttgtcgttttggtttttggttgttgttgttttgtttttattgtttttagttaagttcggagagttctttgcagggaggtgaaaagaaaggtggaagctcctttgaacttgagttgaccgatctcggtcatcagctcctcctctgtggtggtttactcctcaggaggcctggaacaatgataaatgagacagaagtcaaacaagtcccacaaagctgcccttcacaccctgtggactgcacagtatgggctcattgtatagtagggggtacacagaaaggaacactgacagtgactcaggaaaagacctggagtccctcggagccaaaggccttattaggagagttctgccactgacatcagttcatgccagtgaaccctcttaccttatcagtcttccaagcctccagcaggaccttctctaggtcagaacaactatctgacaagattagctgttctccctgcctgtttgtcaccactggatgtcagtgaccctttcagccccgtaacctaaaacaaggacctatctgtaggaaagcagtagagatttggcatttgttggctagtaagtaccctgtatattatcaccctcctgcttcataggacccaagtctcgggcaaaccctctcctactatgaacttctgtttcttcttgggaggtgttaaacatcttttcagtgatcctctaagaatgtgatgtttagaattgaataggagaccctataaaggaatattggagactacaggaaaacaatcatgtttagcagcatccagaactggtactttaattaatatacctacctcaaaatggtactctgagactttaccaactaaataatctaccttcgttcaactgctatcttgagttacgtatgtggctcaactcaaacttttacatctttcttgattgcttggtcagttggtatgtgacctgcttctgagacactgtccctgcttccagtgtcacaaaatggattattaaggtttttgttgagtagtttttttttgtcttatttaaatttcaccttttaaaattttagcccagtacaccagcccatctgagttcactttgcatctcaattttgttcttcaacctctttgatcctctgccagctttgagtcatcttcagacgtggtaagtacattttatatatctcgtaaattattaacgacattggaaaagccccggggccctcctctggaggcctttctactggttgccacctatgctgtgggtaatgttctttaatcaattgccactccattgggctatgttatagtctggttaatacgttattgttttttcattcatgagaaagccatgaaataaaatgaccaaatgcattactgaatcaaacatatgagcactgacaaagtgttataataaacaggatgtataaggataattgaagatggagactttgcttgtttgccttgctacaatggaaatatgagtatttgcttcctaattataaaagtaccatgggtttgttacaaaggtcaatagtgtgtactgaaggtggatctacgtggcatgttggcactctgctagatatatctggccagtttgtgaatttataaacagctctaggatttgagatcataccctagagaatgtttcatgtcctgctttatccccacccaccacttaaacatctttcttgtcagagtgtacagttttacttcatttccaaaatatagtgttcatgttttgtgtcaccaagctcatattgctgggcatttagatcgctggcatgaatcctattacacgtactatgatgagactaactttcttgcttggcttgatgagttgtactaggattctttctcttgtattttttttttttgcattttttcaaatattttctcctcctgctaaatgtccaagggtcacttctacccaagagagaacaaataagattgaatagctatcatttactgaattattgtgagccaaattactactcatcagggtttgagttagacagtgtattctttgctgtaacttggaatggggttaagaatctttttaatatttttattctttcattgagaatttgaaacaatgtatcttgatcattccacaacttctcacagattcacccttacttccctacttccctaacttgatgtttatctctctctttttttctgtatatttttttcattttcaaatatccatcaaatccagtttgtgttggccaactactctgacatctcatactctgaataaactattaaaggacactgaccttccctctctcccagaagccaccaaatgacaacagctctcctgccatggtgggaatctcatgtctacttctcctttatgttggaattttgtttggcttgaattatacaggccttgtgctttctgatcatgagttgtgattttatatgtgtatctgccctgctgtgtgcaggaaacactgcttacttgaagtaatccaccagcgcaccataccgccaccataatctctgtagcctctcttctgctaacttgccctgagctttgagagtagacgtttactatggatgtcccattccaaagtcttttactctatgatataagaagaaatttctttcatgggtattgagtaatggagggttttttgttttttgtttttaaatcaagcacttcaggatgaagatttgagtggcaaacaattttgataggctacaggtcctaactggccctggtatgagtagtaccagtggtacgattaggaacaccaaaagccacaagtgtctttaatcattattccccattatatatcctcaatgccaaccaagtggagccatcttctagctccttcatggtgcccttctttgtatagccatgtgtgtactctgtctgttcactgtatacatgcattttctagacaaggtagtagccatctgctgtgaattcttataactctttaagatcactcatgtttgactatctgaacttcaacttccttgtcctataactcggaataaatcatttattgtatctggctgtatttatcctcatctgtagaatgaacatttacctaggtggtatatatcaaagcaccttgcttaatgactagctgattcaaagcatttagggaattttagtcatgatttttgtcatcatcatcatgggatcatatcccctacaccattgaattgtgatggagacaaaacaggaacatgggcaaagcccatgttaaagctcagcataggaagagtgccaaacaaaagatagaagttaccgagttttgtttatatctccctttggatagttaacttgttttctcttctgtcacttctatgcatgttcatgtcttaatctcccagaaagcagaaaagaatcaggactgaagattagtgaagttcttaaaagttcatataaggaaacgctactatgacttaaaaaaaaatccctttcagattagatcatttgataggtagatggatccgtttccattacctgacctactagggcagcctgggaaaattggggcatagagactccagcctctaaagccactaatcacagaattagctaggtcatgaaatattttaaaaaatttctagaaagatttcctcaaaactacgggccttgtatgtgagtttctctgagcagagatggctgtactccactcatgtagataacagggaacaaacacccttagccattagcctagttcaggctcttagagtaccaaagcaggctcctgagttccttctgtgttcactgatgcctttatgcaacacagtaaatcagatcatatcctcctcaaaaatcttctcacagctctcatctcatgaagtaagttttgtttttgtttttgtttttttaatacttggcacagtttatcgagcccagcataatgtagttcctatgcaccttttttaatctcatcttgccccactcttctttcctgctttgtaccacccacaataaccttctgttctgagaatatgccaaactcaattgcactccaatgctttcacttttattctgaccctctgccaggaactagacctcctcctggccctcaaattgtgtatgctttatttattttctcttccaagtttccacattaatgaccccatgtcaacaaaagatgaagtcttcctcatgtgatttattttcagtaggttttcatgttttcagttcggttcaattcattggctctaaggtttgcttcacactgagaatcacttagagaacattaaaaataagacaatggccaggcccttctagaccaagtaaggcagaatttttgatgttgaattctaggcatctgcaaatacttcctactgtgatttgaacaaccagccaaagttgatggcctccattctggtcaatcagtctgtttcttttctacttagtgcttgaatcaggctacaattaacttgtttgttccatccacttaatcagtaaatatttattgagtacatactgcttgccaaggattactggaaacacagggagtaaaacagtgaacacaaatgaatacaaatcccaaacttcataaaataacaattccaataaggaaggcagacaataagcaagatcagtcaggcaattggtgtttgtttgtgatgttactgactgaatcagtaagacatactgtggaatatgtatgtaaaattctacaccgaaagtttgtatcttcccatagattcataaattaaagtacaaagccacaatgtggtgtaatttaagagatggaatttggggaaataattatgtttagatggggcaatgagaatggggccttggtctgtgggattagtgctcttctaaaaactgctgactctacagagatttctccttcccactttctctgatctgggtgaggatacacatgtgagtcatcaaggtatggaagctgcttataggccaagagaaaaggtttcaaaaggagctagaagttgtctgcatctagatcttggattttatacccctgagaactctgataaatgtacttctatttatgatgtctaacccatgatcttttactatggtatcttgaattgactaaaatatatagcatgttagattacaacttctaaaaagaaaactaaaagaaaagaaaagaagagaaaagaaaagaaagagagagagagagagaagacagttttgttggacatataagtgtagagtccttggcctagtcaggaagatattgaataaagacctgaaggaagtgagaaacatagattggcatttaccagaaggcagcacatttaaaccaaggaaagcttgtgtacatgtactgaaattgaatcctgatgtaactggggggatagcatagggataatgtgcatatagttgagaataaggataaacatagtaggagatatcttcagagagttggagtgatgctgagataattgaggcttttaagttcactggaacacctttggcttttactaagaagtgaaaatcatccaacagagagtagctgtcttatttatatttctactgctgtgataaaacacgatggccataaaaaaaaaaaaccaacttgtggaggaaagggtttatttcatcttataacttatagtccatcatttaagggatactggaataggaactcaaaggcagaacctagaggcaataactgaagcagaggctgtagaagaatgctgcttactggtttgttcttcatgaatatctcagcctgctttcttataccatacaggactgcctgcccaggggtagcatctcagtgtactagaccctagtgagctgggcctacaacctatggttattattattcaagaaaatgaaccaaaggcttgcccatggtgacaatcttgtggaagcatcttttcagttgaggtgtcttcttcccaaatgactctagcttgtgccaagttgacaacgcactagctagcatagtagcataatttgatgtggaattgaattggctcactctcttctttattgagaatagacagaacaaaggaggtggaaccatctggaaagctaatgtagacaagagatgatggtgccttgtagtaggattgtactgatgttacaatagaaattgctgtagcttgtgcagtttgggtcctggaaccctgactagaggtggcaaaggaaatcaagaaaggacaggtacacagacacacataccatgaagctgagatcaggtaagattctcctatcattatgtcatcaagttggaacctcatcatgtttattaggatagcacagggggaggagttagctggctcagtaggtcacctctgtaggttatgaatctcaggctgtaaacatccaggagaaagaagctacagttgctaatctttgcacacagcaattagtcattcataatcccatatacttgattctgtgggtagagctttgcctactcctcttgaagctggcccatataggtaatggccatgtcagttgtctcatgtccttgacaggctatgcccatgtcaaaatatacattcagtcaggacttcacttcctcaaagattcttcccatctcaaaataaaggatatgaaaaccaatgagaaatggtataattgtattatgggaggtagagtgcccagaatgtggtgttaagactacattgagcatgggacaaagtacacagccaaagaaagaaaataaaaataaataagagaagaaggagactagcagagaaaaatgtaattaagagaaaatggagtagccattaactgagctaatgacactgaagatatcacagttttggcaaggactaagaattaagcatagcattttgttatatgggagccactgttaaacttgttctgagtagtgattacagggcattcaagcgataaaggaaagaaataatttggagacaatggaacaaagtaaactttttcttggtaacatttctgtaatcaaatacctgtaaagaaacaatttaaaggaagaatggtttatttttgcttacaatttgagggtatgctatagttcatcatggtgatgaaggagacagagacagctggtgacattgcatctgaaacaaagaagagaatacttaggaagttgggccagtctacaaaacttctagatttttctcccaacaaggctccatcccctagagattctgcaaccttatataacagtgttaccagctgggcccaagtattcatacacatgagcctggggatgacatttcttgttcaaacaacagtatctacccctggaccccataagcttaagtgtcatatcataaaaaaatactaattctaagtttaaaatttcccagttttgttatcaagcccagcattgtattgtctgaaagtcaaggtagtctcttacctgtgagccccaataacaccaaaaaacaaattacacatttccaatatacaatattacatagttaacatttccattccaaagctagagacaatatgtacagaactcattgaacatggagaagtctagctgattcatttactgttgatgactactgttcatgatactgggaactactctacatactaccaaagtagaaagctaaacattaaccctatgttctgcaatggtgaccttcttataagacatgcaggtggaatagtgccacaaaaattgtggtaggaactcaccattagctgattgaaattaaggcacattccatgtgatgggacccatccccaatactgcctgggtggtcaagaacctgaaactgaatagtctgtggtcttagggaaaacaagagactactgttctcctaagagaacacagcaataaattgactcctaatgacattctgcaaaactcatagaatggtatatttctcagccattatcagagaagctgcctccagtagtaaatgggaagaagtacagagacacatctggaaaatgtgcagagaatgaatgaccttggaatactccatcctaaaggggatgtctccaccaaatatctcagggctctgcaaattctgtagaagaggtggcaaaaaagaatttaagagccagctgagatgaaaaacaccaagggaataagtactaatcacagaaggactgatgatctcacagaaactgtggcagcatgcacagtgcctgcacaggtctaagctagatagggttccatacttagaagggaaatagacacaatcccccatttgtgacccagaagctgtctccaatgggtaactactcacaaaggaaaaattagttttctacaatgtagtttcactatctatgcgaaccacacttaagggcagtcttcatgattggcaatagatggccaacacacacacacacacacacacacacacacacacacacacacacacaaacctaagggcatcttttttctttttttcttacaatgtattttcttggctatatttttccttacagatccttttcttatatattgtacctttttattttgtttttatggttttcctgtatatacaaacatgtgtgtctcagtgtcagcatgtgtttcttgtgccttttctttggctcgtttttttctgtttgtttgcttgtttcttctgtcctattgtggtttgtttgtttttattttaccttattattatttttagagacttgtttatattctaaggagaaagagagagagagaaaaagaaaggttgttgttttgctgggtgggtaatggggaaaacctgggaggagatgggggcaggtaaactataattagtatatattttgtaaaacaaaattatgttctattttaaataaaaaggagaaatgaggacgtaacaaggaaagattaaccaaaagcaagactgaagcccaacagcataaacacagaattcaacagacccatgccttgcctatggggctcatgaaggactcatcttgcttccaaaggtcttaagtagccccacccttctacatctatttcctgtagcatacagtctttatcttggactggcttcactacatgcatgtagctttctttgacagatgtccccaagttctcataaccaatgattggagcctgtcttacaacttagacttcattttgaaaactcaaggtaagggcctggagagatagctcagcaattaatagcagttgttgctcttctagaggactgattctatttctagcaccaacatagtggttcacaactatctataattctagttcctgggaatctaatgccctcttgacttcttcaggcaccaagcttgcatgtggtacacataaatacatgcaggaaaaatacacgtgaaataaaatgaataagactaattttttttaaaaaaatgttttgtgcaatggcctatcagagatccattgaaaggtttccaattccttggccacatattagctgaccaagctctctggaacttttgaacaagacttcataactcaaccaatcttgcatttctatgtctgaaaaattagtaacatgtggatgatgctgtcaagttctgttgccagactggaatacagtttggtacccttgaaccacagctatatatagcaatctctgtatgccttgatggctgaatctgcaaaatcactttcttacgccgttgtttttggacacacaaaaaaaatcttctgtcacttctcagttgaggcagtcttcttttacaaattagagataagatgcttcggttcttgcccttagagcatctttcctattgtgccggtacagaatatgagatttctctttaatggtaggcactagcatttttaactattacaatcttttacttggccataagctttcttctgttctttttcttgccaaaatgtttattgctttgaatctgtctactccatttgctattctcctttactgtataataaacctcctgcagcctgaatgctatcctaacttgaaataatcttccacaaaggacaccattttgtcatgatattaagctcattattttaaaattcattgtcagccaggttttgtaagacaagggccaaatgaaaccaggttgtttgccagaatataatatgaatctcagttttcaaaacctcatgtaccatgtttctactgtcttcatttctttgtcctttcagagtactactaaaacagtccactaatttatagcactctaggacatttctagtccagtgtttcttcaaactcttgttcattcatcctacagacaagtttcaccagtctatgaactaactacttggtcagttttgtcacagtaaaggctctattttccagtactagttttctgtattacttgcttttctctttgctttgacaaaatatctgacaagaatcaacttaagaaagaaaaggtttatttttggcccatagatcaggggaactacagttcatcatggttgagaaagatgtagtggaaaatgttcttagaagctggctgcattgcatctgaaatcaggaaactgaatcaacaggaaatgggatctggctaagaagcctcaaggcccacctatactgaacaacttcctctagtaaggatccacctcctaaaggctctgcaaccttcccaaatggtgccacaaacatacagtcctatgggggacatttcatagtcaatccgcaacaacatcacttagtgtagcaaaagaaaattggtggcagctctggggaggattttattaactatttttttatgggattaaataataatctattgagatccagcttcccatgtaagaatttaagcttgttaaagataggaacaaattatacacctcagataccttccatagcaccttaaagcacattaggcactcaatacattttttcacttatattccactaattgctccactcccagtcaccttctgctacatctttttcctcacccctccccttctcctttgagtgagtagggaccctccccccagtatctttccaccctgccacatcaagtctctacaaggctcatattctcccactgaggccatacaagccagttcagctagaagaacatatcccatggacaagcaacagcaaagaaagtgaataattaagggtgaagaaatgagttcatgagagcaggtggcaaaacctccagtaggaatatatgagactgaggagatggcttagtggtaaagagcactgggtgctcttctagaggtcctgagatcaatccccagcaaccacatggtggatcataaccatatatagtgtgatccaatggcctctcctggcatgtaggtatacatacagatagggcactcatacataataaaaaagaatactgtggcagatgagttgggtacatggtgcctttcatttccgtcattgttatattcttgatgtaccaaacttgttacagagcaatgtaacatgagagttgatgggcatgaaaatgatggcctctctttgtccaaaaggaatggtgtattcattgtatgtactcattcattcctagggtcagacaggctgttaaactttaagaactgggtgaggtcaggaatctgccaagcaagaaaactctttgtattagcacagtttgctgggttttgtctgtgtgtggtgcagggtatgggtgatttacatgccacattggcatcccagactgtccgtttgctggagtgtagttaataagtttatcacataactctgtccaaagagcagctacataaaagactacaaagggaaagccatggtcatgctgtcacctgatgccttggcacttgattcatcttagttgctgtgctgtacaatcttcaacagtgtaaggtgacaagttgacccaatgaggatgtcccatggtgcctatgactcagttatttctggaaatatggaatggctcagtgcccagctggcacagaggaaatgctcactaacattggaatgaatgggccccttgggatttttgtgacacatgcatacagaaagaaagcttcgtttctatgccttacccatcatctcattccatattcaaatgaatctctgtactagggcacagctagcaatatgataattccctgagcttaagagacaaaggaaatacagttatttagcagaaactgaagacacgcttctgtccactatcttcttttacaagtatcttgcattctcttagaaggtatttcaatcagcattaacttagtacctgatttggaccacatcctgtgtttttcctaatgctgcaactataatactaaaatactatccctattaataaagcaattctaataaaattgatattgacatgtattgagctcctactatgggctaatctctaagctaagagctttgcatgcattattatatttttctccatagggacaatcaaaacaaaactagatcctaaagaataaaacctacctgtttacttggtattgtaattgtcttcaatgaataagatcattcagtctacaaatggattgagttgagattcaagcccattttatctcactaaagaatcatagtttaacccatcccataaacaaccaccaaccccagacactattgcatttgccagcaagattttgctgacaggaccctgatatagctatctttagtgaggctatgccagtgcctggcaaaaacagaagtagatgctcacagtcatctattggatggaacacagggctcccaatgaaggagctagagaaaatatcaaaggagctaaagggatctgcaaccctataggaggaacaacaatatgaactaaccagttccccccagagctgtgtctctaggttcatatgtagcagaggatggcctagtcggacatcaatgggaggagaagaccttggtcctgcgaagatcatatgccgcagtacaggggaataccagggccaggaagcgggagtgggtgggttggggatcagggcagtggggaggatataggggacttttggagaggaaactagggaaaaagataacatttgaaatgtaaatgaagaaaatatctaataaaaatataaataaataaacaaggccaaaaacagaatcatagtttatatattttttaaataataacatcagtttctttgtaaactgcaaattggaaagtatttttctgcctagaaacttaataccacatttcaaataaaatccaacttactttttggactatcaatgccttgtacaatctactctttgccctactcttccagccttttctcattttttccctctttactctctgcggacttgattccatagcagctactatgtgctgctttaactgaaggtaataggctggcttggctacttaccacttctcttggaaaaaaaaactgtcccattctgaaacaattacccaatgctgtcatacttgcagaaggtaaggatgttctgtaattgtcagtaccagtgttccagggatgcttgatggtctagcttcacattctcctactctcgcttataatgtaagatccaaggaagtttactgcatcccagattctgtccagcaacaagagtcatataatgctcagaagtcagtatggacccccatcctcatttgtcaatgtgatggcagggatgggagcataatatgtctaagacagtagagaagcaatgaaccaatgatcaatatctcattctagttctcctcctctatagctggggaatattagacaaaattttcccctttccagtagcttcgatttccttatccgtcaacgagaacaattcccccttcctctaagaggttgctttgaatatacaaggaaacagaatgtaagtttgtaaatcacaaattcaggcaaaatagtaatgcttactgtgaccatttcaactactgccctaagctccttacaagtactattgccaccaatccttagaaaaacccagtggtaatagtatttccatttctacgaataggaaaaattagtcaacaagattattaattggtttcttcaccatttcccagctgggaacaatgtctgaataagatttaccatcccttcccccaaattcagtagatggagtatcacaatgaatgggagacaaatgcgaatgacaaaagggtgtggcacacttagcctgtatgagaaaccttgagagaacagggtcagtttgcctctttcttgttgtgaaggtaaactaaagcaaccagccacaggggaagtaagaaaggaaccgaaaatagaaagccccatgctgtcctctatttccagcagtcacaaatgacagaaatacgaaaggaaagaaagagcaggggagtgaaatggctgaagtgttgaatccctgtccaatttgtagtgagtaaatagatcattattaagcaccatagcaaatgtctgaatctctggtgctttatttctctccaagcatggagctgtaattactgatgaatgtgccactggcacctcggcatgtgacatcatcttgattctgcagaatacaaaaatcatgaaaactgtaatcggcagataaagaattgagctgaattttcttggactaatagggtggattcataaaaaattcagaacatttttgtgtgtgcttggcttatatttattatcaaaattccttgagttattccgttagcatcactgaatgtctgggacctggcaatgcatgtactctacagtacgaacacaatgatattgcaaagaatgcagatgttccgcctaaagttaaacctgcaaaagttaaaccacatactactaatagagtttcctggagctttttttttctacttaccatgaagccagtccatagtattggagggttatagagagtgatggtgttttaggaactcatcatccagtctacatgagagagctcattttgtttttacagtttgcaaatactggataagaaggttcagtgagtagccttgtgagaagcatcactattgtcactatgtgctatctgggtatataagaaaatggattgatacacaaagttttctaattctgtactcatataatggtatagaggcatcccttattctatttttttgaaacaatagttactgttactgtttttgagtacttccttggtgctatacactttggaaaacaccttgtacatattatcttatggagtatacccaataacccatttaatagatattattttctctattaaaatgttgagtcaggctcaaagatgttaaagtaactcatcaggaaagtggctatgaaaattaggattatacaagagagatgggatcttgtattcgattttggttttgttttagtttaggaaggcaagctttcattgtgttgcacagataggatttaaggtctctcagtcttattttcatctttatagttctaggcttagagatatgtgtgacattgcttccagctagattctaggattcagtatctttatgtgtgctttggagtatattttaaacagggtagaaatacaaggcatatgtatcttggaaaggcagatttcatctcaaagagggatggtacaaatgattctctttggtctatatgcatagaagtggccatagagtgaaatacacaagctattgacacagatccagcttgaataatccttggtgagtgtaggttcttggactttattattattattattattattattattattattactattactattattattattattagattttttttcatttacatttcaaatgctatcctgaaagttccctatactgtccccccgccctgctccccatcccacccactccaacttcttggtcctggaattcccctgtactggggcatatgatcttcgcaggaccaagggcctctcctcccattgatggccaactaggccatcctctgctacatatgcaactagagacacagctctggggggtactgtttagttcacattgttaatcctcctatagggtcgcagacccctttagctccatgattactttctctagctccttcattaggggccctgtgttccatccaatagatgactgtgagcatccacttctgtatttgccaggcactggcatagcctctcaagagatagctatatcagggtccctgtcagcaaaatcttgctggcatatgcaatagtgtctgggtttggtggttgtatatgggatggatccctgggtggggcagtctctggatggtcctttcttctgtctcagctcctaattttagccaaaaactggaaagaactcagatgtccctcaacagaggaatggatatagaaaatgtggtacatttacacaatggagtactactcagctattaaaaacaatacatttatgaaattcttaggcaaatggatggaattggaggatatcatcctgagtgaggtaacccaatcacaaaaaaaaacccacacatgatatgcactcactgataagtggatattagcctagaaacttgaatatccaagatacaatttgcaaaacacatgaaactcaaaaagaaggaagaccaaagtgtggatacttcgttccttcttagaatggggaacaaaatacccatggagggagttacagagacaaggttcttggacttctaaggaagcactaaggggatatataattttccaatgtgaaaggctgtgccagggagagcaacggtcatttaatcctaacttgtatagctactcagattagcaatcatcagcttcacctcatctttttgccttggaggcaaatagagacttttccatgtcacccacttctctgggctcaacactttcacgaaactctgttctgcaaaccccaaatacaaagcttggcttcttcttctgtaccacctctagaggctctcccaattccatgagcaatagaaaggaaaaaataatagctctttgtgagtgaaggtgttgccaggaatagccattctgagtgtggcccagggacttgcagatcaaaatcaccctagactcactaccggaaccagtaatgtgtgccttgccacatcctctaggtgatcctgatgtagatttacatttggaaatcactgtctagactgacaagcagagctctgaatgctgcagacatcaatatgcacatggctcatcaactctcagccccagcacaaagcatagatcgtctcatagcgaaggagttggaaaaggactgcagccttgagctagtcctgcagagcaatgtcaccttcaaatacacatggcactgatggataagtatacagagatttggagctagggtgtcgtcagttcttgttaatctgtacctgcataaggaaatgttgctttgcaagctcagcagctgcccagaggcatgccagctactccatggaaggtgtagtccttgatggtaagggtactgcaccctggaactctgagttgtgaagagaattatagaaaagcgactccattgcctacctcatgcatggcactctcttggcgtcagcattacaaggctactgttgtggtatggtcaggtttcttttagaagagtagaagtggcaagtaacaagaggaaatgcatatagaagttgctatggtaatgcaaagctagcatacatatattatactggagtcaatgctaagaaaacgcaaagctgagagaaatgaggtttcactatgcgagatcaggaaagtgttcatggaggaggcaccagttgaaatagatgaagtttctggatgtggaatttgaaaaatagtaaatagtgttgcttctgatgaagagagtatcatgacccaaaaatatggaggcatgaaagtgcagggggaaacgctcataaagctattctggcaggtgaagtttgagggacacattctgagctttagatgctaccgccagacttttcttgggaaactggctttaagtatgttatttaacattgattggtctctgtcttgctacattgaaattaggcgctacacagaatattttacttggtagtaagaccgagtaaaggagctggtgacatgacctagcttctgcaggtctggcacacagcacactctggcacatgtagagccagattttatatgctagcaagtgtggtgctttgcttgaaatagtgggagtgggacctgaagtgggagagccaatccttgacactagattgtggagtgggccttaagtgctaaagtaaacatttggggcttttattctgaaggcatagactatgtgtggttaaagaatggatcggagccaagtcagagcagagagaacaagcttaggagctactacattttagctatgtcagtggcagaaaggtgatattagagagaaagagacaggggagagagagatggaggacagagggaaagagggaaagagggagaggaagaatactccgtgtaatgctgattttacgttttctgaccctcaatgaatgcataaaaacaatccagtaagagaacagtgaaaaataaaaattggaggaaaaaaattaacaaatatgataggtctaatgaaagacaacccctaagttagtctaagttaaactctgagggaaaaagaaaaccaacagatcctctgaaaatatttcctgaggctggcctttttgtaagacaatttggggcatgagcaattcacacatacacacacacacacacttgataaactgaagcacattctgtcttgctggcagccactaaatctgtaataacacaaggagtcctccaatgaaagagatgattagagattctaatagcaatgcacactgggtcctaattaaggtattttctaatgcctgcctaggaatataagtgccctccatttggactttgatgataactagaggattctttagttcctaatcagggtatacaaaattcaaaacgttctcaagtcttgggccagagggaatgatctcatttggcacattattgagtttctgggaggaggaaagacatgaactgctcacaaatattttgtcattggctaactgcgaaactgcatttgttgaagcaatccaatgtaggaagctggttccctggaatagtaaagattatcaatacctactcaaagtaacccaacgtgtccaacattgactaagcaaatttgaagcaaagcgatctcctttctgttttcccccttgcttccagaggatataaacacacacatgaccgaatgtgtaccctgatgacagagccttttcaaagaaagcatgttttctttggctgccatgaaacatatgtttgggtgggagatagtgcacaaggcaaaagctgtaatgctggtatgatgcctgagaaacggtttcatgtttaccagaataaatattctaagttctgtgccagtcccctctaagatctatcaggcttccctttatccacttagggctgagaacagaatacatagctggctgtagttagactaaccagttagattgaccccaattctttccagaaattcaaaaagcctgctggctcttgggattagctgactggtattttaatcgatccccatctgtatataacctccgtgtccagtacagcctgagtctgctacatctgctcacctcagcagcttgtttttcaagccaaggtcatttgggaacggtctggttatgagaacagacttgtccaatgctagagaaactttgcagaaagcctgaggagaaatttgccattcacggtatttgatttgctagattcctcatgttctttcctgaacatttgatctgatctttggcaagggtatgtgatgcagccaagtggttagggtcagctttgtggataactcaacatagactacacatcacatttatttttcataagaagaatgtgttaagtagctgtgaggaaaatattgggttggaaaaaaaaagaagaagtttttgttttcagagacaggtggaatctgagggcagtcagggaaggcccagataacttcagaggcagttagtgatgttagaactcagcctaaggggaacatggaggtctaggcaaattattcttgggacttaccctgcttatagaatttcctgcctgtgtgatgcatagagttcacagaaaaacattctacagtacagaattcagttcttttttaaaaatatttttattaggtattttcctcatttacatttccaatgctatcccaaaagtcccccataccctcccccaccccccacagaattcagttcttatcctcagctgtgcatcatagcctactggagagatttagaatatgtgcacactccctcccctcagacattttgtccttcctttaaaggtatataaaattacaaatgctggtgaggatacagagaaagggaaactcttatacactgttggtgggaatgtaaattagcatagccattacagaaaacattgtgggggttccttaaaagaaacctgaaaatagaactgccatatggtccagctataccaccactgaacatatatcccaagacaaagacatctgcacgcccatgtttattgcagcactatttataataaccatgatatagaattggccaaggtgtgcttcattggataaatggaaacaatgtagtacacacacacacacacacacacacacacacacacacacacacacagcactcagagagagagagagaaaaaaagagagggaggagagggagagacagagacagagacagagagacagagagagggagggaggctatgtgttgatatgaaagagatgttcctaataatctcaggtatttgaatacttgttccttagttcgtggcaccacttggagaggcctaaatgtgtggtcctattggaggagatagtacactggaggtgggttctgagggtttaaagaccagcaccgtttctagttactgcctctgttttgtgcttgaggttcaaaatgtgaacccacagcttctattcctgcaggcaggtctactacttgctgccatccttccttgatgtaacagaatcatattcctctacaaccataaacaaaataagccttttcttctataaatggttatggttattgtattttatcacatcaatagagaagtgactagtgttccctattatctctaagcatatagatgggactagatgacacaccatttaaccgaatgagagtttatgtcttaattggcatgggcttgagctacattagttcctgcaagctcctttggttgaaaacaaaatccccagaagtgacattagcaaaccagctaaaatttgacaacttaatgaggactatatattagcaaatattattgtgaccaatttaaaaaaaatcctgaacgtgctaacctgtgatgtagttatataagatgtgctttgtaaacacttgggtgcaaggcttgatgtctgcaaccaactcaactggattaggaagggaaaatacagagaaatgtagagagggtagaatccagcaaatacagcaaatgctaacagctagggaagctgtgtgagaggcaaacagagtttttgtactatttttaggattcttctgttagcttaatttttttccaaattaaaaaaatccttttaaaaagatatccagattcaatactgtgcaagcaaattcggaagccattaaaattgtctggggccctcagaaaagcagaaggaatagggagtgactggcaatgagaaaaagggaaagcctttctgggtcactgtcctatcccagtgccttctgccactgtaatgctcaaagcttcacagatactgttaacaacttacaaagcctaccgtgggggttgatattctgcatttctttttctttcttgtatcttttttattcccatactggatttctaatccagggctatgtttgtgctaggcgaacacctttctgatgaactataatctcagcccaggttctgcttttgtagtggacttcctgagtaaagccagtatcactgatttacaggccacccttgaagtagcaaagctatgctactgagctaccttcctataaaacggtcagcacgttttgaagctgcccatacaaacatgagcattgtaagagacattgtctaagtgaaggaggatagccatgccagaaccacaatcttgaccagtttaccatgacaactctcgagagtcacttgatccactgagcagaacagagtacctaacacaacaagcttacagaaaatggaaaaatgctatgaatttttctcatccaaagaaggccgaggtcataagaaaacagtccttcctggctggtagcacttagaatccagctatcagttttacaggaagcagcatcattttaataaagtgtcagctgcttctcctaggtggggactcattagaaacagaattccaaagaagaagaatttcatttcatgctagctgtggcatgctttgcatttgttgctaggctccaagtggagccaaaatgcctttcccctaggaggagcatgaagaagcccttgcctccattagaatttcttagacttttttcttccccttctcctgtggtaccttctttcccttctgctgtatgctgtgtctatattttccattcgttgaatctgaggttagccagacttttgtgcccccattgtttacatctcaatcaatccaactaacatgaatgcataggaggcaactgagattttctgagcatccagagaaggtttctaggaggcaagcaagaaatgccattgagttgaccagtactgagtttgtaccttagctttaccttttagtagttttgttcatttgtacaggttcctttaacatcactgaactgtaggctctttctctacagaatggagattgtcatactaaattcacatggttgtattaaatgagagagagcctaatataaaatgcttacttagcaagtgaaagacaggtattcatttacggagttttttaaaatccatatatagactcaaaaatgcattatccagtctacctctacttcctaattatgcaaacatgaatgtgttgtgttgctttaactctctgagtcttgtaccaataatgtatagcttagaagatttctatgagcaataaatgaggtcagacaagtgttaaactcatgccaaacacatagaaatagcctcagccaacatgaattaacctaatttccctgttattattattagcaattttcctctgggttccttttttataagcctagcccttttttaaatgatcctttgcagcttcctccagcagaccttcccaaatttgtattgtcatttccctaagggcagaaggtcacatactttgtattaattcagggatcttcatgggatctggtagaggcaagcattcagtccatgacagcagagagagcatactaggtttgctgctagtacagccataaatggcctcgctgtctgggttctggttttagctttgtctcctttgcttgaagttaatagcaactcaacttctctggatttctcttccctcatctgagagtgataataattcctactctggggaatttgctgtgaggattagactttaacactaagtagaagtttcataaggactgagtatttttattcaatgaaagtcctacagtcaagcatcatgggacctaccctgtgaacttgcatgaaactgtatgtgcatgcacttgcacatccctccactcccactcctaattggaagcatgaatgaaaaggacatattatagaatgaacaaaaacacatattcattgtccacgaaggctctttacactcccaatcagaactagcattctgtctgaaattttccacaggactgtgagcccttgaggtttgtgtttgtgtgtctgtgaagtaagattcttacaactgaaaataaaccaccttaaaatgaatgattatgtggcatttagtatattttcagttctgtataatcataaccttttagttagggtttctattgctgtgttaattcaccacgatcataaacaacctaaggagaaaagggtttatgttagcttacagctctcatgtcagactccattactaagaaaagttagagcaggaactcaaataggatagaaatctggaggcaggaactgatgcagaggccatggaaggttgctgcttactgacttgctcctcatggcttgctcagccttctttcttatagcacctagaaccaccagcttagaggaagcatgctgcatagtagagtgcctttctatatccattatcaatcaagacagtgcaccacaggcctgcctatacaccaaattgcccatagacctctaccaaaatgactctagtatgtgtacggttgacataagagttatctaacacagcctctgaatacttctgaattgattactcctgcagtctggctatgtccggagcaaagtggtacctcattttcttctccatcattcctctcattgttccagatttcttcccattcaaaccttcttcattcagactctcatagtttctttccccctctttggggtccagtaataacacccacacagaggcacacagagacacacagaaacacacacacacacacacacacagacacacacacacacacacagacacacacacacaaacacacacacacacacacacacacacacacacacaagcacatgtatcacagacctgttgagagagtcaggtgttaaaactatggaaagctgccagcttccagtgattgcactgccagaatacaggttgggattggttgagattctttttgctctgatagtctcagcaaacatacaaaggcactacagagtggaacttgtttcttgtggacatagaggccacagacaacctcaaagatgtagttatttattatagcacaaaagaatcatagtgctttgcattatgtcttccatctatagctcatagtggtttcttagaatatagttccatattaaaacatctacaggattgcaaaataaccttggtaaacctgtgaccccatagagatctactgaatttttgtgtctgtaagcaagagttactattaagaagtttaataaaaatagcataaatgtactggacattttctgtgtgtcaagtactatgcaaaatatatatgagttttcatagcatcattgcagtggctgcagaggttggtattgttaataaatactttttatagaggaaaaactacatcacagagcagataactgacctgttcaaggctacatagtgagcacatgcataaaccattagattttggtgttgttttgataataccgtagttgtctaactatgttgctccagctggcctagaactctctatctagaccaggatagccttgaacttacagatatttgtctgcctctgcctcccatgtgctagaaattcactggtttttacacgattaatagtaatactttgtactcatacttccactggagataagagaacagggtaatatacatagaccataattcatacaactcatcacctagcctttagctcgagttcataagctctgtgactttgggaagaattccttatctttcagaaacagtttcttcatatgaataattgaggaaaatttcctgatgcatctccctctgatttgtaagcagcagatatgaaaagatgcagagaaatattttgcagaaatgtaaggtgctgtagcaaagtatgatatgaataatggtctgcttggattgtgcaggccaaccaactgaatgttgaagaacgataactaagtctacttatatacagacttggaaaactacactctgctgcctaaatcaaacactaggcaagtcattgccatttttcttctccatggttgtactaacctttatgtacctgcttctctgaagtccatacctgcattgttaagctacagttagaatagctgtaggaaaacttgcagcctttggggtaccagggagccaaggaaacccagggtgcaccttaaaagatgactttagctggttccattttttaaggggaaaaatgacatcctacctatttcagaggttccagtgaagattaagtcaagttgatatatctgaaaacactttgcacagtgtcgtcctcgtaagtgatgggggttctttggtgagttagcttgttattcttaaagggtggactaaaagcagcagggcaaaagatgcagtagggaagtacagatattttgggcttagaatttattgattccttgaaatataggcaagattttgaaacacagctgcctctatttgtacagaaaagatttatgcttgagtcattgcctgacttcctatgcaggctatttctgtttcccagaaatgttgggaaggggtgggcctgaagctcagctaaaggcctttctgttcttacaacattcacctacttggcttgtgaatgacttagcagccaagtacaatggagtctctaagtaagggataacttgtagtatctttagcttatacataagcaacaggggagcataaaagaccagggaacagtagagaggaacagggctcttagtccaggtaaaattcttttagaaaatgaattattttcagaaattatatgctttctatgtgttcacagccactagtataataatgcataaacactaaaagcaaaaaaggttcacctccagtctttctccattgcagagtaaactatattaaccgtttaggtttgaatcttctcatgaccttctctatgtacacacaaataatattaggcatgtatcagatccacacaggatgctgctacttgttctaggatgggattgtggcatgtatgcttctgatgttaaacagtgaatcactcacttaccagcacacacatagatgcagatctggttttttttcttttaagcagatatatgttagttcatactatatatataatttatttaactattcatcaattagtaaataatgcaataggaagtaggaaggtaaagggtcaatttaacaaaataatcaaggagcaataatgttctttacgaaaggaatttattttgcaaaattcttgctgattagtatggttaaatatcaagggcacagtggagatatgagtatcttattataaagtttcttccaggggcctggggagatgagttagttgctaatgtgtttggcacacaatatggagacctaagtttggatccatagcacccatgtgcaagatggattaaaggcattaaaggttgcattcccagcactgggatctgaaggggggtgggtggtggtagtgggtggagacaggatttgctgtctagacagtattgccaaatctgtgaaccaatgtattgaaagaccttgcctcaaaagatagagtggagggctcctgagatggctcagcaggtaaaggtaatgcctctgacacatgtgtgccatgatacatgtactcatcacccacaataatgattatgatggtgataaatattgttcctattactccttctcctcctactgataatagtaataataacttttaaactaaagtacagtgattgagatatatacctgatataaaattttggcctccatgcatgtatgcacatatacatcaacatatgaacacatatatacacatatactatataccataattttaatgcttgcctaaaattaataaaatgttaattttatagttttacttatgaaagcctttatcacataccacttcctgtatatgtaaaagctgagtcaagatactttgtcatgtatgtgatatgttaaggcttttgttttcttgcagtactaggaatcaaacccatggcctttcacttgctcgccaagtgttcccccagagaacaaaatcccttatgccttttaaagcacttttacaatcctattctactctaatagcagccttgctcaatctgaagttttcctattatttgtcaacaagaattaggcaaagagtgataaaatcacatctctaattaggaacagaatttgtgttaagtttggaattcattatccagtgttccgtgttccctgaaccagtgaagagagtatgatatgagataccaaccagttccatttctcattaggcatttggttgcatatcacttggcctaatttcccttttactctaggcttctggatccatgcatttctccagggctgatttagtactagctgagcaccaataatgtgctagacactctagatatctaaatctattggcttgtcatctaaaacagctgttgctgctcataggtagaaaagcctacaagatctctcaaagattgtttttcctctatgttctcttaagatgcctccaggggaatttcttgctgtcagacaggaatatgtagtaactggcttctaagtatgaaaatatggacgcttagtatgtttgctacactctcaaagatgagtgtagccatttgtctttcttttctagaagagcaaacacaaatcagttttctcttctgatgagtcaaaactgcaactcacttaactgaaaatgagtcaaaccattttataatggtctgtgtgaccctaagcattttctctagaagttgaaatgtcctctttagaggagtaatgacttacttcctttctgccaggaacatctagttagtcacctgccctattggcagtgatatatatatatatgttgaaatgttttgaaaatctgccttttctgagtcattcttcctccataggtcatacccacttcaaacatccacacaagtcccctgaagatctctctgctttacttcctgtgttctattccaccttatccatcttctaagacatatttttaagaggacattctagctttgtcatgtccctagtgaaaattacaggttttcagattccctttgctgaactgttgtttaccatttgacttccaaccggcagggaagtctttattcaaggaaaataaaaggtgcttaagaatcttaaatgtattttctctctggtgactaactgaggcaggtccacttaggagagcacaggcctcaaaagtggcagagcttctggaatagggtcctatgggcctgcatctgcacccaggtggtgaggctgatcctcagccctctgtgcaccatctctgccagaggagagcttgcctccaggaaatgtctgaccctggaactcaggtgagatcacaattttctctctggtgactttctaaggtaggtccactcaggaatacacaggctgcagaagtgacagagcagctaagacaggatcctacagacctacatctgcatccaggaggtggggctgttccacagccctctgtgcactggtctctcaggagtgttgacataggcctacaaactcacaggaggaacgagctccagtcagagacagcaagaacatctaacaccagagattaccagatggtgaaaggcaaatgcaagactcttactagcagaaaccaagactacttggaatcatcagaacccagtactcccaccacagtgagtcctagatacccaaacatacccgaaaagcaagattcagattagaatcatatctcatgatgcttatagaggatcttaagaaggacattaataactcccttaaagaaatacaggagaacagatagaagaccttaaagaggaaacacaaaaatcccttaaacaattgcagaagaacacaggtaaacaggtagaagcccttaaagaagaaacacaaaaaaatcccttaaagaattacataaaaacacaaccaaacagatgaaggaattgaacaaaagcatccaagatctaaaaatggaagaggaaaataaaataaagaaatcacaaagggagacaactctggagatagaaatcctaggaaagaaatcagaagccataaatacaagcattatcaacagaatacaagagatgaaagagagaatctcaggtgcagaaaattccatagtaaacattgacataacaatcaatgaaaatgcaaaatgcaaaaagattctaactcaaaacatccaggaaatccaggacacaatgagaagaccaaacctaaatgtaataggtatagttgagaatgaaaattttcaacttaaagggccagtaaatatcttcaaaattatagaagaaaacttccctaacctaaagaaaaagatgcccatggacatacaagaagcctatagaactccaaatagactggaccagaaaagaaattcctctcaacacataataatcaaaacaccaaatgcactaaacaaagatagaatattaaaagcagtaagggaataaggtcaagtaacatataaaggcagacctattagaacttctccagacttctcaacagagactataaaagccagaagatcctagacaaatgtcataaagaccctaagagaacacaaatgccagcccagacaactatatccagcaaaactcccaattaccatatatggagaaagcaaagtattccatgacaaaaccaaattcacacaataactttccacaaatccattccttcaaaggaaaataaaagaaaaactccaatacaaggagggaaactatgcccaagaaaaaggaagaaagtaatctttcaacaaacttaaaataaaatagctacttgaacagaatcccagctctaacaacaaaaataacaggaagcaacaattacttttccttaatatcgcttaatatcaatggactcaactcctcaataaaaagacatagactatgtaaacaggacccaacattttgttgcatgcaggaaacccacctcagggacaaagacagataccacctcagagtaaaaggctggaaaacagatttccaaacaaatggtctgaagaaacaagctgtagtagccatcctatcaaataaaatcgactttcaacctaaagttatcaaaaaaaaaaaaaaaaagacaaggaaggacacttcatacacatcaaaggtaaaatctaccaagaaaactctcaattctgcacatcaatgctccaaatgcaagggcatctacattcataaaatcaactttagtaaagttaaaagcacacattgcacctaacacaataatagtgggagacttcaacaccctactctcatcaatggacagttcatggaaacagaaacaaaacagaggcacattgaaactaacagaagttatgaaagaaatggattaacagatatctatagaacattttatcctaaaacaaaaggatatgccttcttctcagcacctcatggtaccttcttcaaaattgaacatataattggtcacaaaacaagcctcaaccaacacagaaatattgaaatattcccaaacattctatcaggtcaccacggactaaggctgatcatcaaaaacaatataaataatagaaagcccacttacacatggaagctgaacaacactctactcatgataccttggtcaaggaagaaataaagaaagaaattaaagactttttagagtttaatgaaaatgaagccacaacatactcaaatttatgggacacaatgagagcagtcctaagagaaaaaactcaccctgagtgcctccaaaaagaaactggggagagcatacactagcagcctgacagaacatctaaaagctctagaacaaaaggaagcaagaggaatagatggcaggaaataatcaaactcagggctgaaatcaaccaagtggaaacaaaaagagctattcaaagaatcaaccaaatcaggagctggttctttgagaatgtcaacaaaataaataaacccttagccagacttactagagggcacagggatagtatcctaattaacaaaatcagaaacgataagggagatataacaacagaatctgaggaaatccaaaaaaatcatcagatcctactacaaaagcctatactcaaaactggaacacctggatgaaatggacaaatttctagacagataacaggtaccaaagttaaatcaggacgagattaacgatctaaacagtcccatatctcctaaagttatagaaacagtcaccactagtctcccaaccaataaaagctcagaaccagatgggtttagtgcagagttctatcagcccttcaaagaagacctaattccaatactcttcaaactatttcacaaaatagagacagaatttaccaaattcctactatgaagctacaaaaactgcatggtactggtacagcaacagacaggtagatcaatggaatagaattgaagacccagaaatgaacccacacgtctatggtcacttgatctttgacataggagctaaaaccacccagtggaaaaaagacaccatttcaacaaatgatgcttgcttaactggctattagcatgtagaagaatgcaaattgattcattcttatcttcttgtacaaagctcacatttaagtggatcaagggactccacataaaactagagacactgaaaattatagaggagaaagtggggaagaaccttgaacatatggacacagggggaaaattcttgaacagaatactaatggtttgtgctgtaagatcaagaattaacaaatgggacctcataaaatttcaaagcttctgtaaggcaaaagacactgtcaataagacaaaaaggcaaccaacagattgggaaaagatcttttccaattctaaatccaatagagggctaagatctaacatatgcaaagaactcaagaagttagactccagaaaaccaaataacaccattaaaaatggggctaaacaaagaattcttaactgaggaatactgaatggctgataagcacctaaaacatgttcaacatccttagtcaccagggatgtgcaaatcaaaacaactctgagattccacctcacaccagtcagaatggctaagatcaaaaactcaggtgacaccagatgctggcaaggatgtggaaaaagaggaacactcctccattgctggtgggactgcaagctggtacaaccactctgaaatcaatttggaggttcctcagaaagttggacttagttctaccagaagatccagaaataccactcctggacatatacccagaagatgctccaacatgtgatgaggacacatgctccactatgttcataacagccttatttataatagccagaagctggaaagaacccagatgtccctcaacagaggaatggatacagaaaatgtggtacacaatggagtgctactcagttattaaaaataatgactttatgaaattcttagacaaatggatggatctggaggatatcatcttgagtgaggtaacccaatcatagaagaacacacatgatatgcactcactgatgagtggatattattccagaagctcaaaattcttcttagaagggggaacaaaattgaaggagttacagagagaaagttccaagtagagactaaaagaatgaccatccagagactgccctccttgaggatccatcccataaaccaccaccaaacccagacactatggcagatgccaacaaaagcctgatgacaggagtcttatatagctgtctcctgagggcctttgtcagtgcctggcaaatacagaagtggatgcttacaattatccataggacagagcccaaggtctccaatgaaggatctagagaaagtacccaaagagctgaagggatctgaagccccataggaggaacatcaataggaactagtcagtacccccagagctccttggaactaaaccaccaatcaaagaaaatacatggtgggacatgtggctctagttgtatatgtagatgaggatggcctagttggtcatcaatgggaggagatgccctaggtcctgtgaaggttctcttccccaggggaatgccaggaatgggaatgggagttggtgggtttgggagcaggagcggagcggggataggtgattttaggaggggaaactaggataggggataacatttgaaatgtaaataaagaaaatatcttaaaatttttaacaattcattgtgttaataaaagtaacatgaaagatgtatttacaagggtattattgcatttggctctccttagtcccttatatttccatgtcatatcattttaattctattgaaaagacaaactttaacatttcttgtgcaagactgcttctagtatgttcctaaagcttatatatataagatattttctctgacattaaggacatttttaagtgttttctcccttccactgtttctgatgtgatgtctattgtccataatcaaaattttctgaaagtttttccttgatcactggtttcaatgaatttcttttttttaggatgtgttttggtattttcttgtgtttgcattttctaaggttctctaatttgtacatttataattttcatcagatttggaagtttcacgatagttaagtctccatctattttgtcctatatgtcctacttatcattttttattgtactttatgtatgtgactacactgtcttcacaagtactgaaagtgggcatcagattctattacagatggttttgagccaccatgtagttgccgggaattgaacttctggaaaagcatccagggctcttaaccactgagccaactctccagccccctacatgtcctttttttttaaggactccagttacgagtatttttctccatggtgttgtgtattagaacactaatgcacttttcactgtttactttttttccataagtcagaatatttgtttactttgatgttcttgagatgtagaagttatttgcatatcatagatagtaacttctttgcattcatatagttttcaaatattttctcttattctatgggctgccttttaggttttgatccttactacacatcaacaatgagttagtctcatttttttttttggttcttagcattgttttaatgtgttcttgtcctgtctttcaaatgagattcaaagtttttaagactagcgatagtctgtaatttctcttatgttttctgttgtgttatcatctcatctgccaggcacatcgtcagtgtgctgactaagcagatatatgctgaacaagccattaaattctgtaaacacattaccagccatgagctccttgcgaaatttttccattaactgggaacttaaagggtagttattcaaaagtggtaccaaaatacagaaatggattgtagggttaaaaacaaaacgtgagtctatcaggaagtagatattttgtgacttcaggtgagaaaattataacagagatggggtttgcttatactgccactagtgcattgtctgcctggatagggaaaactggtgctagactattggaatatggacatgaaaacccaaggggtaaactttgatagtttgcttactgataagtgtctctatttgtgtgcatatgcatgtgtagggatttctctctctctctttctctctctctctctctctctctctccctctccccccctctgtgtttgtgtgtgtgtgtgttgacacgtgtttcaatgcagagggagaggttgcaagatgtgaattcatttttttgaccaggaagatctttagatctctacattatttccaatggcaaccattatttcacatagagtgttgcatcacaaatgtgaccactatttgccaaactctttcattgtttctgttcattgcccagctcacttgtccatcatcagtacttaatccacaacaattctttaatatacacttttatgatgagagatgaaagggtgaaggaagcaggggatggaaggagagggggacagaaggaagtggtagtactcatgacatgatcaaatcatctgttctttgaaatgttagacataaatgatattttcaaacttgttactttattttaaattggtgttgctttggaggctcacagagataaatagtataaatccaacaaacatggtgttcctgtttttatctttaagaagttttaagggaaattggaaaatattttgacacaaatgtaaatatgatataagaaaacttgtggaatttaggaaaatcagtgctataagtattattagcaaagatgcatacattaaacaaaagggatgttgttaactcaaaacctaaatttctctcttttataattaaacaaaccagagaaaactagactcaaagctaacagaacaaaacccagaaagattaaaacagagataggatcaaaaataaaatgacagagaaaattaacaaaatcaagagttgaatctttgaaaactgtaacacatttgtttacctattagctatattgactaaaaataaatgatgtttcacaaagctaaaatcagaaatgaaaaggaatattactaaccatgttgcaaaaattaaaatgattgtgagagggtagaaaggaaagcttcatgacaagttagataacctatatgaaatgtaaatatatcctagaaatatataacctagcatattgagtcacgaagcattgaaaaatattcagagttgtaattatgaagagggatgcatagaggaatttcccttaattatctggttggctaataaagatgacaaatagccaattgctgggcgaaaatgaggaggcgggttttcctctcaagacaggaagaggaggggaggaggaagtgttgcaggagactgtggacagaggagaacagagggagagaagttggaaggaagaaagatggagcagaagcacatgactggagaaactgtaattagcagggatttcatagctggggaaaaaagaggtatagaggtatatctgcccaatatacgtgtgcagtttgtaaatttataactgagttgcgttttcattccatgggcttattggggttggaaatttactgcaacaaaatggcgaatacaccaagcaagaaaagtccaggacccagtgttttcaaaaatcactcttatttttactagaacacactaaatatacaaagtaattagtttcagtataacatttcatcatttatacctggcattatgatccttttcatttcccatcttgcttctcttattatccccttgcctgataccctttccattttctcatccacagtagcccccattttattttcatttaccataaaatccacatatgagagtaaacatataatatttgtatttgtgaatttgtgttattttatctccaatccatctacttttctatagtggataacatttcatttttcatatttctataaaacattccagaaaaattaaccacaatcttcaattgatttttaaaaattgtagaagagatttcttacttcattcagtgtgtgccctcatgtcaaacaaagacacagtgagagaactaaaaacaaatgtcccttatgaatattgatgcagctgttcgcaacagaatattagcaaacaaaatcaaatagtgtataaacagattatatgctatattcagaagggaattccttcttggaatgcaagggtagtttaacatagaaaatcaattaacatagaaaatcaattaacataatgtagctgactagttttaggtcaaattgacacaattgagaaaaatgcctcaataagtttgagctgcagtcaagcctgggctggtggtcctctgtccttctataagaaagcaagcttccacccttctggttggccccagcaccgggtcaccttgggtgctgagtctgtggacacccccaagatccccagagcactctccaagggatcttaggacttctggcgattggaacacaacttctgttccaatccaatcacgcgggacctgagatagcatgaattagggaagcagaaaaaacagactgaccagggtcacaagtcccttccggttggccccagcacggggtcttcttggcacggagttagcaaacacccccaaggtccccagagcacgctccacatgatcttaggatctctggtgagtggagcacaacttctgccaggaggcagatttgaaagccagatatctgggcacctcccctacaagaagggaacttgcctgcagagagtgctctgaccattgaaactcaggagagatctagtctgccaggtctgctgatagagatcaacagaatcacaagaggaacaagcgctaaccagagacaactataaccactgactccagagattaccagatggcgagaggcaaacataagaatcttactaacagaaaccaagaccactcactatcatcagaacccagcactcccacctcagccagtcctggatagcccaacacacccgaaaagctagacccagatttaaaagcatatctcatgatgatggtagaggacatcaagaaggactttaataactcacttaaagaaatacaggagaacactgctaaagagttacaagtccttaaagaaaaacgaaaaaacacaaccaaacaggtaggagtccttaaagaaaaacaggaaaacacatccaaacaggtgatggaaatgaacaaaagcatactagatctaaaaagtaaagtagacacaataaagaaaacccaaaatgaggcaactagagatagaaaccctaggaaagaaatctggaaccatagatgcgtgcatcagcaacagaatgcaagagatggaagagagaatctcaggtgcagaagattccatagagaacatcggcacaacaaccaaagaaaatgcaaaatgcaaaaagatcctgactcaaaacatccaggaaatccaggacacaatgagaagaccaaacctacgaataataggtgtagatgagaatgaagattttcaacttaaagggccagcaaatatcttcaacaaaattatataagaaaacttcccaaatctaaagaaagagatgcccatgaacatacaagaagcctacagaactccaaatagactggaccagaaatgaaattcctcccaacacataataatcagaacaacaaatgcactaaatgaagatagattattaaaagcagtaaggggaaaggtcaagtaacatataaaagcaggcctatcagagctataccagatttttcaccagcgactatgaaagccagaagatcctggacatgtgttatacagacactaagagaacacaaatgccatcccaggctactatacccagccaaactctcaattaccatagatggagaaaccaaagcattccacgacagaaccaaattcacacattatctttccacaaatccagcccttcaaagtataataacagaaaaaaatacaaggacagaaaccacgcccaagaaaaaaacaagagaataatccctcaataaaccaaaaagaagacagccacaagaacagaatgccaactctaacaaaaaaaataataggaagcaacaattactttaccttaatatctcttaatatcaatggactcaattccccaataaaaagacatagactaacagactggctacacaaaaaggacccaacattttactgcttacaggaaacccatctcagggaaaaagacagacactacctcagagtgaaaggctggaaaacaattttccaagcaaatggtctgaagaaaaaagctggagtagccattctaatatcagataaaatctacttccaacccaaagttatcaaaaaagacaaggaggaacacttcatactcatcaaaggtaaaatcctccaagaggaactctcaattctgaatatctatgctccaaatgcaagggcagccacattcattaaagaaattttagtaaagctcaaagcatacattgcacctcacacaataatagtgggagacttcgacacaccactttgatcaatggacagatcctggaaacagaaactaaacagggacacagtgaaactaacagaagttatgaaacaaatgaatttaacagatatctacagaacattttatcctaaaacaaaaggctataccttcttctcagcacctcacggtaccttctccaaaattgaccatataattggtcacaaaacaggcctcaacagatacaaaaatattgaaattgtcccatgcatcctataagatcaccatggactaaggcttatcttcaataacaacataaataatggaaagccaacattcacgaggaaactgaacaacactcttctcaatgataccttggccaaggaagtagtaaagaaagaaattaaagactttttagagtataatgaaaatgaagccacaacatacccaaacttatgggacacaatgaaagcatttctaagagggaaactcatagctctgagtgcctccaaaaagaaactagagagagcacacactagcagcttgacaacacacctaaaagctatagaacaaaaggaagcaaattcacccaagaggagtagacggcaggaaataatcaaagcaggtgcaaaatcaacctagtggaaacaagaactattcaaagaatcaaccaaacgaggagctggttctttgagaaaatcaacaagatagataaacccttagccagactcactatggggcacagggacagcatcctaattaacaaaatcagaaatgaaaaggaagacaacaacagatcctgaagaaatccaaaacaccatcagatccttctacaaaaggctatactcaacaaaactggaaaacctggatgaaatggataaatttctagacagataccaggtacctaagttaaatcaggatcaggttaatgatctaaacagtcctatatcccctaaagaaatagaagcagtcattaatagtctcccaaccaaaaaagcccaggaccagatgggtttagtgcagagttctatcagaccttcaaagaagatctaattccagttctgcacaaactattccacaaaatagaagcagaaagtacactacccaattcattctatgaagccacaattactctgatacctaaaacacagaaaaatccaacaaagatagagaacttcagaccaatttcccttatgaatattgaagcaaaaatactcaataaaattctcgttaacctaatccaagaacacattaaaacaatcatccaccctgaccaagtaggttttattccaaggatgcagggatggtttaatatatggaaatccatcaacgtaatccattatataaacaaactcaaagacaaaaaccacatgatcatctcattagacacagagaaagcatttgacaaaatccaacacccgttcatgataaaagtcttggaaagatcaggaattcaaggcccatacctaaacatgataaaagcaatctacagcaaaccagtagccaacatcaaagtaaatggtgagaagctggaagcaatcccactaaaattagggactagacaaggctgcccactttctccctacctcttcaacatagtacttgaagtcctagccagagcaattcgacaacaaaaggagatcaaggggatacaaattggaaaagatgaagtcaaaatatcactatttgcagatgatatgatagtatatataagtgaccctaaaaattccaccagagaactcctaaacctgataaacagcttcagtgaagtggctggatataaaattaactcaaacaagtcaatggcctttctctacacaaagaataaaaagtctgagaaagaaattagggatacaacacccttctcaatagtcacaaataatataagatagcttagcatgactcaactaaggaagtgaaagatctgtatgataagaacttcaagtctctcaagaaagaaattaaagaaaatctcagaagatggaaagatctcccatgctcatggattggcaggatcaatatagtaaaaatggctatcttgccaaaagcaatctatagattcaatgcaatccccatcaaaattccgactcaattcttcaacgaattagaaagagcaatttgcaaattcatctggaataacaaaaaacctaggatagcaaaaactcttctcaaggataaaagaacctctggtggaatcaccatgtgtgacctaaagctgtactacagaccaattgtgataaaaactgcatggtactggtatagtgacagacaagtagaccagtggaatagaattcaagacccagaaatgaatacacacccctatggtcacttgatctttgacaagggagctaaacccatccagtgaaaaaaagacagcattttcaacaaatggtgctggcacaactggcccttaacatgtagaagaactcgaattgatccattcctatctccttgtactaaggtcaaatctaagtttatcaaggaactccacataaaaccagagacagtgaaacttatagaggagaaagtggggaaaagcctggaagatatgagtacaggggaaaaattcctgaatagaacagcaatggcttgtgctgtaagattgagaattgacaaatgggacctcctaaaattgcaaagcttctgtaaggcaaaggacactgtcaataagacaaaaaggccaacaacagactaggaaaggatctttatttatcctaaatcagataggggactaatatctaatatatataaagaactgaataaggtggactccagaaaatcaaattagcccattaaaaaatggggctgagagctaaacaaagaattctcaactgaggaataccgaatggctgagaagcacctgaaaaaatgttcagcatccttaatcatcagggaaatgcaaatcaaaacagccctgagattctatctcacaatagtcagaatggctaagataaaaaattcaggtgacagcagatgctcgtgaggatgtggagaaagagggacactcctccattgatggtgggattgcaagcttgtacaaccactctggaaatcagtctggcggttcctcagaaaatttgacatagtactactggaggatcccgcaatatctctcctgggcatatatccagaagatgttccaactggtaagaaagacacatgctccactatgttcatagcagccttatttataataggcagaagctggaaagaacccagatgcccctcaacagaggaatggatacagaaaatgtggtacatttacacaatggagtactactcagctattaaaaagaatgactttatgaaattcctaggcaaatggatggaactatttcttaagtcattttgtgcacacctacacacttcactgtttctccatttgggcaattgataaatagtacactataggatccagctctcatccttattccaaggaaattgcagtgtgattgagtattgtgatcccagccagttatttgaaatgactccctagtgaaaaacaaaactaagcaaatatttcatttcctttcaaatacagaatatagatttttaaaatgaaacaagagcatgaaaatagaaagattggaaaagggaggcaaaccaatgggccagagaagtgggacaaggagaatgagcactattgaagtgcttgtttatgtgtatgcatgaaaacgtcatagtgaaacctatcattttgtataattagcatatgctaatcaaaatatttcactgggttgcctattctgagtcacttgtctgcattgttcatatgcagggggagctcccaatctagtgtgaaaagtacaggtctgtaaaacagggaaccagaatatggtgaaagctagactggaagtaggtagaaaccgtcagaggagtttagaacaaagtctgttgttctgtatgagaggatcataaaaggtttcttacgcaggcgagagctgctaggagtaccagcaatctaaatcaagaaaggtgggctttctctagcaaagagaattaatgaatagaaaacagaagaacagcaagttgtaagcatttctggttgatgcagaaccatcatactttgttattgtggtgactctatgggaaaggttaaattagttctgattttccaacaattggtgggtgcagattttcttttcatgtgttttgattggtttctttttgcctcccctacaagagatgtctttatctttactactctgactggacatatgagctgtggatagaatattctcttgtttaagggttacaacctcaatttaagctttggcgttctctctctctctctctctctctctctctctctctctctctctctctctctctctctctctctcatattactcatttaaagatatgtagattgtcaagcaaggtgcacataactgtgatccagtctcttgaaaggtagaggcaggagggttgtgagaaagacagatccacactgggactctgactcatgaacagcacaaaagggagacaacaacaaaatgttctggagtttgattccagccatctgtaatggatagagcaacaaacacaggtgtttatattagcctccaatcaaaacaactttttcttcagttgtgaatcaacaaattacagtgatattagtaattattttggctttatcattaatagaaatcatggctgtcttggattacaagtgtgtgtaattgctattccaaaattgtggcagttatgagacctgctactcttaattggttgctatgggaataaagcatatatattattataatcacaaacattttagtgagacatttcagtactgctgcttttctgttaatcctatatgtatcattttattccttaaaaaaaccacattgtttggagccctttaaggtggtttagcaggtgataatgcaaggtaggcaagcctagagatgacacttcaatctcccgaacccacaaaaatgtaggagagaactgactgcacaaagttgtcttctgacctttagatgtaagtcatgaccttctgccttaccctgctgccacatcacagatgtgcacgtgtatccacatacacatacaaacacacaaacacaggagcgaatggatggatgaaataattaattaattaattaattaatcaatcaaaacattgttttgagaggcatgtagaggcttcagtcgagttcactagggtccatataacatgaaagcagttaagaggacctaacctatattttgtgttcagataattgctcatcctagaaactaaggaaaacatttctgtttggccgctgcgttggcaactttctttcagaaacattcccaagcttgtaaacatttagagcagtgcttctcaagaccattaactctaagttgtatttgtgtaactacatgcacaaaagatagaacattatgtgaacaactctgctctttcagccaagtctggctttttagggcaccagacttctcagtttagtgtcttacttgtggatactgctcctgttatatgtggacatgatcagaaactgaggtttggatagctacagtattgcatttaaccattcttttttcccaggatgattctgtgaacaaagtgcttgtgtatgtcaaataaagaggatggaaaacaaagggaagactgccctgtgctgggcccagactcagcaggcacttagggacacttgttaggaaagaaagaggcatggtagccatgtaaatttcatctgacaggggcaatttcgctccatttcccttcctgctgattactgatgtggaagggaaaggggagaattggttcagttgtcaaggacgtgaagtaatttggttcagctccctagtaacccaggctctaatgaggtgggttcttaatgagccagatcttccttcttgtcttcttaaagggctcttcatgggctcattgtcactttgtcttctgtgctcctgctctcgtcctctttccctcattactaacctgcactaaaggacacttgtgtgagtgcacacgtcagcaaatgactcctactgaggacttgagacgtgctgtacatacacacaagtgccactgtgacgtgattttttatcaccaggtttcttgatatgctgatcttggagcatttcaattttatatagtgagagtgtggtagaacttaaaggctcacattctcagtatacacagagaccaaatacataccctcttcctgaccacagccttcatacagtggtgccacacagatctgtgataaggaaaaccttcacacctatcatctattgtaagggcatccttgaggggtgaggaaacatacacttatatttttcctaccctctaactgaaacaggggaggcgctactaggagaaatgaatgtgtctgtggaaaatatgcattcctaaatatgttttacctactcatttttccacattcctacaaaggctaaattcattcaagggttagcattgtagcccatgccttaaattccatcattcagaaggcagcagtggaaggtaaatctctgggaattcaaggccgttttggtccacatagtttctcccagcctaaccaggctgcatattgagaccttgtattacaaaaagaaaagaatagaaagaaaacctcaaaacaaatcaacccaacaaaaatagaacacctcgaacaggcaataacaaggagaaaaaagtcccaagggacctaaaaggcaagttcaaggggcccttgtttcacaagtgcagtgtatctgtactgagtgcactctcccagcagaggaggtaaacatttcacctgacttcattttggttttgtcgggatgaagggctcagtaaagaggacctctggtaaatccccttagtaagattttgctctgagtatgggaatgcgactccccttgtcttaactcttcggctagtaactgggagaagctggagtgtttgccacccacactccttaacgaagattccctgacaccaaattagccagttgaaaatcaagcataagtgattcctatttggctaattggtgttaaggagtctgtcaaaactcctcacttcctgcagcccacactcagtcagaagttccagaatagtacagtagttgggccggtcattagatacacttatgtggtggctggagccccatgagagttcctaaggaacatttggaggggtccccaagcagataacgatgagaaggtgacctgtggttgccagtttctttggatacaagctgagtcctgagaaatactggactcactatagcagatggcaggtaagaggtcacagaacctcttggggccaccttgcaccatagctgccagacctgcgggcaaagcaaaccctgaggcagagaaaatgtaattctcagatgcaccacttccctcagaatttttaaaattcacctcagtctaatcctttaagtcctcacaagaactttgcaatgtagtatatcagcaaacctgcaggcttgaatcatgatgtactccttttattttaaatgagatttatttatttgtgtgtgtgtgtgtgtgtgtgagtgtgtgtgtgtgagtgtgtgtgtgtgcttgcatatgctatggacagtgtagaaattaaaggacattaaccagaatggaatgggttccatccttccccagtgtgtgacccagggatgatgatgatgatgatgatgatgatgatgatgatgacgacgatgattttcaagctataaaggttggcagcaactgcctttactgtgcagccatctcagggaccctacattcctttctattggtatgtaattaatcatccccaacttagtggcttagtaggtcgcaggctttatctcacagtttctgagtcaagaatcctggctcagctcagcataatcttctgtcactgcagctctttcaaggtttccttccatccaggatgcaggggagtactcactccaagttgtactggggagaggtccacttattttttacaccttttgttgaagatcttttttttctggattgagccccttcctatatcttattagaaaaccaataggcttctaaaagggtagtaataaaataaaagaagatgaaacaaaatctaacacatcagaataggacaaaataaacaaaggaaaagagcccaagaaaaggccccaaaggcagatatacagaaacctactttttagcttaccaaggaattgtacaaaaacactaacttgaagctataatatatattcaaagaaaaaaaatatgtaaataaagaaaccaagatttttaaaaagccctgacatgacattatgagataaaaatccaccaaacagccacttgttgaccatttcctgctggacatgcagcctctccttaagaagagattgttgcccaagtgattatcagcttgagatagcttttgagttagggattgggacatgtgctcacttctttcagctttaggatcccatctggtacagacccatgcaggccctgtgcatgctgccacagtctctgtgagttcatatgagcttggctcagttgatttagagggatttgtcctccagcccctctggcttttatggtctttccacctccccttctgcaggttttcctgaaccctgatgggaggaatttgatggagacatcccatttagggttgagtgctctaaagtctaactctctgcataattcagagtcatgcatccctgaatttgttcccatctcttgcaggaggcaagttctctgatgatgagttctctgatctatgatatagcagaatttaggagtcattttatttttcgtacgctttaagtccatgggctatctagtctcaggttcttttgccgctcaagcagtgtcaggtatgggttctattttgtagaatggaccctaaatcaaatcagagattggttggttactcctacaaatgttgtaccatcagtgcactagcacatcttatatgcaagagaccactgtagattgcagtgtttgtagctgggttagtgtttacatttcttctttgacagagaacagaataccttcctgtattaaagacactagcacatataggagaaaactctatggcataattattaaaaatctggtgtacataggtgtgtgaatttatgtctgaatgttcaatttatttccactgaaatgatcttgtgctttttgtctttcagtttgtttccatggtagatcacatttattgatttatgtatgatggactatccctggatctctgggatgaagcttacatgattatggcggatgatctttttgatgtgttctttcattttattaagtatttttgcctctgtgatcatgagtgaaattggtctgtaattctctttgtttgttgggtctttatgtggtttggggagcaggataaatgtgacctcataaaatgagttcaaaaatacttctgtttttgtggtataatttgaggaatattgacatttactctccttttaaagtctggtagatttctgcactgaaaccatgagactctgggtttttattggttgggagacttttaatgactgcttctatttcactaggggggtataggtctattaaaaatattaatcttatctagatgtcactttggtaaatggcacctgtcaagaaaattattcatttcttttggatctttcaattttgtgtttacagattttttattgtatgttctatggttctgtggatttcctcagtatctgttgttatgccctccttttcctctccaattttgttaatgtgaattctctctacctctctgtctttgtctgtgtctgtctctatctttctctcactctttattggaggctcaattttccttactcctctggttgatgatttagttctcatacacagcattattattattattattattattattattattattattattattttgctggtcagtcagaggctattctcattcattgccgtgtggcttctctagtgtagtggtttacatcaaggtgttcaagctagagagatgatggggagggagtactaacaggatgcatctaagtcttttgctaattcaccaccaaagtgtcttcctacttcatttgctattatttagtccctggaagcaaaagcctagttccatctcaaaaaacataattgtgaaaatcagaggagggatccatagaaaccatgccagaggctgtcaatcttaagttaatgtcaaggaaagaaggtcttcctgaggatcagaaatttagtggtggaagcttgagcaatttttttcactttctctttcttgattttactctagatgagtactagtgataactactataaacgatgaaccaagataaaaataaaagtatatgaaggcaatctgaagaacttctagtaagtctctcttttctccattccctgcatccattcggaatggaggctaatagctcagtctcaggatctggctccagatgcataggttcaggccgagttctgatactaatgacacaatcttagcacagttactagaccatgccaagcatccctgtggccaactgtacaatagaaatgacaatacatagttctcagagtaatgagaaataaataaaatactgctatcaaacatttagcagactggcacacaattatgtgttaattttgttactattttgtgattacatgaggggacattatctcatgcacattagaccactgctgtgttgttatggcatcagtgtgcttcccagcctcaatttcctagctttcttttttttttcctcccactaccacgctcataagcacacaagtatttgtacatgagtaaaatcgagttcccatttgatatttcatttatatttccattttattctccatgaggatggcatctagaaagtgaaattgatggggaacattttttgctcagagattagcatagtaatatgcttggtggggtaaattatgcccaaagagaaagaagacacacacacacacacacacagagagagagagagagagagagagagagagagagagagagagacagacagacagacagacagacagacagagagagaaactcgtatagaaagaaacaaactgaaaaggaataaagcccagaggagaattttgttaatgatccggagagaatacaggggtcatcttacataagcaggagactgcagccctgcagctgactgctcaatgggcacattggtatcatgtttccactgttccttctctggcaatgtataaaattgagcttttacataagcttcattggctgatctctttgaaacagttcaattattattgtcgttgctgttttcattccttgggtcaagcaaagacaagtaggctataatgggttcaaagtgaaagcttactgtcatgagtcatgtagtcttgtcccactggcaagttctttattctatctgagatgcttcatccacttgaaagtgatctttttttttattttctgagataaattttattaggtatttatatcatttacattttcaatgctatcccaaaagtcccccacccgctcccccacccactcccccatccacccactcccacttcttggccctggcgttaccctgtagtgaggcagatatagtttgcacaaccaatgggcctctctttccactgatgtccaactatgccatcttctgatacatctgcagctagagacacgagctctggggggggggggtactgggtagttcatattgttgttccacctatagggttgcagatccctttagctccttgggtactttctctagctcctccatttgggggccctgtgatccatccaatagctgactgtgagcatccacttctgtgtttgctaggccccggcatagtctcacaagagacatctatatctgggtcctttcagcaaaatcttgctagtgtatgcaatggtgtcagcgtttggaggctgattatgggatggatccccggatatggcagtctctagatggtccatcctttcttctcagctccaaactttgtctctgttactccttccataggtgttgtgttcccaattctaagaaggggcaaagtgtccacactttggtcttcattcttcgtgagtttcatgtgttaagcaaattgtatcttatatcttgggtattctaagtttctgggctaatatccacttatcagtgagtacatattgtgtgagttcttttgtgattgggttacctcactcaggatgatgccctccaggtccatgaaacctgcatgatagtggaatgaactcttgactaataaaaagacatagatcctaagctcttctcttctgctaactataggattttcggcacatcttcctactctaagcttcctatccttattaggtttctagtgatatgataaaaaccataaccagaagcgacttggggagaaaatggtttctttggcttacatattctaagcactgaagaaagttaaggcacgagcctagtgcagggacctggaatcaagaactggagaagaagccatggtggaaagttgtttatttggcttgctttcctatttggcttgctctccctagattacccagcctacttttgttatatcatccaggatcacctgcctaagggtagtaccacctaaagtgacctaagtactcccacatcaatcattaattaaggcaataccgcacagacttccttatagaacagtcctatggaggcatttcctaaacttaatttccactttctagatacatctagatttgtgccaaattgactatacccaaccagcacagcctcactactttttcaatagaaatagaaatatctgcctcatcttgaccacatagcttttgaagaggctcatctgagttcagatcacatctggaaacctgtacagatgttgtgttaatgaaggtagttgtggtctatatggatcaaggattctgcctcttatttcagttgttatgctctacagggactcacccaatctctaagccttggttgattcaccacttaatagccactgtcatgcccacagggagttataagcagttggctgggtttttctgaaccacctgttgttctttactatgggtagctgacgccatgctggggactgaatgatgcctggcatgagagcagagtggaagtggtgtggtgtgccagcaggcagaggctgtggtcacggctatgagacattattatctgtgtgttttcaggctttcctagagagagaaaagggatagaaagaaagtgctttaaaaatagaatttaaaatgcggagaaagtacaaaggattatgtttttgtccctctcaattactcttccttgtctatgttagagaccatgttacatccttcccaggtagcatcacattccatctttgccttagcccttgagagaacagttaaatttgtgagaaaattaagattcgaagagaaagtttcaatagctttcccaagaccacactgtttgaatctgtcagagcctttaatccagttctaaaatcatgttgagacatgataacactggcccatgtttagaggtcaggaggatcaataatttctacaaagaaaaaaaaacccagtcattggagcccaggggacccagtgatctctaaggtgcagaccacagtgtttttatctcagtatgtgaccacactctatagttaatcattctctagacaatctcttcttgaacacatgcatagtaccacgggtttgctaacagagggaacattgaagacaaagccccatccacttgagacaccaagatatatgtgtggatgagttcaactgccccaaaccaagaagtacctgtctattaaatagttacttaggtcctataacctagtctgtaccttcctttttacatgaggtcgatcaaaagttacaaagcattgtatattaagtgctccagaagtgttataggccaattatgcttcctaccaaaattcttcatggagactttattaagtttatagtaaatgtacatgagactatccacttaaaaatgcttgaacacattgtgttttatgactttaaagaatacactggtttattggatgggcaaagtttgtatttaaccatttcatcagctttgcatgcatatttattagatgaaattgaatattttttcttttgtttttgttttttacaaatttattagccatatttagtttctcatttagaaattctttttatcttttgttcattgagtaagagaatgtttaaaaagtatcagacacagaacaaggaagcagtcagggaaagtagctataggtattattaagagtattaattgatgatgaaacaggaaggagacaaggcatgaaacaaggttgggggatcatctagaactaggtattaaaggcatcacatgtaagggtccaacacatagataccaattcagcttttatcaagtcactttgtaacttggaaagagttcttttctttctgtaggtctgaccatgatgagtgccatatcacctgttcaccttaggtgaagtactagcccatcaggattacagtagaaaggatcccagcctacaaagctgcttaaattaaacttggaaaagagctttctggcagaatgatgaattatatgaggaggaagaagggaactatttaaagtacagggaaaagcagtagaacagagaggtgaaggagaacaaaatataaaggtatgtatataaaggaccataataaaatctactactttgagttagtgaattccactgcccagtctagaacccacaaaaacatggatttggtagctcatgtacataatcccagaccttgatggcaaacaataagggactctcttttaaatacggtacaagtagaggaactcttggttgtactctgacctaggcacacatggtgtgtgctttcacagacatgaacactactcatacacaaacacatgcacacatgtcatatattcacaaatattttaaaagacaaacccattactgtatgtgctaactttataaatcagggaaagaataattcttactgagactaagtacaacatcaccgatgggacaccaggaaaaagaagaactaagatcagtaaggtggaagcttcaaggaaactgcccggtctcagctcaataaaacgcaccttttatactgcagtggttacatgcatagaggtagaatccacactgcccagaccagaatcctcccttggacatttactagctatacaatctaaggcaagtatttcagcttctctggcactcagcttcctcctctataacataaaggtaataatactggctatatcagagagtagctatgaagatgaaatagattgttatttactttaatgagtatctgacatatataaagcacaatataaggctactttataaaaaactgagcaggcaaaagtgagagctcattggaaacaactgaaagctgtgctttaaggaggtagtagtgagttccctttcattcatcggacattcacagaagtcagtggtattgaatatattcaagaatcaacaaaggagtagagaaggtagatgttgttattgcctcctggtcacaagtcagtgggagccatataatctttggggagaacctaggttaagtcggaactttgtggtgggagtgttgtgccaatctcattttcctgttgggatctttggtgagccttttacacccatccacaaaattcactggtgtaaaaaccaagcatcccctgctccaaaagcagctgttactttgaaatgcaggtttactcatcagatactggacacatatgattaacacatggcttttggtgacactttcattaatgtgttagaagtcacttcctgattcatactctccccatatgtgaggtttctgttgttattaaataaaaggaattatgccataaaacagatgctctcatttgtcaggcttatatctcacatagtctcacctgtgtctgccatttagcattagcctcttagtcagcaaacagcatccattcatccactctctaccacctgtcactctcgataaagacctggaaactctgcctccaggtgaggttgctcagcaatggtctataagagaaagtgctggagttagtttaagctcaatagaccagactgatgctttaagagaccatgaagacaaagggctaggagagaactagggcaaaaatgatttcttgcttggagaaccaggctagactactgtagttcatggagaagtagcttgttggatgattggagatggggtggcattattcctatccctaaaaagagctagaattcaagctagaaaaacaagtgtgagcatataggtgaatgaatatccccagaatagttaggtccgtgtgggctctctacagctcaggttgagtgctatgaacagcacgattcctaaggttttggtttaggtgtgcctgttgaccctgagtctccagagactgtccatatatatcagagaaggctcggacccttagttccctcaggggcatttagcgtccctaagaaaagtggatacagcaaagtactatcttcaatataccatccaagcagtggggtggtgctaaaggctttcacctctacaagacttgactagagataatgaggctaagcaatgagtatggcattggaattggagacttgagttcttgtctgtgcggtcatgtgctaatgggtaaattacttaaccttaccaaaccttaattttcattttatttaattggaaatgtaattaactgtccacagttctagagatgtttgtcgaaattatataaaatagaatgtaggaaacatacttaacactcttaggtgaaaactaagtgcttatcaaatattaacagtcttaatcatcattaccatcttcattagagattaattactaaaacaggtacatataaatatttaaaatttatacatatatttctgcacttttcaacacattatatttcataattacactattaataagggaaaaggggaaaagcaatatgacaaagttgttcagaacccatgacaaatcatggctcatgctcttccctattccctgggtttctgggtaacctgcctagcctcttatgactcaggaccaatcatgcaggagagtgcaagaactcagtgaggaaatccttgtaacatttctagaagagtgctttgcacagagtaaattacatgttattctaggcattatgcatgcttttctctatgcaactgggccctatggtgattctgctagagtttttccttctaacttggaccagagaagagttcacaatgacggtagtgatcccttgaattgtttttggaggtttggaggcttatgaaattaatactgtcaggctctaggtatctaacccagtggtactaagtgggagaaaggggccacactgttaaataaagtcactatggctttagaaagcaaaactggttcccactcatccccacagctgagtgggttcttcagcagctttgtgctgtggtgtatgtagcctctgtcttccagcccccacctaaccagccacttctccatgtatacttttttcaaatatttgctaaaagcttcccgaagcaggaagcctcagggctgcagagcactcggagagagatgaagcagtggtttccatggtaacatttttggcacttattagtgtttgcgtaggcactgaggcaggatctggggtccagacaggctcttgctgtgaaaggctgagaagaaaagaggactgaggaaacaagatcgctcccactttgcccttttggatattagccctaagaggctgtcttcagagacttacatttgatgttccttaaggagctcagagtcactcccttaacacaaggtccactgtcttgttaacctggttaagcttgctcaaatacccctgcatcacagaacatactcctttccccaaaacctttgctgcttttccctactaccaatatctaccttctgactttggaggccttccacattctcctttttcttaatgctctgatcactttccgcacacttcccctcccccagtatgtactggctacttcagtaaggcctttctgcttcatatctttacagctgtttctacttccataccaatcttccttgggctcctgcttcatgtacctacttttcttttaaaacccattccaagtgtcagtttcttcaagaaacattctttggccaccccaactcaatagaaacctcttccatgaactcaagttggaacattgctcagatcagccattttcagttgtgttactacttctttaatatacagttatacagctaggagagtagtcccatcaccccaaaaaagatggctttatttttcctactatacccaatacagacactgctcttaagtaattaaacaatatacaataacagaatacatgaaaaggtataataccctaatacctaatacctggtatataggagctagtagatagatagatgtatgatattattataatcatcctcatttacttcctgattcatgccctggtacatctgtcaccacttctattcatgagcctcatataacgtccctgatcttagacattctgactggtgtgaggtggaatctcagggttgttttgatttgcatttccctgatgattaaggatgttgaacattttttcaggtgcttctcataacgtccctgaatcttcatttattcctaagcttagaatcttcatgagccattagcttggcaaaactcagtgagtggtcattgaccttattttcacctcttgctgctgtctgattctccctccagctacagggctgcatcattctcttcactgaataacacaaagggaggattctcaaggtagtgagagcagagccttaatccaagcacagggtgtctgtgaatgtggaaccctggcccactacacaggtgttgcatagccagagaggcgattctcattcatttgtgctgtttctcaaccctggaacaagacagagagagcaagttcctgtgtgatgaacatacactaaatagtttagtagtagttttctaaaagggaagtcattggaaggtgaggtacaataacaatcaacctgccatcgctgttgtgggttcttgtccttgcccaagctctggtgaagcccccgaggactcctaagctggcactcgcagcctcttacttcccaggccttagcatattgtaccatggagaaaatatttcacttgttttatttcttttaattctttctttctttctttctttctttctttctttctttctttctttctgtctttctctctctttcttctttctttctttctttctttctttctttctttcttttttttttaaagtcaatcatgattacttttgaggctaatgtgggtagctattccaaccatctcacactccattcgcaatgaatcgggaataaagagcaaaatgttttggagaattagaatctattattatatatctcaacacaactggaaaggagaatttgaaacataaaaatatatgttgcccttgtttgataagtacacattttatacttgtatataatcatcacactgtacctccatactatgtagttattatatgacaataaaaaaaattaaaaacttatgacatagtttgaaaatccaactttaccctgctgatatataatatcagaccttagggtattctaactctactttctaaacatagcaagcataaatttataatctgtctttgatgtttctaacattggaagtttctatgggtctgcttctggttttttgggggggtagtagctggcaatatttcttcttacatctagatgtctttgtatttgaaaactacttgtagaagtaacttggattaaaccatagatccctttcttcagaaggaggggaggggaggcagaggagagggagaaacagagagagagagacagagagagagacagagacagagacagagagacagagagacagagacagagagacagagagagagagaaacagagaaatagaacaaacctgtttgctttggccactttgctgtggtattcctattacagaaccatcttacatgcttatgatgcattttcttaaactgtttaaactgtttaaataatacgaagttgatgtggggtttactcttatccttcaaatatagttagagaattagctccatgtgggggagtgttttctaccagacttctcacctttagttctttccagaccttcatttctgtaattttgacccataagaaccaattacttgaccatgaggattctaatgggctagcactggcaaacgttcctagtaaaaagcagctgtctctatactcactcggctctctatgtttctattgttatttcattcttggccttgaatgcttgttttatttcttgctctatattgattttaagttttgaatgtatatttttgtaattttaggtgatttcaactaataaactcaaagtatagcacatgcaattttgccattgtgcctgaaagtagtaagttggaacgagaagctaaaacctcttaattcaagccatacactgaattagtgtcagagcttgaaggaaatctcaggcttttacagtgtatcactatcatattaccaaacattagcaaacagcagtgcagtgtgatgatccactgtggtgggtgtatgtctgctgagggtagttcgtctttcaccttcttccaacattttaaaaaattctttcctcatatgtatgtggtgtgtgtgtttgtgtgtgtgtgtgtgtgtgtgtgttcccatgtgtgttcccatgtgcttgggtttatgcccatgaacatttgtgtgtgttcggggtatacgtgtgtgaggcttgtggatggagtcttcctggattgctgtacaccttatatactgaacaatgcatgtctcttgctgaacccagacctttccaacatggtgaggatatctagccagtttcctctggagatcccccgtgtctgctttgtgagcatagaaataatacatggactgccacacctgactatcactttgtggattcttggggtctaatctccagtcctcatgactgcatagcaggtactttaaagactaaactatctgcctgacctgcctatcaccgttctgtattctattctcccaaagagcaagacccagctttgtttatctttttcctaccatttatttcccaccatatattgtccaaagctgtgatgttaagttcacagcttttttctcctttcctttctgcccatgtattttggtcaatccttgcatgtagtcttggaaacacggatgccttttggctactgcagtggcctgactctcactgcctgtgagcaaagtctcctcagtttgtcaactcctgcctcccactctgtagtagctgtccttcaggtgcagaatttgagaaagaaagtaccagagtcctggagtgcttttccacatgagtgttaattttcccatctgtgctgtcatctgtgactaccagaagttgatcttcgaatgtggataagcaggttagtggaacaaaatttaaaaaaaaaaatcccactgttttgttgttacctatctaagctggatcaccgagattatgagtttcagacttttattgagggacttgtttaggagactcagaaagataagtaatggaatattcaggctatatcatatggcatgaaagtttccattggcatacagagccataggggaaatccagtgaactgggcagaaaacgtagccacagacagccccgggcttttctatttctccttccctacctgataaacatgtcttgtcttagcttagatgttcttagattcttaccaaggatccttaacagatgctacaggtataaccaggaacaggtgtttgtaaagaggccagcaacagtgttatagcagtaagcacggaagtagcttgacaccagtaaaagacagaaccatactaccgctttctgctatgttagtagccagtaattctaggtggctaggcctttgtaatatatatatatatatatatatatatatatatatatatatatatatatatatattattttcaaccgttccattttctcccattttgaggatagtggttctgtccatacttgagaggcattatttcccacccacttgagtgccctttcacttgtttttttttttaagacaatcactatgtttgctttcttcctatactcagatgattgtcctcactggctaaggtttgtatttccaagttgctgagagggaagctaatgggaaaatctagagagggagaaaattggagtgttggagtcctgaaagagatctagtctgttaagtaagagctgtatgttttgccagcagcccatgcatgcccccacactctgtcacacaggtactgagttttggtgagcaatacttgaccttctaggaacttctgcttttcagcaggttaggcaagcatggtcttggctgatatcattctaacccgactactgtacccatgggccagggctgggctagacagtaggcaactcccaattgcattggtattgttgccgtggagttttaatgggagtatgcttttcaacattagtcacctctaattgaccccatctcagagcttttgtctctgccactgtcatgctgctgtgtctgtacaacatagccttctcacttactgatctaaatttcaccctgtaacctcatctattattgttaaccagggccaccctagctgacctgctcaacttgggggacagagggaagtcttgatggatgggttgcagagagagctacataggagcagaggcaagggggggttgtctgctgagtgtctgctattggctggacactgctgggtacttttcatgcctgggttcatttgctgttagtcaaagaaaggtagtcagctttgaaaggtggggggtgatttgtttttccccctaataagtggaataagtcaaaaaaaggaagagattatttcatgagtaaggagtctgtggtcaaataagtatattactttaaacaagctaattttcttcagttttatcctctgtaaaatggccaggtagtctttgctaagttatcacatacaatagacattgcataaaattgaaattaatgtgcctaaaaaataaaatctcatacactctatgcaaagcaattagagtttaaaaaccaaattgcagatgagttgtaggggtcttaatgtcttagtttgaaaacttattgcttgtatatgaccttggaaaagtcatttgtcatatctgtgaagtgaggatattgaaagtcagggttcttggggttttctaaggaaagtttcgatcatatgtaggaatgttagaaaatgtgtacatgcaataatgtgttagatactgagtattttagtcccttcttttctcataaccactctttctaatctttaatgcagcagaattgagttaatactattgataggctgtgatatttggtagctttttacaaacattagttttacattaaattaaatatactaatgtatagaggaagggacagagttattctactactctgtgtttattgacctaactttatattgtgcatgagttacaaagaagactaatactcagtctataagtctagagacttcattatttagtaggagatacaagacacatacccaaacttacctaagatgggatagagttataggctgggtgtatatagaaaatattatgataagcaaataaacacagactcagaaaaatgctacatgtttactaacatttaatgtttcagatgtatatatgtgggtgttggtgtaggccatgcaactacaaaggggagttatttagggaagagattatggcaatagaatacatgcagcataaagtagaaaaaaagctagtaggagttgaagggtacaaaatgcttatgaaatcgaatgctttgcaaactaattttaagatgattaataacagagtcaccatgtattctttagaacctgagaagcctagaaacatgccaatgctggcagtttttgcacaagctgtgcaaattgcaaagtgctggagtaaatagaaaatggaagaatcattacttgctgggggcatcatagaaggcacctaaggatgagaattgagagcaaacagtaccagttaagctctgaactgagaacacacacagagtataaatggcaagtgccttgtgctggctttcattgtgtggatacctagggtctttctgaggcataacagagttcgcaagacagattgggattaggctaaaattgtgagcttacagaagttgagcttatttaaaaggcagtgtgagagccatcgagaattttggagcaggcaaattgcattagcaaacttgcctttctgagggcattctgacagcagggcataagaaacacccaccatcttctcaggccacctgaaggaaaccatttttgcaaagaaatcgtttcctctcctgagataggcagtgggtgcttgttcatttcagtaaatgcatacaactggaattctggcttgcctgccagaaaccccttaggaaaaatgggttatacccaattgttttcccctcctcactctctgctcaacgggtagcacaaggcttctcactaggaatattatagcaactgttcctgtcaagatcttattgacttccatgggctgatcctatgttctatttctcccttcctttctttaaatcctcattttctgagctcttcacacctgggtttcagtttgactttcatcttctatagttaatctctaaacactggaatgcccatgctttatcagtacagcctcttagtggtttcaaccacttccatggtttgaaaactgtctaaaagaccaaaactggaagtgggcagtagtataggcagagtcatttaagtggctttcccactccaagttttgtccttttaatattattattaattactgtcaaccccatcaataactgtaaggcttgcaatgaattcactacactgtctccagaatgaagtttaaatcataaatcataaactattactcatgttcttcacacaatagcattatgatgcatgatgaataaaatctaaactccttttgatgatatacaagggccctccaggaactggcctttgtattctttcagccttgtcatgtaccgcatcgttcatgctctccatacatagcctagtctctgtcttttctgttctggtaatcagtcaggttgggcctcttctgcagttctagtcctggatccttccatgcaaaaggctttgtccttaggtcccagcatagatgccacttcctcctgaaggattttctaacatatccccctgttgttgttttctttttgaagtattcacctattttattgttagtactgatatctattacattctcttattcttggaccacttgcttcctattctccaactcacatataactagaaagtaagcttccttggagcaagattggcaattgtgtttcccatgcccacaacagtgtcctgtatgtggtaggcacagaataaatatgcaatgaatgaacattgaaaaaattaattggtaacagagtgatttactgaagaaatacagacaacaggcactaaagcatttaattaaattggtggcagtcagaagcaaaatgaaggataaaaaaatcaatattagactaaccataccaagatttcaactaaaagtacttaattctgcaaacaatagaacactcttccagggtcaccatttctattacaaagtatcagaactggcaagacaaatcaataatgtgctaagtaattatcttttcattcatcagaatgcaacagaagaagtaacagtagtttagtgcaggtcgctaactgcaagtgttggagagaaaggaagagacaaatggatctctacattcttgctattaaaattcaaaacgtttctgagatgactgaggactgggtaggaggggatactggcaggtttggggcagggtatgtcaaattttattcactccctgcaatgctggcagggtgtttttatttgggaaggacggaggctggagactatggataccatcagcacaaagatggaattccaagcaacaggagtaggattctgtgaggaatacaaaccacttgaagggagcagtaatccttatttgaagaagtttacttattatgtcatcttctggctcccagaagacactaaaaaagggggggagtgattacaacaatgtctcatttcttcagtctctcccttccttgagcaaccgggtagatcttgtctcatgcagatgaccccgagcaatgggctctgagaaagcactttggtccttcttgccattggccttgaaaatatgctatctacagggacaaatgtcaagatgggcaataagaatgcctcttaatagctctctccattctctgaggagatgaggaaagccgagctataaagtagtccccagtgctacttcgcactcccaacacaaatgcacagtctgaaacttgaagcacaccagaatgcatgtagtcagcagcaactgcagcaacagtttcacccagacagctaaagctgtttgtaaagctgatttattccttaatgttgttagttgtcatactgccattttaatttttactcactgccagcctgtggctctcccagtgaaagctcatctgagtatgtggcagagctgagcgaggccctcagattgctagcggcagctcctctgctcagaaggcacggctggcagctaccacattctgctacaccatcctctctctttggcagaaagcaaggcctcatcctccatgctggccttcatcctgaactgatgcaagccaggagcccatcacggactgattgtttagattctgttagcaaatgggcatcaaccagtgtcagggcttgtgtggtgacgatacaatagggttcctaaacgaggacaagacattgtttggtttcaattcaagggttcatttgtcttctgtttatgtctagctaccatactgtaaagcagatggcttgagtaggccagaggggttgctataaaacagactgtgaacaaaacggtttagtagatcggtttagtagatcacagctctcaggtgctgcgtgaaattgactcgagcttagttatggtccttccgtttgccctggagagagaggcacgtttaggggagctttggctatgtgtataagaaaacctcatctcagtctggattttgagagcactccattcccttggagggagggaaagaggagcagcaactttatttgagccttgtgcaccctttcatccttaggacctctagtagtctggagaatagtgggtgtacaataaatatgtgttgactatgagaccagataaaaatgattcgatctcagtgatcacactgataaactcagcttgtcgggtggaaggttttcctagcactccccaggagaatttaactagggaagcagtctaggccgaatctaaagccccaacatgactgcttttcattggcactgtgcccatctgctgcccttttactttgttttgactttacatctaatcttacacatcaaacatcttgagttatttttcatctttggccaatagtgacaataaaataccattcttgctctccttgtcattgggctgccacaatctctgcttctaaacaatttggattcccatttgttggctggtctctgcttagtgtgacgtcaggtaagtttttatgaagtaagtgtgtgtgtgtgtgtgtgtgtgtgtgtgtgtgtgtgtgtaagcaaatttcactgtctgggagaaggaaaaagtaaacagggcaaggaaaggtgataaaatggaaggttataaggtaatgatttatatcttaatgaaataatcaggtttgtgtgtacttgcctgcatgcatgtgtgcctgcctgcctgcatgcatggggtattctttgtttcagagacatagtctcatggaacccagactactttaaaacttgctctgcagcttaaactggctttaatttcctgatttttcgacctatacccagtgccactatcaccactagtcagaaaaatactcttattggtaactatatctttaactgggacaatagttgagctaacctactcaagacaatggatgacgttccatgcagatgtagggttcattgactcttagcaactcctaggtcagtataaaactaggaggtgagaaagctggaaaatgaacaagtacattgctagtgaccaggtttccacttgcctttgaagggggactcaggaagcagcagccacctactcccatctctgccttaaatccggcttgtcaaatagcctaatttacagcctatattcattcatggcgtcccgtctcttagcttctcccactagctccaaaaattacagaggaaatgaaatgaaaattcaatgaaaatactcatgaaataaacaaacagaccaactattagtggttataaacagaggatggggaatggagtacaggcgactgagtcatttagaacaaacactgaaatacaaggtagtcaggaaatgctctgctcagaactgctgcacaaaacaatcaagtaccatattattagataatataagataatcctcaaatgctctttttcatccccctgcctcactgtgttaataataatgacagctaatatttactgagtccttcctgtctgcttagacactgtcttaaacatcttttgcccattatctcacaactctatttaattctcaggatgattcccacaggccaggtacaattatggttctcactgcctcatacataatggaaccgaggttcagactgataattctgttttcctgggtcaggccactgctgagaatgatagagatgtgaagattttctaacctcagccaaatttattcaccaatgtgctgtcataagtacattccatcttttggatctttcctgtaagtcctactttaatgaaatcttaggccaatcaatgatttggaaagtttccaaaaagttttggcaaagttttggaaaagatggctctggtcatacctggaaggacaaaaacagcacaaaaagataggaaggtgggagggggattattgggaaagggcagtggacgggagagaaagggaaatgagagaagataggaaagggcaacaacaaaaagcacacacacacaatacacatatacatacgtgtgtgctgagtatgtttttatgtgtgaaattgtcaataaatttaatgcttacaaaggttttaaaaagttttggcaggctggagagatggctcagtggttaagagctcacaaccatccattgccaccttcttgtatgtcagaagacagctacagtgcactcatatgcattaaataaataaataaataaataagtaaataaattaggcttttaaaataagttttggcttcattcaatgaagaaggcatttaatgacacagtcacaaattatctacagcagaaaagaacaaatgatgtgtctattgagtgttgaatattgttatgaaataaattatattactttattattctatgaacagagactggtggcatttatggtagtaatatgggtataatgaaagtattcaggcacataattatattacattcacgtttccttctgagatatttcacatgctataatacataatctctttgtaattaatgtgataagtatctgataccaggatttacatgtcttcttctatgaagaaactttgagattaaaatataggcatgtgtcatttcctggtatacttgatagaatgagttgtgctcaagagctgttgagaaatagctgatagaaatttctatcactggttcatgggcaagtgacagagttgaggccacagcaggttctaaaagacttccaaagttcactggttactagcatctgccagtgcaaatggggaaattgaaggttatataaggtttcgattctaaagcagattcggtgttcatgaggtcttactatgtctttatcattacagatactggatgacagaaagttataagcagttagtagccaaccataggcaatgcttataagtacttattccctataggctatattggcaaatttgctcaaagaccttttccaggctccggcacttttgaggtatcacatagcatcagaaggatcttgctaagagtgagcccttaggccaggctacattcagtggtggtagctctcaattcattttggatactcttgagtatgccttaccacacaggacaatcccatctatccacgaaccctttacttgacacagtcccttaagccactatcaattaaaaagagaaagtacagatagagcatattgagggtaaggtccacaaaagtgcagaacataccctaaggtaactctcctgacacttgtccatgcttcacaaaatgataggctgtccttgctccccgttgaagctatagccaagctatgtgtgaattaggagctttgcctttgagattgcatcatagcatgctacacaccaagacaagtctattctacaccagagttctgcatccttgtcattgctctccatgttttgcctttctttggtgagattacactttttaagattgtagcaatcactgaaatttttcccacagtgatgaagttgatcctaccccatttttaactgcatataattgtgcatctcataaggtcagtctctatcacccactattagtttgcataggacaaacaaatcagaaacttgcccatcactggtccactgtgaactgacatgagtatctttgaccttcaccagggcttatacaatcattttgctcatagagaggcaatctggtcccaaaccatggtccacatctttcatcaaatgcttagtgaatccacttttatagagtccttcctcattaatgctgtatgatatggaaggtcaaaaacacatgcttagaccatagcactgcaaaggtaccaactaaacaattatagaaagaacttaaattttgttttttcaaaagatgaaatagtcatagtaagaaaaatcagagctttattatatagattttttaaacaattttattagatattttcttcatttacatttcaaatgctatcccgaaagtccccgataccctccctctaccctgctccccaacccatccactcctgcttcctggccttggcattctcctgtactggagcatataatctttgcaagaccaagggcctctcctcccaatgtctgttgtatgatttagaattccaaagaggagagtgaaggtcaaaacctttctagtgattagagcttccaagggcactatttggccctgccctcttggtttctctgctgctgtaagagagccctttgccactacccaaaccttctcactcccttaatcaactcttgtttaatgtactaatcctacaataagggaaaatattcatatagtcacgggtggggccattgtcaaatgttaaaactctgaatatttttctgactgttagtaaaacagccattgtcatgacttgtccaccatccttcctattctgagtagtttaatgtcaacttgacataaattagagctatctggacagtggaccctcaattgagaacgtgccttcattggattgacttgtaggcaactctgtaggatattttcttgattaatgattgatgtgggtgtgtccaagtcattgaggacagtgctgtccctgggggtggtgctggatggtataagaaagcaagtcgagaaaaacatgggaggcaaggcagtaagcagcattcctccatggcctctgcttcagctcctgtctctaggttcttgcactggtttcccctattgagggactgtaacctgtatgccaaagaaaccccttgttgtctgagttgcttttgatcatggtattttatcatagcaatagaaaaaaaaaacctaaaacactatcctccaaatatctgccaccacttgcagctctagaatctgccctccactccagatcactggaccatttcataatcaaacagctgaaggcaaaatgcttgctccagactcttttttggggagggggggggggtcgagacagggtttctctgtgtagccctgtctgtcctggaactcactttgtagaccaggctggcctcgaactcagaaatctgcctgcctctgcctcccgagtgctgggattaaaggtgtgcaccacttattccaatgttcaaattgataggtcagtgtcaatgcaaagtcactttctaaacattttaggtaccatccttttctggaatcactataccaagcatacaactttacagaaacggttgcctagatatgtatgccgctaggtaaatgtttctcaaaccagaaaagacttgggacacattatgaaataaccactgctctgatgccatgccccatatgtatatatactttgtcttgaggcaactttgtcaaggagagatatcagtgcctccacactactgatatttacagatctctgcataccacacggcaggttttaactgccttctgtattagctgctttcttcattgctgtggcaaaacacctcacagaagcaacttaagggaagaaagatatatttttatttgctttagggtgtaagaggttgctatgtgtaactgcttagtcagatatgattaatgtagactctgattagggattagctcataccacagaaagagttgctccaggtattatcatcctgggtggtttcagagatctgtcaactcttcagatttatgtttgggaaaataggttctaaacttgattgtttagaaattggaaggatctcacgctaagggctgatgctacaaccaagatagagttagatacagtgcatcatagtcaaaggcatgataatgggaacatgagatgctggttgcattgtgtccatagtcaaggtacagagtgatgaatgttgatattcctccttctttctcttctgttttctgtttatttacccaaggatcccaacctgtgggatggtgctccctctaaagttattctttcctcttcaattaaacctctctgaaagttctctcaaagaaatatccagaagtatgcctcataggtgattctaaatccagtcaactggacattgaaaattaaccaatgcacctcctcatcatttactaatagtgcctaatagcctcgacagcctatgatctggtcagtatatattgtcatgacttgaagtaaccaacgtgaccattatattcatagagacaatgccagttcttccaagctggaagatggtattactagatctagttttacctgggatctagcgtcagtccctaacaagtattccacttcaattcttgacagaacattaggcaagacttaagagcaaaatctctaatactatatataataattcaagcagtcatctactaagatataaagcctcactcaacaacagcaaagaaatctctagacttggcagacccatgaaatgaaagcacatggggtgatcaggactgaagaagtgccacacctgctcttcatatggcaggagttaatcccttactagaccagagttcatgtcagccatcaaatctggttagactgaaagccacctcccacagtctgaaacaaacacagctaacccagggaactagagtcaagatagtgcaaatccaaagtagaccaagagccttgtgggagctgataagatgactaaggccccctgaagcaccctctatttcatgagaccacccggaaacaaatcaggcatatttgccccactcctcgcatgcatctccaacccttcctcccaccgattagcttctctttcttatatctctcctaccagtaactccttactgatttttttcacgtccttattcccattctgtgttggcttactcagtgctctaacatttaattactacaactttcaagttttcctagttacctttaatcaagaagagactcaaatgacttctaaagtagtacctactagaagtattaccagtgactttgtttgctatagcatatttcactcctggagccagagtgagttgaggatcaaaagcctcttctttagttagtgatatatcatattaggaaaaaatactgatttaaaattttctcaatgtgtactttgttgtcaagctttaattgcatgtttaaataaacacagctcaatgttgcttatgtcctttaaacctttttctattgagtttcttctttcataatgtgtcatctattggcttctgttcctgtatctaatctaataacgctaaatcttcctccaccctcaattttaagaaccttctatttggtgtgttttataacttatgcttctatgttttaagaatttctcatatttagatggatagatagagatagttagatagatagatagatagatagatagatagatacagatacagatacagatacagatacagatacagatacagatatagatacagatataggtgcagatataaagatatatgagcctacatagaataatacttttcttggttttatgctgatgtggtacatattccgcagtttgctttttccatagacattgtcttgaagtccttatcttgtagatcatgagttactgtatttaccagggcaatccctacaagactgcagtgcccatgggtcagtgaagggcctaaagttaaaccagtttggaggtggtgtctgttatattgcacatgagaaaatacttatatagttgaagcttagtgattgtgattggttagcagattatctcagattggatagtaaatgaacatatcaccagggtctctatgtggaagaatcacattaaaggagatgtagagagagcaagtgcagactcatccatgagccagctacctggctactcacactacttctgaattcagtgttctaacttctgggaacactgaggagtatgatgtgccatgtaggctggccaacaggtcatatctgcattttctcccacaatgcatgtgaatttctgcacagtatggtacattatggataattccaatttatatgatcattccctttatttgaataaacataaaggctgtttccattgttctgttcttatggtatttgtgaaaaccttagtgtatgtaattcagtttctttagtatatgtcctaaaaataacaaatgctagatcactgtaaatgtcctcttcatttattttcataaatattacaatattacatttctaagtagttttacaaattcaaaagaccacgaaaatatataaatgtacaagattcgttaattagttttaatatttaattttgaaatgattcaattcctaaaactgtaatttatgaatagttatattatttccctctagatctaagttaatattttctatgttctatctatctatctatctatctatctatctatctatctatcatctttatttatcatagtcactggaacatttcataaaaacaatcatcactcagttttgtggttctggggatggactccaatgctgtatgcatgttacacacacattcttccactgagttatatcctcaggctaatgtcatgattcttgacccttaaatgccttacaagggcctcctaaaaggaatggcattctaatagatagacacaacttatcttcatacaatatcatattccatgtataaaatttagcagtagtttcctcattcttataccatttaatatctaattcacattaaaatttccccaggtgtcacaaaatgtcattttaatgttttattttgacaactgggattcagtcaagtttaactaattgaatgttttataaaatgtaattgaagtaccgaaagacttcatagtttaaaattgaacagtgcagtgatatggtttattttgttttattttgtttgagacaaattattgctgtatattttacctcatgctagccttaaattcatgatgctcctgccttattctccccagaactagaattccaattatacagtaccatgatacctagtaatattttaaaccatattgagtgcactaatgtaataattcatcacattttatcatccaataaatactatatcaattaggagtcactccttaggttctcttactctaatcagaactatgaccagatctatgtaggatgtagtaccagtccctaatatgtgatccacttgaaatcttcatagaacattaggtaaaatctgaaagtaaaattcttaatactatgtttaataattcatacaatcgtctaaactgaatcaattgtaaaaccatgtgtctatgttagtatatatgtatgtcttcttttgcttagctataccactcccagatttttcctatgttatattttagtattgtgtttttctcattttatagcagaatagaaaacccctgtacgggtatactatatttggtcatttaatcatttattgacaaatatctcagttgcttccacttttgggggttctataagtaatgactgtgaacattctttgtgataatattttgtggggacatacattttcttgaacaatgagtatacatctaagaataaaactgatgtgatctacagtgggtgtaccatttacatcatcagcaaccaaaatcacagcttttccaaatactgctcaaaacttattgtcaaaggtactgagatgtcctggtcagtaaaggtacctgcttccaagcctgataacctgagtttggtgtccagaatgtttatggtagaaggaaagaaccaaataccacaagttatcctctgacttccatatgtgcgctctgcacacagaggggggtggggagggagagactctctatcagaagttgctcactttcttttttatgattccagaagagtctaaactaatgaggttctgctaagaaatctatgtggagagaaggagaggggaatggtccaccaagctcagctcctcttacgagctctttctggttcatcataatgctgttctgcagtataagattctacttatttatctcattctcacattgagttaaaattcttagttgttaaaaacaatttcccacgtgactatgatgatgaagattttcatgtgcattttgagtacctggatatcatcaccattgaagagatgttttcctaggttttaggttatgttatcattttacaatgagttatatttgttactcatatagttcttcccagttgcctccttaaagtatgatttacaaatattttctcctattctgtgggttatgatcaaattttctttagaatgccttctgacacagaagaatgttatatattttttaaagactttatgaatcctcatttgttttgtttgtttagttgtttgtgaaggattttgtgaaggtctgcattaaatttatagatgaatttagagtatggtatcatcctaatatcaaacctaatttatgaaaatagatttttccacattcattcttctacaattccttttagcagtgtttttctgttcttattttctgtgtataatggttagattcttcttggcttgttattcctcagaattttattgttatttatgctcatattctttcatgttcatactctaatccttttttagtattagcttgtttgttccactaacttttagtgcattcctggggagtgttctgtgtataaaactgtgtcatctctcagtgtagatgaagtagcacgacgtccttttctctgtggatatcctttgttcttctgccccattgccctggatagagcctccactactaaactgaaaatgagtgatgagatcagacactcaggtttgtttctcaacttaaagtaattcattctgtcattcatcattatgttagctatgggtttcttagaggttgggctgtttcctgccatttctagtttttgaatgttttctaatcataaacaaatgtgggagtcttattggatattttttctgtgtctgttgagatgtgggattttcccctttattctactaagaatagtacaatattagaagacatattgatttatttttgtgtgtttaaatacacttacattatggaaataaatagcatgtggtcataggttataatcaattttgtacatttctaattttcttgccttttcttacatttgtatttatcaggggccctgttgtataggtccctttctagtaatgtccttatctggccttagtatcatttaatattttccttaaagaattagaaggtgtagtagtgcagggctgtaacctagtacaatattagaaagatggggagaagaaaattacaagttcaaattcattgtcaactatacaactagttcaagttcaggctgtactgcatgtgacctgattttaaaaaagaatgaaaagagaaaaggaagaaagggagtgggcaggaagaaatagaaagtgtccctcttctgttttttgtaattaatgtaggaagtattttgattattaatctaatctctttatacgagtctattcagactttctagtcctttagtcagcttggtcggcatttcattttattgtatctctttagtttgtgttattctagatcagtattataacccctttcccttcaaattcacataaacattcaaatggattaccattttttttcatgcagtattttggataggcaaggttctcattggtttgagatgctgattatatactaaattcttaaatatgaatgctcaaaaaatacgcatgctcaaactttttgtaatactccattgatttattttaatctggtcttatacaaatacatttaattactcatatgtacaatatgcttttacatctgtgaggaaaatatgttatctatttctttttttaagtgatcttggctatgcttacacattcgtttttctccaaaattttagaatcagctcgtcatatcgtatgaaatatctcttgagatccagattctcattatgttcatcttataaaattacttctgtgagaatttatatcctcactataatgagtcttccatccataaacaggttctttcttatgctattcagtaaataatcattttctctgtgaaattttgaacatttttaggaaaggttattatcacattgagagttctctttgtattgtgttattttcaaccacactttccaattgattattgataatatatatatataagtttactaacattgatatacaagccttagaaacaatcattttttaaagaatttagtgaaccataagttttgaaattttcctttgttttaaatataatttaattatatcccttattggattggctagaatatctaattctatatggagttttagttgttgataatcacctcttctattttactttaatgactatgttttgaaataatcacctttgaagtatacttgttctttgtttctattagataagtttatcaagatattttgaatttactaaaatggtggctaaatcatgaaacaatggtgttgtgattgtagctccaatctgaggactgtattccatcctcattaagaaataacacatagtttgaaaattcagttgagttgaattgtgggaagattgaaccccaatctgaaaccatctgatgactcaggaagtcatctagaagcaaacagtcttctagagagctctttgtataatgctcaaactttgtgttatgcaaatgtaagatttgtcttactggcctagaggaggaagaaaacggcaagattgggtctaggcttagaggggcatactccttgtagagactttgtttcctccctttgttcaagaagtgatttgagaacagaagaagaatgactgcgatttgtttcacctcccaactctctaccattgtttaaaaaattaccttatttcatctgctacctcgggagagaaaatccattcctttgagattgccatcctaatcacaccggccactggctagggttgattgaattttctctttctgtgctatactgtttatagttccatatggcaattccaaaccttgatacttgaaaaaaaaaatatttgtctcttactccagcatggaaaaccttgtactgggcactaaatacctaacaagtaagatcttcaaataaatctgttcacacattttggggaataattaggaggaagagtgggataatatgtttctgttttattatagttagtaagaaacatcattggccacatggctacattacaatattactccctttcttctcatatgatataaactgaactgtatcatttaatatctctgtctccgttttcaatattccaagtgaaaaaagtcattatctacataaaattcattgtggtgattaacatagatatgtatagaatatttagccaaagatcaaaatatagtggaggctcataaaataatatctattagaatgaagtatggaatgaaattatcataaagctcagagaatgagaggagagagacactactattatctgtatacatttgtctccagtgacttgcatgcatgcagccattaaatgacttgaatgcaagtcaagaaaaccttcagtagccttcagtttctggtcctacaatctctcatagcaaagtgtaggtactcaaaactaggtttccttgcaaaagtagtaattcctatagcataaaactaaactatagatgcctcaacactgaggcatctagagaatggcaacccagctgaatgccaagaatgactatttaattcctgaatgcatccagaattagttttgtcttctctggattttaccaggaagggaaggaggatcattcagcagtgctctatactacatgtacttcctagccaagtaccttgaggtatgctgttcccatttctgttctaaacatctgctccttgattgctcaatgggggaaacaatacattctacatgtaattgtgtctctgacacgctcctaccttgaccaaaatagctcctcactatgtaggaaatttttctcattttcagacaaaagatgacatggaataactttccttagtacattgtgagaaggaaaagcagacaacttttaaatgattataataattaattgttgatatttattgggtacatagtatattatacagatcactgataaataagttatatgaactgtattatttagtccttataacaaactaaagtcttggtactattaaactcacttgcctaaattatgaaaaaaaagcattaagctcagtgtggttaaacattttactcacagtttcataggctttaaaagtttcttctgccagtatgaaggaaatattttacctattgtgtatcttaacaagttattgatgatgtatgagaaagctattgatttttgtagagtgttagtttagttcattatgttagactttaatattggttttaatattttctcacttgacattttaaatcctccatagggttactgcttataaaaattgtccacttcactgttttgatttcaaatattctctcatttctcttgccttaatggattgacagagcatgacagagttgcacagtaagtagtgatagtggccatttctgtcttgtccattggtgtaatattttgtcaacaactacttataacagcaattagtgtttattgactgtcactctcaatgaaagccattcttacaagtagctttatatactttatgacaaataatccttacataacattacaaggaaggtattgttatttttcttagtttttcaaatgaagaaaagcttggagagatatagatttttgcctaaggttatacaacttgtgtaggatggaaacaatattcaaacctgactcaaaaagcttgtggtcattgcctaaattatctcctcaaaattttataaagatttattgaggaattttcttctattgctttatggattttgtttttttgttttgttttgttttttgtttttaaatagaggatcattaagttatgtaaaatgctttttctatatctgatgagataggtatatttctaggtttctttttatttgcccttgtagtggcttgaatttgtaaattttttcatatcagattgcccatacaatgaagggataaaccctactttatttgaatgcatagtctttcaaaagctgaaattggggaggaggaaattttgtataatattctgtttaaaatacatatattagtattgtgtgagaatgatggacaatgtatagatcagaggacaactttgtggagtggtcctcctttctagggaacaaaacttggattttcagacttgtggaccaggagccttactcacaaagccatttgtccttgtctctcttatttttaatatcactttggtatctatttttatgtgtgtttatcttcctggagatatttactgtgccttctgcttttttcttattagtacttattgaaggcttgactttaaaaaacaatttcagtttcatgtatcaactctaatttatttgttttctatttcaccgtattctgcttttatctttattaatctttgccctccattttacctgggtttgttttactgggttatttataacttccggaaaagatagcttagttaatttattttccatttatgtttatttcttaataaatgaattcaaggccatatggccttttgctgattatggcttagcctgcatctaaaagattttgatatgtacaactcttattatcatattaatataaatgtctcttcatcttaagagtccttcacaagggtttttgtggttgaaatttataaatgtctgttgggataggcctgtgtcaatggggagtggcatagtttgctatctttttattgctggtttctaatggtatttgagtcttgcatggctgatttctgtgcttgtatgctcagtcagtacaagtgttaagagtccatccagtgtctcggcaaggggtggaggtgggggggttgtctgcctgtttactgaattgaaggcagtgtgagtgggattggatttttgtactctgtaccacctgggagtgggcatttgaaaatgtgggaagtgaagcagaatgccagtgtgaaaaggtcagctggcttgcttcccgcaaggcagccctcccttatacagccttcacctgggttgggaagagggcatctgcttttacagccctgtttgccaagaatcatttataccatttagtcctaaaaattgtggctatatttcagatacctagctgtttgtttatggtgctagtccatgggttatatgtgattgaggcaatagcatcttcagtcgttttctttttttttcttcttcttttttttttttttttgcttcacgtttttttttcttttttttattacgtattttcttcaattacatttccaaatttctaaaaaataatctacagtgaaagacgtatcaatgatctattccatagaggatagggtttttggttaattattctggcaggcaatgtctttacctttctgctcttcaagtgcactgtctccataaccaaagagactacacacacacatacacacacacacaaacaaacacacatatacacattcttagccaaattaaaaaaaaaaagacagacaagatgcatacatgcccagcttcatctctcctccccctcttttgtctgaaaaataaaaacaaaaaaattctacatagtgaggtgctattttggtcaaagaaggagcatgtcagcaacaaaatttcacatagcatgcaatgtcactgctttgttacacagatctctgttccttgaacttgggggcaccagctgccatcttatttcttttgtattatctaacccatccaacttctatagccagtctttccaatgctgccttatacatgcaaagaatggtggtttttactttgtttcccagatgaatggggctgctactatccactaactggagccccagaaccgtgcttcattttgcctgcctccactgtgtttaattattctgcttccttgacaaccttaattggacttttgtagactgaatatgactgtcatttccttcttttctgtatcactaatgacaatgcaaagtaaagagagacctaatactgtggtcctttttaacatctctgtcagatattcttatgcaacatatttgattatcagttagccctctccttttatagtcagttttctgcccatggaagaatatgatgtcacattagacacactcccaaacaaagaaacagaccctctgctgagattctagggtggttgcactaacccagggctattgtgaaaacccctatcttcatacagctgactttgaggatgtatatgggcaaagaagattgattctgaaccatgtgtgtgctgatactgtttctgactttccaagcttgaggttgtgtgtctagactaggacatgcttcaaatggacacagctaatctatctgaagctgagtcacccttgctacagacacagctttacaatgagaaaaatttccaattcccttgaattgggagaaggaataaggaaatacttaaaaaaaaaaactccaagaatgttagtatttgaatctaatgttaaggtctttgcatacttaagactgtcactagaactcacaagcaactctttcaaatgagtcctaaagggctggagagatgactcattgattaagagcacatactgttcttgcagaggttcttaacacctgcaaaagatggcttacaacctcttgtaagaagttagaaatcatcttctggcttttgtgggcaacagcagtcatgtatgtacacaaacccacacaatatctatgtctatgtctctctctctctctctctctctctctctctatatatatatatatatatatatatatatatatatatatattgaatattttaccttagagccgaatggaccatgatgctgtctaatgattccttttactagggatgctatttttatctctattttatagatgaggtggctgagatttacaaacaaacatgctgtactaaagtcccagtttcatgtgaaaataccatatccgactctacacctgttcacagtgatactactcttgctttctgttttggtcatggctttgatctcagggtatttgcaaaagtgtccctccatgttgttatatgctgtgcttctagtagggagaattttcacccataacacccataattgagggtagattggactcactcctgttagcttgtagaaaacgatatccttttaattaagtgatactctcacaaagctctggagccctgtgtggttctgtcacatgcagcctgcctttttttccaactccttcatgtctctattaaaatattccttgcaacagtacttcacgaggtaaatgttgtcatcagaagatgattttcttagttaatggtgcttgcatagactttagagtctgtaagtagtccaatataataggcagcctattgtatgattatattatttagatggatattacagagagtcttgaagacttcttacatacaaagctggataatgctcatctgatttttctgactgaggtgcacatgtcctaaaaatattgtagagtgcaaacactatggaactcttagaaaaatagcctcagaattttccctttaagggtttatcagttttctaagagcaggagtaaaatatgatccctccctctaataatttatttctaaagggaaattgagacaaatgatatcagcaaggcatctaaataaaaatttatatgtcataagtgtagatatctagatatagtctgattatgtagtcacctagccaaatttatatactagaatttgtggtcatctggaggaaaaaaccaacagaatgtagctatgtaataaaagggaaatctctagattgatttatgtagtagagctgggtagttcggtggtccaacaatgtctgtatccacagcctgggagctgcttgttgccaagtccatgaagttgatggtcttagcagccacaatctgagactgaaagcttgacattcccttgagagtaactgactgcatattagaaacccaaagaattggagtctggtggaaatggagaacagcagccagagtagatgggatttgtttaggaagaagatgtgaaagcagacaggcacacactgtttttttttttttctctcagatctctgtccatttgagcagggcattagtaggtacataggtaccacctactatgagggcaggtttctcctgcttaattctccctaaacatgccctcacagacatgcccaaaggtgcatctcctaggtcatgctaaattctgtcaatttgatagtcaagctcaaccgtcacatcttgcagggaatttgaagtcagaaagtttctagccataccacctcgaaggtgcccagtctccttcagatatcaccactttctagctttctggccttggatatgtctctgaatatctccaaaagtcaatttctttatctataaaattggaatagaaataatttcccagtctcttattcaaaagccttagggtcaaaataagctccataactcaggtttttaaaggaattttacaaatgtggcaaactttaataattttagagggattagaaacagtattcagaaatcaatcacattgaaatttcttttttctttttttattatctttaatatttttttgcagtctagtcattatacccttcctgctcctcccaccaatggttcctcatgtcattcctctttccctgtctccaagagggtgacctcacttcccatatcccccacaccttgccaggcctctccattccctggggcctcaaatctctcaagggttagttgagtattctctcactgaggccagatcaagcagtactcagctgtatagtgtcagggcctcagatcagctggtgtatgctgcctggttggtggcacagtgtcgagagatctcaggggttcaggtttgtcgaaactgctggtcttcctatggggacaccctcctccttagcatcttctagcctttccctaactcaaccacaggggtccctgacttcagtccattgattgggtgtatctgcttgtctcagtcggctgcttgttggacctcttggagggcagccatgctaggctcctgtttgttagtacaccatagcatagtgtcaggctttggagcctccccttgatatgggtcccaatttgggcctgtcactgaacctcctttccctcaatctcttctccatttttgtccctgcagttctttcagacaaaaacaattctgattcatagtttttgactgtgggatggcaaccccatgcctacacttgatgccctatctttgtactcactaatatcatcctgagtgaggtcacacagacccaaaatgatatacatgatatgtactcactaataagtagatattagccaaaaattatagaatacccaagatacaacccacagatcttaagaaggctaacaagtggaagggcccaaatgaggatgcctcaattccacttgggaggaagaagaaaataatcacgggaggcagagggagggagggacctgggtgggagaggggagggggcaaggagaaagggggaacatgatcaggtattagggggcaggagagaagccctaaaagccagccgatagaatggaaacaggcaacctagagaagtaggaggtgggggaccctccagaatgcaccagagatctggaaagtgagagaatctcaggactcaaaaggagggaccttagatgaaatgcccaaaagtggggagagggaaattgtagaatccacattggtatttctaaaacaaaatacatgagctaaggatctcatgtgaatctatgataggctttttcatgcagtttggcaggaagcatatgaaaggctggtttatggagcattctggaatttagaactattgacaatggaatatatgtttgtagtggaacacaagcatttatgtatagggagtttcctgctcaatgacagttgaaactcagacatcacagtgatttactaccctactttgtttggagaaccatatcacaagcagcagcagcaccaccaccaccaatctgtttctgtgagatgatatgtgggtgacaagagtctctatgagaaggacaatggcagagagacaaagctgtggaggtagagagggataaggcagagcactattgtacgtatgttccaggtgtaacttccgtgctgtgatgacaaactgtggcaaacactgaaatggacacccccactgtactgagttggaaccatcagagctttttaccaaagctgctactcccggcagtggcttccactttcttttaaccagaggtgctgattgattaggtcctggagtgggaacttctattacaaaaataagcttcatcaaatgaaaataaacacctaacattcgcaaacttattacagacgtacattacatagagaagaagttcagagagggaagcttatagcagtaaatgtatacatcataaaaaagatttctaagaaacaacacaacaaccttgtgatatagaaaaagaacaacctaagcatgaagcactaaaagcaaataatgaagagaggagcaaaaataaattaaaacaataagaataaccaatagcacaaaattgatttttaatttttatttttttaatttaaaaatatgtgtgtctacgtacatgactgctgtctacatgtgtggtatatgagtgtgtgtgtgtgtgtgtgtgtgtgcatggatcatgtgtttatgaacacatggaggccataagagttggctgtctggttctatcattgtctgcctcatttgtctgatcctggagttaggtgggttaccagaatggtgtctcttcacaccaatagaacagtgactaagacattatgctatatcctcattctatcttatatgaaaatcaagctaaagtggattaagagcttgaagataaactctgaagctgtgaaataccaaaaggaaacataggagaaatgctctatgacatcaactggccagtgggtttttccagacaatattaacaaagctggagaaataggattacaccaaaccaaaagataaaataaaataaagctttcagacagaaaagaaaaccatcagcaaagcaaggagacaatatatggaaaagaaaaaagtattttcatattacatttgatcaaggtttaatatccattgtatgtgtaacaaactcaagcaactcaataataagcaaacaaattatccaatggagcatgggcaacttgctggtagctacactgctaatgaaagttacccctcctccctgggcatccataaactgccatagggagtagtggggtcttatgaactcccaaatccaggagtagaatgttgctaggccccattctgtgtagatcgcatgcaggttatagcagctgctgtgagttctgaagtaaaatggcaatacgatgtcaaaaagacactgctcttcttcccatcctctgactcctaaatttcttctgtcccctcttctgtgatatttcttgaacattgcagcaggttatctagttgttccagtcatgactaagcattcaagggtcacttgttctcaccactttggccagttctgagtctctgtttgtaatcattgcctactgttaacaaaaacttctctgaccccagctataatcaccatggatttgtgggtatagatataaatatttagaaagcagttttgacagcatttccatatgacactagtagattctctaccaggacctacaaattccctagccatgcacttttggccaggttgccagtatcagacacaaattctttcctgcgaaacatttctcttctgcacctcaaatccaatcagaaggtagctggttgtttctatatagtcataccacagttgcaacggtgaacacatcttgcctggcatggtttttcttttcttcagttttcaggtttctctagcggtcaaataaattatcattgacttttctcccccagctgattccatagcacctttgagcactgtgaaagtttgtcagttgggaaagaagtttctggttgacagggctcctctttgatttttctatgtcctagaagcaaaatagaggggcgggggttgtcttactacctagtgcttgtgggcacctactaagaatgctaattgctcatattacttttgaagtctctaaattcatgtaacagctcagagtggcacactcctggcactgagattttcgtctaagaactatgggttctaggagcagtttcccaccgaaactcctttttaagttctatttttaattatctcataaatattcattcatggagaaagggtcttaagcatgtagaccatccttgtctctaattgatagtcctgccacggtcccctaagttctagaattccaggtgtgtgccatcaaagccagcttgcagtttgagattatattaaacagcctcataatgtgcccgtggaatggctgattggtgcattcaaatatgcccatggaatgtccactgtggattataatatttatttcttgcatgcacatccccatttctagaagtagctatatttataagcaactgaagggctaggagctaggtcaatttgagtagatttgtagaaaagccagcttagtagcatgtcactctatcacatatgacctaatgtgcttaaaatattattgattcactggaactaatgaattcttttacctctgtactcttaaagagaagtcatgaactgttaaatgaaatgacacaagctcgggctataaatgctcagcccctccccccaattgtgaggcagcttcaaacacgcactgtatagcctctgcattttttttcattattgattttcatagtatacttcagctcaagctatacatgagatagtttctcctccaggttacttccttgtagccaacttcctctttggggtgtgtgtgtgtgtgtgtgtgtgtgtgatgttttgtgtgtgatgttttatattttgttttgtgccttcttgatgtcttttggtacaataaattgtttgaaatataaatgtttcccgtttttgtgagttttgcaaatgacctataaagtagttgaccaagttcatttctctggattggccaacatagaatcaacatttatccaaaatggccaggaagagattctccatagaggaaaatgtatttgattttcagtatgagcaagtaacccaaaagttctatctttaagtgctgaattattcttggatgcaattttagaaacagtcagacttcaaagaaatagaaaaggaaccagagggaagggaagaataagtagtattcataattagaggaaaatactatcaaatacccttatatatatatgtttaaaatgcaatgaaactattgatacaattaatatgtactaatagtaatcaagaaactttcattattttaaatgtcaatgctcttttaaaaagtaaagtattatatcatacattatcaaagtctccaggttggaaaacagtttttcatttcagtcagtctgttttaatttgatatccgaggattgagttaaaattgctatgagattgttcccagtccccactgtctcctccagccttctaaatgggaagatatcaaaattcaaggcagcaaagacagatgtgctgaaacaaagactggtctcgactagtaatatggtaaaacagcaattaaacaaaaactgagacaccttaacatttatgtttaattaaaagccttagctttgtttttttagcctattggagtttaagaaaaatcctctttacacttgtataaatacagaagtctgaatttgaaatgttgtaagtgaccaagtaacctggctatggtgtgcctgcgaaccaatgtttcatgagggcataattcttttgtttgtttggtgttttgttttttgagtctggagttcactaagtagcccaggctgtcctcaaacctcccatcattctgccccctcctcctgagtgctgatgtcagcaacagtagagatggagccacaggtacacactgttgcctccagcagcctgagcagtctccttaatcatttaggaaacttgactcaggcaaaactagatccttggcttcatcaaagaaaagaattttaagttaagtctgtgtgaatcaaaatgggagtttattagaagtcattttaaaaacatagatcttaagaatgaagtttaagagatggggataggcaaaataggcaatacccaaggctgtgtaaatgtaattttgtctgctacagccctggaactacctctgacctcatttaaattatttagtaatcatttttagtatgtaatgacttgaaaaactacccaagtcctctatgtaactattgtaaagaggataaagtataacttctcagaaagagagagagagagagagagagagagagagagagagagagagtcttatctattggcagtcttatagtaagtgctaattgggtgggaattctggattctcccctggtgaggggctttaccctgactctggagtgggagtcttccttcctatgtctcataggtttttctcttatggttttctgttctgccaaactagatttgtgagcttgtgccatcacaccatcttcagttgcaacatttgccattttattctctaaacaatctttccatgctctccccaaatacctgcagtgacagctccatttttaatatgcacagctcatttttggatccaagtatcattgcccattccaggaggatcctctgcaagcaagcagataccagaagaagacaagaaatgaaagctttaagacagccctggaaaattgtcaatcaggttgcctccttcccagatctaggagagggtagatttataccctctttttttatggggcttttgatatcagaaagatgtccctgaaacactggaacgaaagaatacattattactagtatgactagtctcatttgtttaaggtactaagtctattgggtcagtttcataaacagtagagagtctgataatgttagttttgggggcagcaaagaagtgaggagagagggagaaagaaggagacagatttctaaaatgtggaatatactgaagtcattttttaaatgcatctagttgtcattttactaaaaatgtctaagaagagaaaggttgaacattttgtttgtatttgagtttgtcatttaattacaatgctctcctttctttcctccctacaaatcctcccacacacccctcccatcttttctccaaatgcactgtctctctttttcatcgattgttattgcatgtacacatgtatttgtctatacatgcatgttcccaaatatagcccattgagtctgtgtaacattccttgcatgtatgttttcaggaccgaccatttggcactgggcagactgattggtgtgctcttccctagggagggctacctctcctactcccagctttccttatttgtctatagttctttgtgtagagctaaggccttattcacgttagcattttctctagtgtcatccttactcagaaaggacgaaatgtgaacgctatgtggagtatagaatggcagactttcagaagtgccccaccccttgagacaaatttaaatacagcaaggaacagaatgagtgacaaaccctgggtgcccctcttcttaatatatttctagtaagggccagatcattttgggtgaaaacagggagaatggtgctctgtttctctgcctttctcctaagaactgaattaggtagtgtgtgctttcaattggacaaagctgctttctagccttacaagggtggtgaaaattaaaaagggtcaaagacaatcctaagattagtgagaaagtataccctttctaccccctgccatccaccaatcccatttacaaagacgccccatgtctttcaaaagagacccgcaaattgccatggaaatctgccccaacaggctgtgctccagtcagaggaagagcctttgttcaaaggggtgtggaggggcgctgcaccatagtgaacaccgttaagcctcactaattccctgaaagggggaaaggccaatcttgatttgtaagaagcttgaatttgaaaatatgctgaaagaaatgccatgttattatttctaaaaacctgcagtcaaactgctggctgcagtctgtgcattgagctgctgagactcttaaggcccagaacaaacagataagggctgtaattagcatattggccatttgaatgcaaagtgcacttggagtggcgcttaaaaccgtatgttagcatactcccctagcaggctgatgctttcctatatatataatattaatttgcctagcaacatgccctatttccttttttggcagtaaactttatcctagcaagtcagaatgcagtaaattcccatattggcagcaaggaacgtccaaggaatgaaggaatatgctgaactactttgaaaaatggcttcaaatgcatttgaaatttctacataatctttaaaagtcaacagtggcttactatttattatttactaattagagagtgtatgctcttggatgattaaaagaggtggggaatgcaaagtgtttgaaggtccctcctccacgagcatcttcacaggtgaacactggagaaagaaattggctacaagttcctgcttagtagtgaaataaggattgatcatacaacaggtgcttaattatacagaacaccagtccattggcatcaccatcaattaaacacatctgtgatggtcagccaacgctgcctttgtattattaactttgttttaaaattcacatttaagaccacttaatttgaagtggcactgagttatgtgtgggatgaaggaaaagaaagatgactacaactttgattatattcagtgtcgccatcacattgcttaggacatggaagaaaagtatattattagtttttaagtgtactatgtgtccaacaagctatctggtagagtcagtaaggaaaaggctggtgaagcctcaaagaggaaggaatttaaatgcctgcctcatgagaaaattcccccattctactccatggccttgtagaagtcagacacactgaaagagagatagggagagattacccatgaacctcttagaggaaagatcaatcatccttaagcaatgaaatccctaatgtagtggttcccaaattttgctgcacattagaatctgagaagattagaacctgaggggatttttcaaagcctggatgctcagatatatgccatcaaattaaatcacaatgtttagcaatagcgcctaggcaacagcgttttataaaggtaatttctcctgtgcaatgaagttgagaaccagaactgtaacacctatattttttataagcatttaagttaatctttccaattacactaagaagggggattatatttcacagatgaaagaaagttcaaaggggccatatacgttgtccagggtcttgaattattatgcagtaaaactggaatttgaatgtagcaatttaattacaagagtctacatgctgaaattttatacaacagtgcgctccagaattttgtccccatgtcctgcactaagagaatccgatgtcaatgtgctcagcgtgtattaggcatctgctacataaatcacactgttgtagtcacactatgtgcttctaggtaaaggcaaggagatatggtccacttctgataagtctgataactcaggtttagttgtcatttcatttgctttgttgaagcttcattagcccaagattatcagaaataagactgaggaggtcagatgccttgtgtgacttagccatggagcatccttggtcatcaatatcaatagcaaagtgaatctgggatcattggtaggaaggtagtgtcacctaaaggaggaggggaaccctgggacatttcacatgtgctgtttatgtagccttggagaaaacagcactttccttaaagttacatctggctttatgtatcagttctcccatttagaataatggcaaaactatttattcttaacccatgctaatttttatcctttcaattccagacacactgagattctttcaggtttttgccctttcccagttaggtgggtctgaaagacacattgacattcatataacccatgaatagatttattgatttccagatgagctaataaaatatttcacataggaggacatgtcaacaattaactctgaataaaattggtgtttgagttattagtgttagaccaacatcaatttctacattttaaatatgctgtaaatcaaaatatcagagacatttagtcaaggatacataggggctctggtacatttttgtaacttcccatgatccctacactatttcaaatatttaattaagccataaaatatttactaggaatagagttttgataacaccctttggacctcaggatgtagctcagttgctagtgtgcttacctgttagacgctgtactctgggttctgttcccagcactgcataccacaggaatcctaccaccggtgaagtaaagtcaagagaatcaaaaagacaggggtattcttagatgcatacagaccttgagaccagcctgggccacatgagacctcatctaaataaataatagcacgttccctatgtagtctgtcttcctgtgcttccacaaatagtctgaaagtagttataccttataccagtgtgcttttatataggtctctggatttatctcttacatacattagtattgtcagtgtacagtgactagcagttacagatctctaaaggcttacatgcatgagaaccacttattcatcaatatgccagttgaatatagcctatactattcattaccgattgccagataagaataagagggaagaatagaaggaaaggcgtgggaaaccaagacatataagggaaacagaataccttgacaggccaacacttgggcataaagcaagatgaattggagctggagtataatgtcttctcactgaaattaagggatgtgggtttgcgtgcatatactatatatgtattgtttgtaactacctaatgtatatctaatctctcaaactagattctagatcctataataagatggccaaagtttagttcatttgtataacctttgtagcacctacctttatgcctttaatttgctaggtattcagtaaatgtctcgcaagaatgactgatatatcatttaaaaaatgcaactgatcttcccttttaaaaattatctgaagcccaaatataacatagggtaggggcttgtgttcaggaaaaggaaagtagcaggcaaaaaagaacatacacaacaacaaccctgagctccctttgtatcaggctttgatgaccagttttgaccatgtccttccatctttgaccctgaaccatgcccatgagggtttgaacacaatgtgactatcactaatgaaactggcattctgctcacttctcccattgtttgcctttagtgggaagtctcagaggtgttcatctcttcatcactcatttttcaggactctgatttacaacaaacatgtggattcaggagggacctggtagtggtaggtaaggaaaaagtacactacctttaggacttgggtagcatatgttgtctgaaagggtgatcaacaatttgcctattgatgagttttccccttcacctctggagagaaatgttccactgctcatcatttcagataattgggtgtggggataggggcacttctgttcctgataaccttattatgtgtttatcaggagcagacactgcccaggttgtcacgacaaccagcaatgattcaaagcttccctgaaaggtctgtatctctggcaaataatcagcctttagctttcagcagatgctgaactgagcagccaatcacaggtgagctgagaaaatatgacatcatagtccagctggtccaaatttttttttgggctttctttttttttttttttttcattgattctttgtcccctagatgttctctcgctctctcctttcccctctcctccctcttctctgtctctctcctcttcctccttctctccctgctctctcccaggggagcatgcaagcaagcacaccacaaatcactcacaatcaacaacaacaaaacccaagttttctgaattcaattcactgtgcagtttgacttgcattctccaaatttagtgattgggagtgtgagggaaagaactgtgtaattctcttgggagaaccgtcaaagagcattggctcaattaaataatgtggtttgatatgtatgaccatagaggaggcagaggtaattaacaccaagttagaagagagaaacttcctacttattaattcactgcaagccacctggatttaatcatcttctacttttccttcactgactccctcatgaaatgaaggagggcagaggcagtggccatttgaatcatcgcaggttctgcaaggtaggcctctagtgtggtctaattatgaacaaaggttaggacaggccctctgttcccacatgcacagttaggaatcctgtgtatgtttggcctcatcacattgatgaaggaggtgtgtgtttccttagtccatcaagtttgcttttgtgttattagccattaacatccatacaattcagggataggtgaggtgagttttacagagcagaaagttaataccttggggaattggacttttgttcaaggctttgtccagtttcagggtcctgtgtcacaactctagtttcaagaagatagtgagttcttacccatatgatgctctctgcccccacagtctagttttttcagagacactttggtgacatatctgaactccctatatttatttcatatgcaatccacaaaactgcttgcttcaggagagctttagatgctaatatactgggtcagggggacaaggagaaagaggatcagttacagtgagcacaacacacagtgatgcctagacactgagtaaacatggaccaggcatgtttctcctatttcatgtctgaacaccagttgctgagcaaattggggtaggagggcagtttatagaagtgcaccatgggggttgaagattaagagcacctaggaactttcagaggacctgggtttgattcccagcacccaagtgacagcttacaactgtctgaaactccagttctaggggacatgaagccttcttctggccaccatgggcactaggcatgcaagtggtacacagacatgctgacaaaacactcatacagctaaaaacaaaaaataataagatttttaagtgaacctgttccagaaaataacgtgaacacagagagctagctacaagctctcagcatcagctactaggaacagtttctggctatgtgatttaaggtaaagaaagccaaggcaggctggtcatttctgccctgtagactacatattattattttcctgcatccagtctatgttcaggaatgtctaagttcaccatatctttgccctacttgaaccactggcctggcattcagatagctttcaagatagttaaggtgctggttggttttgttttaagcactctcctgaattatatttttgattctaattctgatttttacaagcaaaatagagtatatagttattatttaaattcttgcaaacaaagctagccatgttaacacaggcttgtcatcccagtactgggaaagtggaagcagagaataaggagctcaaagtcctcttcagctacatggtgagttcggagctacccttagcttttgagtgtctgtcttaatgaaaatgaaaataaagggcattcaaactgcacagatgcttgttttcctttgtatacagtaacatcaataaaaccattggaacttgcaatttttaacgaaccattttaacttaactcagtataccgaaaagaatggattacttctcattgggattgtgttactaacttgggggtgggaggagcctctggccagctgctgctgcctaccattctaagagagcatcttaatccataaatgcgaagtaaagcttatatggaatgcacgtcatttttgcatcatggtaaagtaaaacgaaacaaaacaaaacaaaaaaacagatgcaccattgtaagtttgacattgtctatataaagaaaacacacatacttgtaggtcataatttacagcatttattctcatgagcactctttcagtggtttgctgatttttgcggtctgtaatttcagtataagcacacatacacacacaatttttaacaaatataaaattatagcgtacattattgtcttgcaattgctttttacacctaaaaatgtgtcaaggtgtgctcttattttagcatatgggactccacatgattgtttttatctgagggatatttaggctatcatttgtatgatattcacactcttacattagattaaacaatgaatattcttgagcatatatcttggtatgctgtcatgaagatatctataaacatcttcctcgacttaggattgctagataaaatgatatatacattttttaatttgataaaatcttactcacttcttagtcccattaatggtatgctatatgagagtgtgcaatatttccttagtttacgatttgactggaatgaagacactaactttaatttacttatattataaaagtcccactttggatatctctcttctcttctaaattatagacttgtaagtcatagatgtggtttgggtgctaggaactaacacagaaacacaaactcaaaagggaaattttgaatgacattagtctttgctgatggcacatctcatttggtaccacaaggacaaaaaaaaaaaaaaaaaagaaaagaaaaaagaaaagaagagaaaaaaagaaaaaagaaaacaacgttcttacttatcccttaaatatactcataaattgccttatagtatgatacaaaggacctagaagatagagaaggaagcctggtttgtatgaccatgtatttctatgacgcaatgtgctggtgacttcaaagccctggaactccactgttcattcgatgaaatttcagatcataatgcttgctgaggtacactgttgtgggtattgtgagaatttagtggtgagatacaaagaaggtttgtaacctgagaaatatgatacacatcccaagtaaggatgtatccttaaaccagaggcacttgtatgcaagggagaagaagactgtgggagttagttagttagttagttgtttgaatggcattactagacttccatttgtcaagaacctaataggattttgccccttcccacacttagtttctgtaatcactggggagagaagaaatacacacatgaaatgttgaaataaccacgtgaagtgactgcataaatagctccgagttatagctgaggtatatgtgaggattagagtgaaatcaaataccttttaattacaatttaaatcaataccccattgaatcattaccaggaaaatcctgttatgcttccttttttttttaaaaagtattttagtttgaaagaacccaacataaatgcaatttacaaataagatacattaccattaagtaaatgacatttagatcagtattacttagattacttccaccattatgtgtaaaaaagaaaaaaatcaatgggatgtagttactgttttaacccaaaagttaattaaaaagatatctgcaaagtcattgtaagcagaaccattctgatttcaacctattaatcaagaatgggagagagagtctgcgttgcattagaaggtaaccaccgggatgggttttaaaggctatttttaaataccttgttttaaaacaaggcttaccttataaagccagtgcatattttcatagccattaataccatgcttatttttcattaagcatacactccagcatattagaaaatccaggaactttgtacttagatttaaatataaatccctgttctactactttcgacagtctttatacaatactgacatatgtgtaaatatgtaattttttattgaaggaaaatgttgcaaagtcatccataagacctgtttggatcatgtcgcttattgtgtctctatcatccttttccctattttgtctgaggttgatcattgttccctttctgttcctgatgttattcaaaatgaattcattctcacccccacctcgactttcccagctatctgagtgattatctcttgtgaatcaagagatcatttgtgtggctcttcgtcagaggatttggaaaaaggtgaaattcagtttaggtgttaaaatgcattgtgtggtaattgggaagaaatgaatgttggttcttatgcagtgttgagaaaattaaaggggcagcagaaagagtcactattcattttggctattcacttttacaaggatacacttatctttatttacaaaaagtttaaaagtagagaacaaaataacctataatcccaggacattaacctaaccattacaattttatgctccctcccttctgtgttgggaggcaatttttacatcattgtagttcaaacatacatatattgtgcagcctattgtttcattggagagatttgacataatttgtatgatctgccaaaattctagggagtatggatttgggaggaagtgatgcttttcaggggtagattttaaatggcttaggacacctgtaaatatttgaagcttctcataaagacaggataaatcagtaaaggttttagggaaaagacagcaaggggatttgtgtgaaatcaatgtactcaattggaagaataattattcctttttgcataatgccacctgttttgaaatgtatatttcatgtacagaagactgttttttatcctgcttaaattgctacctttcttaatttcaccgccacatactccccaccacacacaccctcgtacttgtctatgtaacctgctaggctgacaggtggtgtcccaaatccaaatttcctcaagaaagcctgctccagtagatgggttccctagcctgaaacgcatctcaaagcctagtgtttgtaacccagaaagatgcatgaaatgttccctctccactcctgtctggtgtctttctcaatggctccaccttcctctttagacaatcctgacagtgtagaagtttccatctcccttccctctcctctctccacccccttcactttctcccccctcctagggcgcttcctgcctggaaacaaaagattggtccccagtagcccactcagggcgattttacttttatgctcaccatctgattggcctaggtacggtgcagagcccaggtgacgtcatagcatagctagggagcggttgctgagcagaggggctctacagtaggcaggcagctgtggccgcaaactgtctggggtcttacgctgggggctgtagctttttctcctctgggagtaagtgcattgggtgaaagaagagccgtggggggagcgagccgggcccggggctgcggctgcggccgctgggctgcagctccccagcccaactgccagcgtgctccgaggtactggaaaggtcttggcagggtggctggacccttggcaggtaaatcccgcgacttctgtactgtaccgagctagctcgggggaggggagaatgccgggcagatgttctttcttgtgtccccctcctgctcttgctgtgtcccagctttgactcttctacgtggctccattgcccaagccctgggacctagcgcacagtgcttcatggggtttgctcaggcagatgagtgggtgtgtccgggctggtcctgaaggacctgggcttcttcccttagccaagcccagggttagcttactggggtttgggccgcctggggcaaaatccgccctgaaagctatgtcagactgtaagtctcctaccatcttcccctgaacccccccaccccgcctcagccatactgttgacagcagccctccagagaaggggaggggggtgtggccgcagtctggccaagtctgcatcagaacaacctgagtgaaacagaaaagtgccaaatttcttaaaagggagctttcctttctttaaaaaaaaatccccctccccttttctctttggggggatggtaatgacaagaggaccttttttcccccttttctttttcttcttctgcggggactgaatggattcaatatggcccttagaaaagcctggcatcttccccccccccccttggcccctgtctttatctggagagtgggggtcattgggtttgctgcttcctcccttcccattcctgtagctcccagaagacgctgccctcagtttgtgacctgctacgatgactgacatacttctgagtgaacagaacattttagattcaggctctagcaggctttgcttccctaggtggtggctgagggtagagtgtgggtgttgggggatatagatggttcttctaaggagataaccagaggctccattgggttgttttttgcctgtctgcttgtttgtttgttcccaccttccagagtccatttctagattcttggggtttctgggctgtgtgggctgtaaaagcagagggaagggtgcgtgccttggctttggaaagcctgatgggggtggttgcggtgctatttaaaaaaaaaaaaaagtggcttccaccggggaagcccttagccatgttagttttgctcccttccccaatggttttgcagactcaaatccaggccaactgtatggctgtctgaggtgttggaacagaaggaggtccattcctgttggtgacagcactgtggccctgttctaggatgagccaggtataaaaggtcagtgtggttttcactgggccatgtgtaaaattataattggtcaggatgtgtgatttggcacttgagcatccaatcacaggcacctttgagtaaaggggctcactgtggtaatggacgtaaatggatgattaataggctggaatctgggaagagagccaaatagtcctctttttttttttcctggatacaaatgtcatactcctctatgtccgtgcaagacacaacatgaaaagaatctagaaggtatgctgggttaaagctggctattggtaatccagaatccagagagacctcagtatgtaagaggcagattctttaaatctcccaacagacaagtacacattgtgatgagagtgcaagcaatggtccacaagacccccggaacataggagtgctgatcattcctacaggttgtgggcatttccgtttacaggtggaagtggtatacagagaagacatgtttgctgagggtttgggagagactgggtagtagatttatttgatagatgagaaaagtggaaaatgagagtaaagatggcaggggttgccattagagattctgctattataaagtcaagcctaagcacagggtcaaagagaatgactgatacaagagaaatcagatctagaaatcggagtgaataggttgaagttaatggagttggtagaagcagagctgtagtggagataaaaaggccagcatcatgccaggagctcaagagtcctatttcctctggtgaaatggtaatggaaaagttttgctagtcaagtcagcaatggttcaataaaggcttatacgggactttttgtaacccattttcaggaaccagtaacttcaggcaaaggaatgagaagaaatgtgatggggagcagtcttaaacaaacaaacacaaaaaaaaaccaatgctttcatagtgggtgacagagggcacggtgggtggggggaacaggagagactagtatctgagacaggagtctgactgttttgcatggctgagttaggtttaggacaaaaacagacaagaaagaacgaaagaaggaaggaaggaagaaaagaaagaaagagagagagaaacatggacagagagacagagatacaaagagacagaagaaatctttctcagggctccctggaccttatgtccaacaaggacagcagaaaaccttcaccctggaggataagtgctgctttctaggcatctgggactcagcttaagctttagccaagctccccacgagcccgcatccacattcacacctacacctgtcaagagctaggtggttcccttggcagggccagggtagagttccaggccaaatccacactaaatagctttgccagcagggggcagaaaagtaaccgtagcgacatagagagcccaagtcctccatttcaggtgtgaagccctagcctcagatcaactaacagccatacatttacaatctgatttagcaatgccagagaactaaatgaacctccaggtcaagtgttcccatttcttcccagaagtgtggtgcttcctgcagcactctgcagtgtaagaaggcacatgcttttacttgggattacttgagtcactaacaccagcagtctaaccgggagtttaattggaaatgttaatcaatgcaatagatccgtgtctgatttgcacatttggtcaattatctgcacgtttggacaatttgtgctgcacccaggggatgcaaccagggggtaaaacggtacagctacagctgggactgggggggtgggtgggtgaagcaatataggggacgtggaccttgaagactaagaagaaatgaacgatttgctggtggagagaagagtcatgtcaaatgtattttcacagagaggttggatcatggggcgaatggtccagaagcttacggggctgaggggaagacagggttttctggggtagaagacggttgatatagagaaaggatttttgtgtgtgtggggtgtgggggggggagctgggcaaaagctaggatagcctggaacttggaaacccagaaatcaggtgttcttggctgaatgtcctgtttccttgactttcaaaagatggaagttagatcaggtgttctctattctggcaggaacattttaggaagtggatccttttatacttggtacttaagacagcctttaaagtacagacctcctgcaacaaaagaaaatagcccttaatatctctttgcattttgtgtgttttccactttagggaaagccaatacaaaacagatacccacaaatttcatcttttagctgcatgatttcacttctatttcatgtgagtggagaacatgtggaaaaggagaagcccaattctgtatttgctgggcaacctataagccccagaaaagctctgtatgttactttgtatataaagacagatcagagagagcggcactgatccgcactactgttttaactccctaatgcaatctcaaaacagaagtggtttagaatgaagataaagataaagaaaaagaggggcttcttgggggagtccttttccctcctctctatctgagccttgtgaattctttggaattctgcaccctaagcagaccactatctctgacagcacaatatcgccccctagtgaccacactggaaacatttttctcagctcttgattgctatcccatgatctccatcaagggtgccagtattcttacattgctctcactcctggcaagcaaaggcacattccttctatcaagactgaaggagtaagtcagggatgtgcagcctcctttagagcattcttctccagtgtgagtgggtttaaagggaggggtaccactctcttctcccttgtatgttttttttttcttcttcttctttgggcctgaaaaagaaaccaggagtccagaaatatttagtgctacataagacacttgccaatgtttctggggaagaaagagtaattttcataactgcctttgatctgcatcccaaggtgatagttttagtcctcagacaggaattctggcaaaaagctaaaatacggcaaggaaagagaagttagatatgtataagatgtgttcatccatactcccagcttccaataagaggtatgagttacagacagaaggcaaggaagtagaattgaacagtataatgcagctatgcatcactcaccactctgtacagacatacaacgtggcatagactatatgtgctgcacactacaaattaaacacatggcatatacacatgcctgtaccatgcatggtagagatccaaacacatataccacattacagaaatacagtgcatatcggcaagataaacatatctgacatgatataaacgcagcattgtacatataatacaatgcagtttcagtataaacacaacatagtataggtatgacacatcgtatacacagacacatttaacagtgcaagaaatagcacaaatataccggacccagcttttgctaatatacaaaatactatgctatactcaaaagatactttcagtaaggaaggaatgtagatacctggttacctgccagttgcttctgcactggttcaagctacacaactggtgggttcaaagcaaactaccgagaaggtaccatttgatgctccaaatggggatatgtggggaaagtaaggtatatccaaggaaaacttagaaagatggagatttttggttagtacaggctgttgcacgcaccctcttcccagtgtctctggcattttgttctctccccccacaatcagttgctgcttccccaggaatttgcttcgacatcaggaatgggccacatctgaccgtcctcatgtcctgtcacttgtggcatcaggaatgggccacatctgacgtcctcatgtcctgtcacttgcggcatcaggaatgggccacatctgaccgtcctcatgtcctgtcacttgtggcatcaggaatgggccacatctgacgtcctcatgtcctgtcacttgcggcatcaggaatgggccacatctgaccgtcctcatgtcctgtcacttgtggcatcaggaatgggccacatctgaccgtcctcatgtcctgtcacttgtggcatcaggaatgggccacatctgacgtcctcatgtcctgtcacttgcggcagttctgacagttcttacctccctacgtcacctcaccttcctgcaaagaacgtgagctcatgcagagaaagaggaggtgactcattgctcagtgacgcagtgggaggtatttggaaagctaataaggaagcctatgggaaaatacacaggaatgctacagatgctaggggcagttgtgatctagacccagggtctggcattgttcttttatcataagagatgtagttggagatcatggggctttccttggctccccgagacttcaattttcctttctctttagctattttggttagaactctatattttcttgtcccctaatagctgggtgctagcctgggacatgctctgtttgaattagcaggcatgtgctgctctccttgcagggtaactatggttgcttgtgtatgggtgggaatgttagggattaggtaggggttgtagagctcagaggtctacaaaggggaaggtcatccccccccccccggggaggggaggaggatcaagtgatggtggaaaaagcagaaactagaggggttaaaaagagcctgtctctggcagaaggtttagcttcatggtaagagtgactgcctcagatggttctagattccagctccacaatgagataggggaagagcagagaaagagagagagagagagagagagagagagagagagagagagagagagagagcccatttccatcacaattagacacagaaacctctgtgaggcgaacaaggtacatcataccccaaataaccacaaatcatttgtatttgacaaaatttgtcacaagctgtggaaaacatttctttgaagataggccaaaagttgcaattacggtcagaggtttagaaccttcacagctgtgaggcagtaggaaacttggcgcgtccttgccagagagactctttctccagatacctcctgaaaggaagaggttggtggctgaaggggttggaatggaggtggggactcagaattgaggggtgaaaaactgtatagtagtggcaggttgctagacagtctcagtctatttacctctattgacagcttatgcactggactgcgccatctctgtctggtaagtgcaattttacccttaattctgaaagttgtggacatttttcacatgcatcttatttaacttagccctgcctaatatgtgtccaaaattacaagagaagcagatcttctatagttgataagaaataggcccagaatagtgaggctattaatctgtactctcaactcctaattcccagctcaatactctttccaaaatcttacggggcaatatgtttttatatatcttacctttctgactcacttgtcttcttaaatgattatctgaaataccctctctctccctccctctctctgtctctgtttctctgtctctctgtctctctctctgtctctgtttctctatctgtctgcctctctctctctctctctctctctctctctctctctgtgtgtgtgtgtgtgtgtgtgtgtgtgtgtacgcacgcaggaacctagcacatatgacggtaagatgagggagtagtggcagctgtagaaagggtttagtatttcccacaatgcttttctcagtaggctcctccaagaaagggcagctgagtctttgcatcatgtggtaactggtgtgcacagcaccgggtcagtcagagctcaaggcagcccagcccagtctcacaggccgcattcacctctgctgagatcctgcaatggtggctatgtgaggtgagcaatgaatttcagggcatggagattggggtatttgagatccaataaagcttgcgtacttatctgaactcagaccccacattaggcctcacagtatgacccttctttctggggtgttcagtctattatagctatcctttgtctcttggttcctccagccctaatatccgaatgacagccttaacctacattttgcggtgaggaggagaaacaacataacagtcattggcaagtcctttgcaaatgtcaagcacctgaaaatgctccccatcaaactgtcattttctttttctcctttctggacatctgagtggcatttcagccacatgtcagaaatccttcaatcagatcctgccccatcctccaatcagatcctgtagttccaactgccccataatcttaatttggtcttcctagtcaaatgtacccaacccactcttccttgcttctgggactaaaatttggcgcaaccctccttctcccttcccacctaaccaggcagcaaaggcagatgccctcccctagctctctagcatgcattgtctgtagcaggcattatctgtagcatgcattgctttcctctcatcatacatcattccttgaggagttcttggagtatttctctgaacagagaaactagattaccaagggcatgtctttagtcttacaggtctttactgtcccgtataagcagctttacacatggggcctgtctctctttctctgtgcatgcctgtcatctgcccttctctctgtctgccccacaggccatcacagtagcttcctctgttgccttcttcacctgctcttctatactataccctgcagcttagatggctagttaggatttgatgttcctgagtctctctgtgtctttgtcggctgcttaggtatctatcctgttgcccaagtcaacattcccacccccaaagaatttcaagaagacaaacaagccaagactatgtaagccatttctctttgactctgagaacaacctgggcctagaagatggtagaactatatcccagcagcacgagtttgtgtgatgcactctcatgaaaggaaagcaccagagtttcagccatggaattgaagatatggatgcattcgactttctagaaattcacctttctagaaacctatagaggtccaggatcctctatagactttgactgacagaaggtaactagaactggtaataataataagcgtgtctgagcatctcttctgcgatttctatgccagctacaataagaagttttatttactatctactgttgccaacactgagctaggcactttgcaaaggagttctttttttttttttctcaactagttcatgcttcttattctgaatttataagcattgtttgtcatctccattatagaggttgggaggagctcggcaagtctagaactagaacaacatgtctatctggggaggaaagacattttctggagaggttcctagccttcaatattattcagtacttactgagtcatgtcccttcccaggttccccctcacttatcattcttacctctctctcatatataagcatatttacaagcctattacacacagctgaatagatgtattcaaaaattcacatttttattatgatacaacacatacaccttaccccacttgaatgttcccacctactcatggttttatattcctcgatatgttcacacatttttatatctactcacattatacaggtaagtaatatgataatatatacccttactaacacacttatataaatcaaacactttgtgcccagatataccctgcctttccccttgcccaactcaaacttcttttcatagtcatagccatatacaatacaacagttttatattatctagcatgtttgcactgatatggtcattttttcctcacagtcacacacaactgcggtacacagaggtatacacacaccctcaccctatttgtatataaagagcatagcaatatagacagtatcacccactcaaccttttgtatacttttgaactattacactctcctgctctatcccactgacaggtctgctttcactgatatgcacatcatatttccagagactcacacttagacatggaggcagacattttgcccatattacactcaagaacttccttttcaccctggtatataatcaccccgttcaatactatgccttcagacacacaacctgaaatatagctatacattacatttttttctataaatacagtcatgttcacctggtgtcatcatttctccttttacaccatcacctatgtacagatatgtacaaagagatgcatattggcatgtacatattctccttcattactcatacaaaattataaatacagacacacttaatgcatagccatgtatttgcacgcatgcattttaaaatatgcactctcactttcagaactacacattacaaattacacatttccactcattcttttgaacacataactctcctgtatactcttacataacaatacctattcatgccattacatgttttcacacaaacactcttatacttaccacatactagtccttgcacacatttccactctcctattctcatatgggtgtaccctcacactgttacatatatcatatgagggtacatataatgacatgtacagtgctcatagttactagtatgcattttactggtatgttccacaatgcacgggtaatttatattgcactagtcagttcatacagatacatacatgtactgacacaagtagtcgctaacaccatacatgtcagttattgatatttacactcattcatttttcaccctaccacattcgcactaaaactctttggtagatacacttactcattttgacctatatgcctgagcagtcccatactctccagtaaagttctccacactcttagcttcttctatgggtacattgataatatatgtctccacactggcactgaacagcactccctctccactagaggcacagtaacccccatctatccacattgactcacaagtactgatagcaacccacccgcacattcaacttcagacatattgttctgaacatcttatgtgcattcacaaattgacattttcgtagttacacactttctcagtggtgtataggctaagagaacattaaccaatcccacacaacagtggtgagagtggtgagctttgcgtggtgtgattatttgtagaaaatcatgccgtaacttgttatctattttcctcagaagacggtaagggaaagatctatttccttaatgctgggccatgaataatagcacatttatgtttatgttttatgtttatgatataaaactgttgttggttatacacatggaaagggcagatctgcttcacttaggcacggcacatctacccacatatattaatactctgttaacctggaacacttcattctacagaggaatagaaggcaattctctctttgagaaacctgtacccacacttagatgtatgggtaccctgtgtaatcctctttcaattaacccctgtgcttaaagtgtatgctaaaaatacattttaatagcatccatctctgcttcattaaagagaggaagaaagggaaagaaaaggttaatgagatagttgaatgataacatacgtttctactgtgagtcggcccacacatatgtagaccccgctgaaatttcaacagctgttactaacgagtccccagaggaggtttctctgtaggcgtaggtaaagacaagctgatggaagttccttatactcgagacagattgcagatcttctaagagagtcgaaagaaacacaggcccagaaatgagccagaggaacatgaacttggatctagagatttacaaacacgagaaaagcccacagtaatctcatttgtgcatggcttcctccactggagtctttctgggcacaagtgagtgtcaaataatgtctgtaccaccacttggtatggtgcggagcacaagtggatgtgaagtaatatctatgtggtatatcttcactcaggagcatcaggcaaccccctgactccaccattaagttgaaaatgtcttggacagagtaagtcccatcatagtactttttaaaaattcctaatggcagaaggctaagcctagaagaactacttctgtgacccaattaaggagctaaaaggaaaagctaggcaggggcatgttgtcagtacagttctagtctctccctcttcctcatcttagaattctataggctccacatagagtcagagccagagaaagattaaaatatctgtgcctttgaattactttttttcatttgttcatgaaacagtcataaaaggtaacaatcttgaagcttggaatcaggggtatctttattgggtcatctagtggtcttcagtttgtaaaagacttaaagacccagaagtgatttaaggaaaccacttgccaacataaactttctcatagacatcttgctcaacactgggctgtgccatctttccagacaattgtgtaatcgagttctctgtcactgggcataaggtagagaaagagctacaggccttaatgagatcattgtacttaatcaagattaagttgccacctccttttgaagacagcatttgagaaacagcctggcaattttacatttgatagttcattggtgatacctaaaactcaccataggcaattggtacagtgtatgggaagaactgaagttttaagcctggatttgcatcaatttaacaacagttgcttagtaataatattgaatctccagaacttgtgttattttatacctttggagattctcattttttttaatgaaaaagccattaggaggataaacataggagtcagtaagaccagcatttgtatccttgtttagccactttctaaaagtgtaacctagtttgagtactaagccctcctaatagtgtctttatccgtaaaatggcttttttatgaggatgaaatgtgatagatactttaagaaaacagttcagtgtctgccaatagtaaacatacaagtgatagattctattattatctttccattgcctttgaaaggagccatcaaagggcgagaactcccagacagcagagaaatggtgtggagcaaaagccgttgcagccaaagcctgaggttcactcaacttacttgactcattttgaaccttttattttagcttagccaaaagccagctgtcagtgttatgcctactcaagggcacaattgaaaaacatgactaccctttagtttcctcaatccctgctccaccagggaatgtgtggcttgccacctcatcagtttcttgtccatgtgcatgtgctataatgctataagtgcttcctagaaatcgagccttcaatggcggcaccttcttcatttgctatgaatgaaagtaagggaggagagaatgtggaagaaacttctgccccctctaatactgaatgcctcttttgtagatagagcatttgctcttctccaaggttttgtctcaaataccacagtggaagcacagttcactttctttgaaactgtaaagacattcacgagcaagcaaagagtgatatatatatatatatgaacacagggggaaaaagtgtgctagccgtggtggcacacacctttaatcccagcactcaggaggcagaggcaagcagatttctgagttcgaggccagcctggtctacaaagtgagttccaggacagccagggctacacagagaaaccctgtctcaaaaaaccaaaaaaagaaaaagaaaaaaaagaacacagggacctgagacatagcttggtggtagggtgcttgcctagtatttatgaatccctgagctgatcccccagtgtgtgcaagagagaacacaaaattaaaaatcagaattaggtttcagagtcacagattaggagttgtcaagtcttcatcttgagtttactagatatatggctttggacaagtgacttaatgtttctgaatgtcaatgatttcttcatctttcagatagaaatattactaaaacttcataaatacaagttatataaacttatatatgagtaacttttaagcagagtacctaggatatgacaagatctccatgaataatggtaattgtatttatagctttgaattatgcagcagtaatgataaaacaccttattagtaggacatcttcgattattttgaatcactgtctacatgtagaatcctgtatccttacatgtttctgatgaggggtcccatctttcatataaagatgtagctacagaggaaccaagcaatgtatagagcactaccaatagtgtagactaaggggatctaggctagaatgaatatttgtgttttcacttgaaattttttatggtgctacagttaccaaatgggaactacttgaacagaaattattccttcccatggaaaatagatctaaaggtgagcaatggtttatctattatctgaaaccgactgtgtatattacacaatgcccagcataatacaagactgaaaccaatgtgacatcattatagtgttcttcagaacaggatagagtattaatagccacagtggtaacagccacagccaagaagaatgcttcttgatgtgtaatctgttgtgtcttccatgttgttccaataacaacagactgcagggtgttagaattctcaaaatatatctaagtgtatccagagacttgtagaagcagttggacattttgtttctaatgtgaaaataacaagaaagcaaactaggttgactttgcagaaagtctagggtataaaaaggaacatttctgacctatctgtaactttgcatcatgatcaatagattccgcttgaagcattctcatcttaatttctttgacctcatacaattcacctctctgacctttctctatgatcccaggctcctctccctgttacagatctgcaacattggtgttccccagaggtcttctcgtttctattgctctatgctctttctgggtagtttcttcatactgatggcctccaagataaaatcttgagcgcatatgtccagttgttcttggaataattccacaagccaaaccaatgtgtcataactatgcttccattggggtaattgttcaaatgttatctctactttttcttacttgtgatttcaagagcaagatgtttaaacatttaaacatttgtcttgcttccacatagacacttctagattcacttctactgagctttccagtgtgtcactgttttgggtcttctatagttgtgcatttgagatgcttgtgttttgtctttctagaattattgtctttctcagaagagtctgtatacaattttagatgcatttttaaaaactcattaaaagagatattctacgagcctaaaatgtgaggataatttcttattcttaagagtacatttatttctgatagctcagtggctgctatgcagaggaacactagtatgatcacatgtgttagcctcataccaaattcagtttagtttccaaaatagttgccatctctcctgaaatctcttgtctcctgccttcctttttctgtattacctgtgtttcctatcccttgatcatactgcattattctgtttttttattacctgaaaaaaagttttaaacagtcttatcttcaattgggaatcaccacattggcacctgggtattagttctaaaatacaacttaattgtgccattccactacttgaaatgtttttgtgcaggcagaaagaggccaaaccaaatagaaaagcataaaagacctttcttaatttgtctctacatactttgtttccccttcgttctcttatcacctctgggcattaacacatatagttctttgtgcctgaagcttgcctttcctatgatttggttattctccccaatttaatttaagtagacttcctctgtgaatcttctttcctcagtcccttccttcagtaacaacctgttttcatccttgaactcaacagtcatgactgtcctttcaaggatcttcaagggggcagtggtgttccttgttcatctagacagtattagttagccattttcttctgtccttctcaagtatcctctgtgtagcttggcatagaacagacgtggtggaaatgctcaatgaattaatagatttgtgaatatttaatgatttcctaagcattgtagaataatccagaactaagaaccgcaatcaatctgttttctctccacagagagaattcttttagagttataaaatgatctactaactgaacagctatctcccaatgaaagccacataaaatgacaccattgagtctttaaagataaaacaaaagaacaagaattacgtgttactaacattttcccagatgtctgctctgttcatttatatatgtatccagtactaaaatgttttgtgtaagaccctacagctttcttttttttgtagctgttttccagaaacagagtcctagctcttagactttctttttttctttctttctttctttctttctttttttttttttttgagacaggatttctctgtatagccctggctgttctggaagtcactctgtagaccaggctggcctcgaactcagaaatcttcctgcctctgcctcccacgtgctgggattaaaggcgtgtgccaccactgcctggctagactttcaaatactgctttttacacagttttgacatctcttctttctcatgcaccaccaatatcattcagctcagtagaaacaagtacccaaagcagagaaaaaataagctaatgtgctgagactactcatttgttagaatatgttattgaatcttttgacaacatgttgattcctatttttcaaaatctgctcagctcttacacactagtcagaccctattcattctcttgactactttgagaacattatcatttctggttctttcttccttctgaagcatcttttgtctatctggattgcaatcacaatattcattgtatacctactgtctaacttccatgaagacaagaactggtcatggcccatctctgtattctccctatatccgatgccatactatagacatcggaaggttggtggcatggatggaggtgtaaatgtgagctgtggttttaagaataacatctaataattatatgccattattttttgaaagttacatcattgtctatacatttggtatgtgtttaaagataaatatagccactgactgagcattctaaccttacttagagctatgtacttatttatttatgcatatcacctagcatgatacctgtgaaatacagaactgataaaggtttgttaaataaatgagagtgtaaacagatggggtgcttaggggcttttattagtaaagtcataatattcttttcctcaaagggttttgaagaaaagtctggttttgtcccaagttttcttgaaatgaattcaacatcaggttaacaaagataaagcactaactgatgtggtttcctcttaaaggcaatggtttaagattcttttgttcccctatatatatccttacaacttaagatccttattaagctatgaataaaaaggtataggcatttgtaggtgatctgctcaagatcttcagcctagctaatggatgtttgataatactttgacagatacaccatagagaagttgctagcatcactttcaaaggagctgggatattctaagatgaacatcatttcacatatctgtgtatattttatttattatgagaaaccagattccttctccttgtccatagtatatttgttatgatacatttgaagccatagtagatattcctgaggacgaatttggaaactccttactggttcatccttaggcctaactcactttctttgcaccaaactctgcttctgtttcatctgcagttttgctcagcaaaaaccatttgttttttcctttaagatgagtgttatggtccttccttccgtctcagctccacattttgtctctgtaactccctccatgagtattttgttccccattctaaggatgaacaaagtatccacactttggtcttccttcttcttgagtttcatgtgttttgcaaattgtatcttgagtattctaagtttctgggctaatatccactcatcagtgagtacatatcatgtgagttcttttgtgattgggttacctcactcaggatgatatcctccagatccatccatttgcctaggaatttcataaattcattgtttttaattgctgagtagtactccattgtgtaaatgtaccacattttctgtatccattcctctattgagggacttctggcagccacaaaacccagacaatattgcatatgtcagcaaaattttgctgacaggaacctgatacagctatctcttgtaaggctatgccagtgcctggcaaatacagaagtggatgctcacaatcatctattggatggaacactgggcccccaatggaggagctagagaaagtacccaaggagttgaaggggtctgcaaccttataggaggaacaaaaatataaactaaccagtacccccagacctcatgtttgtagttgcatatgtagcagaagatggcctagtcagtcattattgggaggagaggcccttggtcttgtgaagattatatgccccagtacagggccaggaagcaggagtgggtgggttggggagcaaggcagggggatggtataggggactttcaggatagcatttgaaatgtgaatgaagaaaatatctaataaaaaaagatgagtgttatggcctgttgacctcagtttgtagggggggcttggtggggccattttaaaagtacacagcagtctcctcttcatatatatgtgaacaccggtgaagcaaaactgactgtgtgccacagttaggatctgctcttacaggaaccaatcacaagtcatattttcagtaagaagacagtggcttctgtaaccaagtaatagggtgacaagaaacaagcagattaaagaggtcatttgatctgacaatttgtacgtcatgagaaggctatagagagcccaacattaccaattgtaaagttactgttcagatttgactttttgtttctagacaattactttgtgtggtttatgatcctgtttgtttgtttgtttgtttggttggttggttggttggttggttttggttttggtttttggtgtttggtttttcaagacagggtttctctgtgtaccctggctgtcctggtactcactttgtataccaggctggcctcaaactcagaaatctgcctgcctctgcctctcaaatgctgggattaaaagtgtgcgccaccacgcccagctttaagatctctttttaaatccgtggttttctttatttgtgttagatttgtatttttgagacagggtctcatgtaatgtttgttgactggtctcgaactcttgttaatcctgattttcaaatgctggatttacatgagtgcaccactatgccaagcttgttcagttctattttttttcaaagtaaaacacttgtcattggtggtggtagttggtggtgggggtggtagaagataacaatgatggggaatttttaaccaggtctgtgaccaagtagatgtttatatttgactatttttgaagagggatagatggcttttgtcaacttccattcttcctccagtattttaggaaaacttttttcttaatttctcagtttagatttattttatccatatttgtgttttcctgactgatctccttgaactggacttatggctggttgtgaaacaccatgtaagtactgggcactgaactgcagtcctctacaagaacaagtatgcttaactactgaaccatctttccagccgcaacctttttaaaagaaaataaataaataaaaaagcaaacaaaaaacaataaatactattccacatttcttgatttctttcaaataagattttgaaacccatgctcagccttttaaaattgtggatattgaaactttgattaaaaggcaaaactagagtaaagttgctagattttgttagctcaagctgcttaactgccagatctgataggaaatcacttttggctgaaatataaactgtgccaagttgatgtaagttcttggtttaggaagaagactaggtctcagttgccttcttctgacatgcatgggcatttaccttacagagcatcattgtgggtgcagggaaagtaggtgacacaacaaggctctaagctaatgagctatgagtcacaggttgcagagcagcattcaggcatctcagtgccaatgcaaaaagccctaggaaatgcagcaattgaaattctgagcttacatttaaggaaatgtgttgatatttcactgcggtggataattaaaatctatgcatagtaagagggagcagctagaatgctggagacccaagactttggctcaccacaccctgctccctagggctattagtctgcatttaatttgttccatccgaatgtttccaaggatattacattttctatttcagaacccggaaatgttttattactggattctgctttccttttattttccccacctattcctttgaggtaacttttagtgttaattatttctggtcttccatgcttaaaaacatctctgcccttgtactttaggtgtcttattctatcttaggtatgctagtactggcaacaaaaaactgaagcctttaatgatgcattagtctataaatataaatacacatcagacagtcattagcaatttcttggcattagctcacacaacatatacaataaataataaaaagtattgtgcctcatatatttagagccttaagaagtcatttgaaagagaactatttgtcccttgtaatacacgtagaatatgaggtccagatgctgggcctctacctattgacttccttttttttttttttttttttttttaacagcctgacattgaaatctgtaactataatctgctgatttcttggactcaatgccaggctcctgctggatacaatggaagcctctcataagaatgttagcagaggacaggactactacacagctgacctcatttgcgtgtgtgaatgacagagaacatgactgttttctgtgtgagtgcgcttgtatgtgtgtcatcagtgagctatctcttgcataatctaagattgaaactagagggctgtagaaagagctagcgcctcccttgcttgtccagctgcttttgcaaacctcctgcctaacaagtaggtcagctcctcctgatcaaatgatattacaaatggcttccctccattatccactgtaatggtatctccctggcgaggctctctgaaacagcacacccctgtctccgatagcagagttctctttgtgagtgctcccagaagaggcaagctccaaaacaaggccgtctaagaactggtacaattggtcaacaaaaacttttggagttctatcaataaacgaatagccttgggtctttggatgggaaaagcaaatgaactcagtaagtaccagcctgaagtgagttgatacgaaaaagctacacttattctgttagtttcaagaggttaaaaatgtgtatatgaaaaacatgtgcatctttctgtttacttggatatatattgtgttgtagtgtcttgttgagagggaaatgacaagagttgaggagtttatagtatcctagacttggtgactttgctacttaacctatactcttcatggaggataaagagatggtactgacttctttgctgtgttgatgtgagacacgaaccagagtagaacatggaagttatttttagaaattactatatatatatatatatatatatatatatatatatatatagagagagagagagagagagagagatgttgttaaccagatgctggctgcctttgaaatggtgcctatttgctttgcagttaaagtactgctagtatttgtgtatttgcaagcatgtctttcttagctcagacttggtctaagtagcaatgtaggcttatgtaacattcagagctgaaactaatgcctagactatatagtattccatttgattgtcttaaatgcaatgcttgttgggaacaataaactgtaccagccagtatgatagtatgtacttataatgttacccttatggctccttgcagtttgagacaagatgacagaactcctaagttgggtccacacagctgcctgtggttaatggatgacttctcccttgttcacctagtctgagagtagcagtgtggatgtagaatatcttagagactcagatgcagctcgttatctttttcataaaataccttcactgacataacatattgtaggaattaatgtctgaaacatgtctagaaatgttcagataacagttattagagaagtggaaagtcgtgtgtaatacttttttcatatatattgtagtcttatgaaaggctgcataagttttccttttctttactttctgtgtctctgtctctttccccctttttgttctttctttggtggttgggaggaatgaaacaatttacaaattatctactagattttttcatgttgtcattcatgaatgtttgaactaggcaagttcatcttcaaataatgcatgcaaaatagagtggaattagcctaggctaattaccaagacacagcttgtttcccactgatgtctatgcctaacacttatatagccaccttgaaaatgtgtgtttaggatataggggaatgtaggaaaaaagccaacaaatataattcttgaatcctctttccttccaccaacgtataattcagtctatacatcattccagttaagatagcaatttcatctttatatactaaaaattgattttgtattgatataattctctgagatgtataatgactttaaatctatgcttattcaatactttgacgtctaaaggctgtcattaagttttactccttcatgtacagcactaattctttttatgcagaacctccacaatttctcctccaaagaatttctgtaacacactcatcttttaacagaactctgttacaagcatactatgcttctgcaatcctaaaatccatctttttcatgtgtccttgtgttgaatgattgttatgtcattacagttccttgaacattctattccattccattccagtttgttcctgtctagtctagtctagactagtctagtctggtctagtctagtgtattctatatctatgtgccagacacattacagtttaccctggacatttcctttaggctctaggacatttccatcctggccttatgttgtattgcctagtttcatatacaaaggatattaatgttggtgagatcaccaatgtcagttaataggcttatgttgctgctggttttgtgctgtgtgtgtgtgtgtgaggttctttttattatggctgtacatttgctaggctcagctttttgttgaaaggcagacaacatgcttgttttattgcaaaaagtatgcaaataaataattacataaaatttaaaagtacacaaatgcttatttctatgtatggctctcgtggtacttgtttaaaatacttatttcatttgcttatggcttaataaatggtctggtaagtggtggtaaaaccagagtttctgacttctcatcattcatatacatggcatatagtacctgtaataaatgggtatagttgacattttggctgcatcctattcaacatatatattgtagtatgggttttgaccatttcgatagtctatagttgattagttttctttcccattaacttttagaaacatgtagattgctgactttcttttttaacctcctgagaatttagtctggtagtgcatagcatgagaatgcatgttggcaaagtgagagagtagcaacagtagttgaacatttcttttttttctttttttcttagatattttcttcatttacatttcaaatgctatcccaaaagtcccctataccctccccccaccctgctcccctacccacccactcccagttcttggccctggctttcctctgtactggggcatataaagttttcaataccaaggggcctctcttcccaatgatggctgactaggccatcttctgctacatatgcagctagagacacgagttcttgggggtactaattagttcatattgttgagttgaacatttctaatcattgcatctatagtttccctgtaccataacagctagttttaagatgcaagtcagtaagggactgtgggtattcatacagtgaccatgcatacatgctctcacacttgtagatagactgagaagagagagagaaagacatgaaaaataggcatagcatatcatagtgattttaaaatagactgtttagtatccttggtcatagtgaaattaaaatactttttaaaaaatagtagattcatttcaattgaaattacagaaaatatgtcaacactaactcccaagggatggctcaaaaatacatagcatccacaaaacccattagaattctttgtgaagaaatatagtagctttataatcaggttacaaaaagatataaattgaggctgcttgtacactagtgttaactattttttcacaatgctaagggccagtatttgaaagggaaacacatgtcctctggctagatctaaagtgccactcaaaagtttctgttgcagaagtgaaaaacagcagttttttgattgggctcctagagaataatagtgcttttgtattatacttgaaatggaacctacagccatcccaaacaaaatagtctcttttaagatcttggaaataatgacatcatatgcagattgaggcagtgatccattaatagtgctctgtagaaagttgtctcggaagaggacctgacacagtaaattggtattctttacaaacataacataataggattctctctttcaacatttctggaagagtacaagatacttcccacttggggaaaaaatactttaacaccaaggcttccttgtgaatacattccctttctccactgttttcaaaagcatatattgaaccacttgctttaaaggtgggttaaccatgtcaagaaggtaatttttgtttgtacttcagaaaccttgacaaagaactaaaatagtattaagataatttaaacagaataaaatctgtaccatctactcaaacagagagtatttaggtcatttaggtcatctcccattggagaattggacgtgcattctttagtctcagcttcatctctgtaaaggttgatcccaagccttcagatgacctcctgatgagacaaatgaagccaaaacaattgcagtttgttgagaagtaaaaagccttcgatataagctcagttctctgcaaagttcctgggatatcataccatgaatatggttctgtgtgtctatatatgtatgtatgtatgtatgtatgtatgtatgtatgtacatatgtatctatctatctatctatctatctatctatctatctatctatctatctatcatctattcattgtatatgtatttttgaaaatttgagttgtaggttgttagtacaaaacagaagcctttaggttcaattttctatctcaagtaatcctcaaatcttcaaactaaaacatactttgtattatagcatcaaggccatcaggtagccagaaaaggaggagcacataaacatgctgcctttttagaaagtataattagggatgtgtaactaggtgtggaagcctcacctatcaatgaagaacaaaggagcacagtatgttaagttacgtagttgccctagaacccttgttgtcttgcctggttgtgcaagatcaggtttattctaaagagggtatgattgtctctttgacttctgtcatatcgagttgaataatacaccatcagaaaatatgtatcatctgcagcatggtagctctttatctatgtaggacacaaccttccagaaatctgtctcttggtatttctacttaaatactcaggtcctgcccagtaactttcacacttaggttttttttttaaatcattttttattagattttttaaattcagggttcaaatgttatcccctttcccagtttcccctccaaaaacccctctcccctctccccttcccctgctcaccaacccacccactcccattcctagtcctggcattcccctatactggggcatagagccttcacaggacctagggcctctccttgcagtgatgactgactaggccatcctcagatacatataccgctagagccacatgtcccaccatgtgttttctttgattggtggtttagttccaaggagctctgcgggtactggttagttcatattgatgttcctcctatggggcgtcagaccccttcagctccttgggtatttctctagatccttcattggggacattgtactctgtccaacggatgactgtgagcatccacttctgtatttgccaggcactggcaaaggtcctcagtagacagttatatcaggctcctgtcagcaaactcttgttggcatctgccatagtgtctgggtttggtggttgtttatgggatggatccccaagttgggcagtctgtgtatgggcgttccttcagattctgctctgaatttgtttctgtaactccttccatgtgtattttgttcccccttctaagaaggattctgagcacctgggctaatatccacttatcagtgagtacatataatgtgtgttcttttgtgattgggttacctcactcaagatgatattctccagatccatccatttgtctaagaatttcataaatccattgtttttaatagctgagtggtactccattgtgtaaatgtaccacattttctgtatccattcctctattgagggacatctgggttctttccagcttctggctattatagataaggctgctatgaacatagtggagcatgtgtccttattaccagttggaacttcttctgggtatatgcccaggagtggtattgctggatcttctggtagtactatgtccaattttctgaggaactgccagactgatttcctgaatggttgtacaagcttgcaatcccaccagcaatagaggagtgttcccctttctccacatcctcggcagcatctgctgtcacctgagtttttgatcttagccattctgactgatgtgagctggagtctcagggttcttttgagttgtatttcccttataaaactagatgctgtatagcggagattattgtaataataagttaacatttggacagcatttttctagcccaaaacaatcagtcacagaccaatttattcccagtggctacatgaaaactgtgagctgggccagtaaaataggataccacagatgaaatcagtctggagaatagtatatttggaaagatcaaaggtcaaaatgcaaaagaaactgtagttcattagccctgctttcacatgtaccattaccatgtggtacttgctgtattagcatatactccacattgtttattcattgtaccttatgctctaatgctacagtttcctctccaatttctcctcccagccccacccacactttccctctctccttccccatctattcctcctccctttctcttcagaaaagggcaggcctcccatggttatcaaatagccacacccaacatccttaacttgccagtagtcctttaggaaggtagtggggcatcatggactgtatatatcgattacatttagaacatagggaagtaatttaaaattttactaccatatattaattatatgaaataatgagattcattatgctatgtgatagatgtacataatatacttggatcatatttatctctttcttatcttccttcatcctttttttctggtcctcgttcttgtactaaactctcctttctacttatttaacctgtattctgcatgtgagaggaaattataatatttgtcttttagagtctgattaatttattttgctgctttccaggtgcacttatttttctacaaacgatttcataaaatatagtaaaaatttaaattttcctcatatgatatagctaataggtaattattgaattattaatcactaaaggaattatggcagactcttccctccctccgtccctccctccctcctttctttctttctttctttctttctttctttctttctttctttctttctttctccctttccccctttccccatttccctatttccctctttctctctttctttctttctttctttctttctttctttctttctttctttctttctttctttctttctttgtgacagagttcctctgcatacccttggccatcctggaacctgctttggagactaggctggccttgaattcaagagatccacctgtctctgcctctccagtgctgggattaaagtcaagtactaccaccacctagcagaagaccatttcttattccagcagttatttttactgctgtacttaggttcatttacagtaaatgtccttttataaagtgccatgataacttgtatttggataattaacatattgctgttagtactaagtaatacttgataaatctactgagattccattatagctaggtttgaattgatttatatgaaaaccacgaattcattcaaaagacacttttagaacctcacttgtgcctgtgaaagtcaactcttttaagaggaggacacactttttccagttcatcctctgagttggatgaaacaggaatatcccccaattttgacacaagaacctaagttacagagaaattcagaataattaataaattcttaaaacctaggctagactgttcaatcaaggtgccttttggggacatgaactatgacagagagtaaaattatgatatccttcggtgtgctagagctccacctttggccataatgtcattcagcccacctcttttagttgtttgtttggggaaagatggacatcgtctgccaaggcagtttaccccacctttcttgaaactggtgtgtgtataaaaagccttcatgattttgtaatgtaaaaacagcagaaatcacttcacaaatcaggtacacagaagtaaggaggagacatcaaagcatgccagtgttaaaacagctaagaaattgtagctgagggccactaacaatcaacatctaagcttgaatcaactcaaagttgtaaaaagtttatgccaatggctggactgaaaaaaaaagtaattggaaaaaaggaaaatgaaaaaaaaaagcttgtgtcacttgaccattttgatcatcagcataggattttaagggactgtgaattgctcactcagagactgtgcatggacagcagaaagtagagttccactgtgggaatatcaagggagcttacacattcacatacgtatattgaaagtcattaatgtcttcgtttacttgaattttggtaaattgtcttattagcctttagagaggctttctctttgcttggtaaatttgagtgaatacatgagaggggaagactgtgtctgagatgatagactcctggtgtgtaccagactggcattagacatgtcctcccttacctcctgtttatcgctgctttctccataggagctgtgaaatcagctgcaactgaaaatgtctgacagcttggataacgaagaaaaacccccagctcccccactgaggatgaacagtaacaaccgagactcttcagcactcaaccacagctccaaaccactgcccatggccccggaagagaagaataagaaagccaggcttcgctctatcttcccaggaggaggggataaaagtaaagtatcaggggccgggagttcaaagggggacagtttattctttgattagcactttcttgctttcatagtctattctggagcccgggatgctccaggcttgcttgacctttcaccttgagatgttgccatttgttagaggatcatgtgtgattgacttcctgtgtggtaacagaaaatacacatgctgtgttctcctctcacataaaccgaattggtagatttaagttaagggaaagcacacttggctgagtgtatagacaccagctgactttctgaaaacttaaggtagaatttaaagcaagttattccgaactctaagttgaccatctgtgatagttgagtaaacgtttaagtagattgacttttgtacatcttcttggtaactgaagattctgagttaagtatatgggaatacgtgcaagttgcctacaatgttttctgtatgaatcacaaggtaggaaggaaaacttggctttctctattcctcaatcagttgtcacctacttaatcagttccatgttcatgaaagacacaatatattatcatttaccctttacacatattgtgtaataatatattgtgtatcatttacatggtatattattatgtacctataatacaacttgtttcttaactaatgtatgctactactttatgacacttacttctgtgattttattttagtaagtagcttataaggttgtattaactgccataaagctctaacatggcttctgtagatgtaactattgcacaggatgagaatacagagagcataaggttgcttcatcattgaaattggccaaaggggaaagaaaggtaatatctttgtgggggggaaaagtcattatttatcggtgtctgcaaggtaaaataagtagtttggtggtatttatacagtgttaatggatttataatttgtatcataggaagagctgaaattcttgttagtaactgtttcttgtatgtttttgttttcccttcatggcctaaggattgaagagaagtacaaggatgacttacctcccacacaagggatctgtgaccttataggggggccatgcttgccaatacttaagtagatcttaaaaactattttctgaacataatgggtggattgaaaactgaaagtcactatctagagactgagtcatgtatagtaatcatgccaaagaaacaatccctatactacatctgctacattggcagacaaaggacgaataatggtctgctctacacaaatcgttggtgctactgaaagtgcatacttttggtgtcttttttgaagagcaggagtttaggaaagtgaaggaagttgacatttctgttttgtgtcaataataaactactgctattctccagactagtatccccagatcttctcagggaaaaaaaatatctgagacaatttttttcttgaactgtcatgcaaacagaggagcctggacgacttcatctctcattctggaatggcctgagcagtgccttcttagagaaattcaaggctagttgaaggaaaagaaccttgaattcaaaagccatgtagattcctaccatccatttggtactacatgtatttgccaatatttacatgttctaagataaacactatacttaataccagctacactatgacttttagtttctatagcaatgaatgaccaagccattcaggaaaacatacgttatttagtagttaaaaaaatctcacaaaggttctgaagggactaatgtgagggattcttacaccattataatggatccttaataaaagaagcattagctagtttggcaaagcttggcattatattagtgcaacccagaagatttagcaaaagatagtgagacatctttcaggatctctgcctgaaggcagtgaaattctggatcaagtagaacctataagtgatgaaattgttgtgtaactaaatttgactatgattcacgctaatataggatagggtatttaataggatgctcttcagagaggttcttctatgaagacgtgattatcctaagagacaataaagataattaggaggttttgagactggaagataaagttagaagaaaggggagctttattattattattattgttgttgttgttgttgttgttttagaaaaagaggaaaatattccaaggaaactaaagaatactgggattttttcatatcatatcttacctgttcaaaagtcatcaactacaatttactatattactggacagctgacaagctaccttcagagaaagcttggatgatttgattgcacttacaaagtgctatagtagtgtttttttctttttaaagactgtaatgagaaaaagtcaacgtcaaaaagatcactaaggtagtggagtttaaatgctgttactggatagctgttaagttgccttcacagcatgaatgagttcattgaacttaatacaaaggtggttacatttcttccaaaaggccataagccacatgtcttcttcacaagggggtaaagtcattaaataacgctgtttaatattcatcttcttgatacatcttcaagatgggacatcaatgattctgagtacatttttatacatgatgtgaacgaacagtaccccaccgtacatcgcttcacaatcctcttcatttccaatcccataaagagtaatccctatattcttatcatccctggaaatcatctcaggatcgaaacaaagcaatgatgagtctttcattattgctattttaaacgatgaaaactcttcttgttctttttatttagtgctttattattattattatagcatataaagatatttgacaagttcacttgtgacttcatatctaatgtccatgcttttctctcctatctccaaaatttccccagttaccgtttgctagcttcaggtttttctagaaacctgaggaccctcatgggtgaagagagaatgtttctctatccatgttttttgatggcagtttcaatagcatcacagtttttaattaataataatttaagaaagcattgaacttgggttctgcaggtatttttctggcaagaatgattgtaactgttgattagttgtgtagcttctatgcacctgaatttttatcacctgataaatgaggatggtagggtttaccatgccttaccaaatcttcatgaatacataaggtagttgtaattgcctgagtgatacaaaactgactacagctaggtaattatgaggtaatattattatgtttgtggcatttgacagcttccacaaccaataaactaggttgctgaacttaaaccttttaaaagtaccttttgccatgactataatttatatctcaattatagaacactttaaaaagaaaagaaaattttcttgtgcatatataagccaaaggaaaatgattcgattgttttcctcatagaccctcttttgctcatcatatcattcatgatattattcatcaatgtcaacttgtaaaataaatttaagcacctagaaaataaaaatcactcataatcataaatcccagaaattgtgctaacatgttggtggatttctttctagattcttcatgtaagagtgtgtgttacttgtttttatctttgtatatttaatataataatgtatatatacagctttatattctgctgttctatttaccattttctctagaatatttgcctccatttgaaagcctataaatgtaatttttaatggtatatatgtgaacatatggtggcatcatgtttaaatttagccactttccttttttgatttttggatacctagggacttttcctaatatttttccattatatataacatatacttcattacttaattgaaaatagttcatttggttgccacactgggaaatctgaaaatttctgtttgtattggagagcatctataggttagtttgttgttgttgttttttttttttttaagaagtctctttaatagctacatttcattgaccaaatggaacaggagaaaggtaaaacaaaatatggagtaggtttcatttggagattgaggatctgtcattgttggagacagttcaacgagctgagtctttttttttttttttgatactgtactaaacaaaatttgaaggatttatacctagaaatgaatatagtaaataagtggtttgattttactgtgaaatgtgggtcaatttatgtttctcttttgtggactactagaaagcttggagccaaatgtgtggttcatgcatagccattacaatgacatttcttggtttgcatgcactttggcccacctgcgttcagcttccttttacgttcttaacttcatttttgttttttttttccctttacatccttatttattttgaatatatgggctcctgttgcattttgtgtattcttgtgtgtcagctgccatccagtttggaatcaggtggtgaataagtacaaggatgaataaataagctcattaataaatatataactataaataaaccagtacggaaaaagcaatgaggcaaataaatgcaacaaggatcctgaaaatgaaacagtgcacccaaggcaatcagtgctagcgagttgaagctggaagaacatatgagaaagaagcaggcaaggttacactccaaagtagcctcttcttcatggcatccgtttctcatgtacttgtgtattttatgtcttgtactgctcttgagccagcagcacaatgcagtctttagtctctctgtctttagagaacacatttaatatgtactttttttcgtgagggaaatctggagagatctttggcttagtgaccggagaattatataaaggcccctttgcttggtggtataggaggaaatagtgggataaaaatcaaattatggtatatagaaaatgatcactcattcctgactactacctgggtgccactctgtgctgcagggaccacacatgaacattccttgttctagtccatttttgcagccatgagagtataagcttaaagcatttaaatatatagtctagggctacataagaaagactggaagctagaaacatttatgaatgtctacatgcattaaaggggctgactatattcatcatcatgggcctgccatttccttgtgctcatcttatcatttccctgaaacagtaagtagcatgtgaattaagcttgtagctattcttgcagattcaggtaccactttgaggtttcatctgtacatactgtcttaatagccattaaagaccaggcagaaggacattagctgaatattttccccaaggaaatgaactatacataaagaaaattcaaataggttaattacatcctatgaattactttagcaacttactgaaggaaggagaatagattttacatactgtaatttccgacctacatactgatgttaaagtcatgctcctcaatcctcctatgaggtagggctttccttgaagctgctttatacaagaagccatgtcagaaaacattaaatgactcccacaaagctgatccaccgcttaaaacttgacagacctggctcaagccttagttcagtgacttcttgtccaaacaaatgaaagcagttgagcttgttttgaaaatatgttttaaccagtggctatgtatatgtggaatttttttaagcaaagaaatggagaaacagatgccttagcaacaatgacctcggtcaattttttttttccttacaggcttttcttgatcttagcccaccttgctagcagtacgcaactagattttttttttttttggatgcacaattttctgcgattactggattcttttgaagtcttttaaactatttcctataacaattgtaatattgatgcttataaaattgtaacattggatacgtatattaagatagaatagaaggaacgtccattgttccttcccgtgcattcccaagccagccctgttgcttgcttgacaggaagagccttgcttttctattcagattcagtgtgcattttgcccaagatgctaggtttaaacaagaaagagttatgtggaaactttttaatttttattactttttttttacctgcacttcaatgtcaatttctttaaacatttggagccaacattgaaagtggtgttttcgggctggacctaggcttccctgctcatatgtagcagatgtgcagcttggtcttcatgtgggtcctgaacaactggagcaggggctatcccaaaagctgttgcctgtctgtgggctatgttcttctagctgggctgtcttatctggcttcaatgggagaggaagtgcctagactcacagagacttgatgtgccagggtggagggatactcaggggagccccacctgcaaggcaaaggattatgagagtgggtgtctgaaatggcagtgagtggaatgtaaggtgaataagttaaaaattttaaattaaaaaaaaaacttagcagaggagatggttcaacttgctcccatgcccagtgacttgaggtccatctgagagacattcatggttgtccatgatcagcttgtcctctgatcaccacatgccagttaatctatacatataccaacccataaccacacatctcacacacagatacacagacacagacacacataaatgaatgcacttgcatgtgcatgcacacacacacacacacactttaaaaacattgaaaaaatagtcatttgtaaaaaaaaaaccaacagattgcaaacatttgctctttgtaatatttgatattttgtcttatcactacaaccaacatctgttggttaaaaccattttttcttcccaccaaaaacaaagtaagtctgtgggcccattaataagatcatgtgaaattatttgcaataatctacacctcagtaaaagtgcagcccaaaatgtatatatcacagcaaatgatgtttttcaaaataatatttttgcttttattaaagtttgtgaaaccaataccaatgataagaaaaaatctataattaaatgttacctcagaagaaaaaaaagtggtgttttatgcctgattttccaatgccattaccacgaagtatttcaaatagtctcaattgtaaaataatgaatttcaaggctcccaaatgtgaaaactagacaattacttttcctgctgtgtaaggaaagatttacatgtcagaaagaaagatttacatgtcataaattcaggaggtaagaaaattctgtgggactcctccaaataagatatttctatgtagagccagagcattagggactagagacttggcagaaatcaggacccctgggattattgccctaggaagaactattctgagatacttatacttaatcaagtataaaaagagcttcagaaggctccccacttaagcctgacaacagagtgcacaccatgctccatgactgtgaatcagaagatgagacaaaatgatagcaaaatgaagtaagagagcagcaactccatatttaatgcactgtcttagtagttaattacatagtaaagtattttaaatctcacaaacccacaaaggcaatattttatagacagtccacatgtctcacctagataaagaaggagcatctcatgaagaattgcctgttaggaaaaatgaatgttgtcatccagagaatgtggataacactttaaaactgctcttccagaggacccaagttcaattcccagcacccatatggccatgactttaatcacaaatgtaatttattgatgtgtcaattcagaaggaagacagtctggcagcatgtctgaactgcttgtgtctttcacccagacaatagttgtgctggcttttgatatgtccagtgcagtgatgaacgttgtaagagagcaagctccttatccttgggaagacactgatatacctgtctcttgtgagactaggctggggcctagcaaacacagaagtggatgttcacagtcagctattggatggatcacagggctcccaatggaggaactagagaaagtacccaaggagctaaagggatctgcaaccctttaggtggaacaacattatgaactaaccagtaccccggagttcttgactctagctgcttttgtatcaaaagatggcctagtcggccatcactggaaagagaggcccattggacacgcaaactttatatgccccagtacaggggaacgccagggccaaaaaaaatgggaatgtgtgggtagggaagtggggggggaggttgtgggggacttttgggatagcattggaaatgtaattgaggaaaatacgtaataaaaatattaaaaaaacaatacatgcatgtgtgcacatacatgcccaagcacatgtgtacacaaagggagagggagacagggggaagcagagagagagagagagagagagagagagagagagagagagagagagagagagagagaataggaaacacccagtaattggccttcgatgtgaaagatgtcgtaataggtaggtcctttcatttctccgttgcatacccaccattaattctcagtctgagtgaagcctgatactaccctaacagcaccacagcactaccttgtcttcagctccattatctcatccacttgctcacaatcctttcccacacattctttactgttatctctagtttcatctttctgtccttcttgattttcaagactatttgccatgtgtttactgttgtcttctcatttattatgtttgctatatgctttcttctgaccttttacttctactgtcttgcctacttccttatagactttatttacctggtacttgtggcttatttctagtcatacctctacttcactcagactgtccactaaagatagatttattctagaacatttattctctattattccaatttaattctttgttttctctagtctaataatattgttccattttattaagctcattctcccagttaatttgcaactttaaagtattgtttaattcctaatgaatcacctagcataatctgtcactacaatgaaccttaattaaatacttgcttcctaactgaaccatgacttattcgaagaaaatgaaaggaatctgattttaatcccatatacgaatgcttacatcagagaactaaccaatctgagtggaaaatatttctgtatttaaaatatgcttaatattatgtttttctgcattaatgcagctttaactgtttaaattttgctacatgtactcgaacatattgcataatttccactgtcttaaaaatgatttctgtatgtaagcttttaaggcaaatgtctgtagaaaggcttttctatgtctgtcttctgccactcctattgcttgcctgcatgctcagtattcaaggagatagaaagtagccaggcggtggtggtgcatgcctttaatcccagcacttgggaggcagaggcaggcggatttctgagttcgaggccagcctggtctacaaagtgagattcaggacagccagggctgtacagagaaaccctgtctcaaaaaaccaaaactaaagccaaaaaccaaaaccaaaaccaaccaaacaaacaaaaaacaacaaaaaggagctagaaagtaattctggaaatatcttaataacagataataaaaagggaaaacaaattttaaaaaactctggaattttagggaagatagcaattagacctccgagaacaagtaagactcacctgacagttttctaaaacaaattacagaatggaaacagcattattgagggatttcacctgggggagactggttgtttctctgtcccttaaattccacccaactgtgttgccaatatatattttgacacaagtgacacctcacaagaaatgagactgagtgaatgtagaatcattccctccaattgggttacatcaatgacaccatcaacaaattcctatacaaaaaataactttatagtgtgaccttcattttcttggccttcttggtggacctgggtcataatttacttgttaataacatatagaaaataataatggtctgtcttcatagggtcatttcatgcaataaaggcattaatctatctattcatttgttcattcatttgagctgttatgaaatattgagtcttgtagtgtttggagtcaaagaagttataaattaccatccctgcctttaagaaagtgatggcttggtaagaggcaagttggctaatgattagaatttgctatggtagagagaaacagaagaggagtagaaagagaaattggttggagactggagattaaagcagttagagaaggcttcctgaatgagatgaccactaactgaggttagccttaagccaaaaagtatctagaaatatataaaaagtatatctatccatccatgtaaagagtaagtagattttctagtacaaggagcagcattgtaaaggcagtaggcatgaaacactgcttcttgacatttcatggatataaccacaagaatttcagattaactagtataaaggatgggagaggaggtggtggcatgatgaagcattggaggaacaatgcatatcagaaatgactaacttagggaccagtgccactagaaatagcctaggaaatgcagatacagtatttagaaaggaggattgctaaaggtgggtaatggatcaggtagcaagaagaggagctagagaagggtggggtaggaaagaaaggaaatgtagtttcatgttgcttcacaagtatttaccataaagaaccagagaggcagctaactgaagatgtctaagggcaacgatactggggttgggattgtgctgaggcaaggctgaaagtgtatataacatgttgatagtatagatgctgaaataaagcaggtgtattgaagagatgattcaagggagagtagactgatgaggaaaggtgacctagggcagcttgtagtgaatgttatctgaacaaccaacaggaaaatcctcttataataagtcctaagaggagaaacaaagataaagaactggattctaggaaatagctgtgtacaggagattcaagacgtttatgatcaaagatgtttgttcttattgagaagacagtggttataaggtgaaaagtggcacttgggaaaggaagagattaatgtgtgtcttcggggagatattacagttgttggagaagtgagagataaagtgcaaattgatttgtgtagatgtttaactcacatgaggaagtgctgagtgattccaagaggaagccattggaatgaggagactgagaggtccgtttatttatttttttggaaaaatctcaacatgtcttttaagtctgaaggaaaatttcagagagaagtgaaagactgaagaagaaagaagaaaaataatcttccaagaatcattagtgtcctaactagggtttgctatcttaataataatacagtccacctttaccattgaattcctcctgctgaaaatcctcagaaactttagcatataaatggagggagtttagggttgcattatgtcaaggtagaactttgccagacaattgttagagctcatgtggtgagagtttctaaaactatagagtaggagccatttacatgatgcatcataggatgtaggtcagagaggtggtagatttgcttcattaaatagatgagagccagagaatgtagggtttcttaacatcattgtagaaatgatacaggatataaggggttgacaaaattataagattagtagaatgggaagctcaatttaaagcatgagaatacagggttgaatatttcagagaaaaggtcagccagaaagaatacttggtgttctccaccctaacgccataccttatgtctggaagattttatatatatataaattttatataaacctctgtggtattctggtgcaaaacttgattgagagccattccttttttttctggttaaaaagaaaatttatttctctgtatgatcaaaaggtattatttgctccagtacaggggaacgccagggtcaaaaagggggagtgggtaggtacgggattgtgggggtgggtatgggggacttttgggatagcattggaaatgtaaacgaggaaaatacctaatttaaaaaaaaaagagagagagccattcctttaaaagatgatgtagagagtggattgaaagaatagaagggagatgacactgatcatatctgaggaaggtcaaggatcccctgaaggaaagggtatgaagaagttggccactgacatctcctgtttcagagtaatgtcagtgtagagattagaatggaagccaagaagtcaaaactcttcgaaggatgcatgggcatgaagggagcacggcaatcacctcaacaggagagtaatttgtaggcaagtacaaaaagtattcccctcaaataaacaccttggaataaaatgatagaaagtgtaacgtcattctgtcaggtggaatggtcttgggatagagaagaataaacagcttcccctagggatacctgaggaagaattcaccctcatcaaataagtgacaatccacacatctaagggctgtgacacatcatttttagcatagattccccactccagataatggtgatttacagagaaattcatgagtccgaggcaagaaatgatgagagcatgtaatgaatagctttaatgcagaagacagtttttcttaatggtataaggtctagctctagagagaatacagaatattaggttcatgtatagaagggatagtaggatacaagaggagcttttgtttctttatatggtgatagaatagagatagatagcaaaatattagaaggtttagctagccctaagctaacagggaaattttattcatacttacatggtccaaaagccaaatggcatttccaacttgtgatgcaaccagtaacctgtagctttgctctctgttctgacagaatatgggagctacacatagaaagtggtgctcacttggatgtcttctgttccctgcaaataccaactttgaggtaatcaggttgaatcttagcccagccaactaagttagcatgagttttagtatacatgaattcttaggggagataaactcattgtaaaattcccaagaaatgaagtaaaataaaaatcaggcatctaagctccattaaatctctacatatctcctgagggttagagcaaaagtcgcttttttttcccttgaaaaaccatgaagtcatcagttatgtggatcacaagcttaggttcttggaatgtagtgagaattaggttcaagtactagttctgacttttgtcatctgtgtaaaactgggtatatagtttaaatgagataaccctgggatttgttcctggtgagtcttccataaaagattgttattgaatattcatacacaatacaggtaccagagaatgtaagagttaaggtgaggtttgttgtcaagagttttgacttttagctagagagacagaacatataatactccagtattggtaagtgctaagcttactaatagacttagaatgtatactgggtggtactgtgaaaccataaaacaaggaacattgaatttcgtctgcatacagagaataatataggatttgccatggtggaggaagcccaagagagagtcttctgagaaggacaggtaaagcactgtgcccggtgtttctgaagcgttgatatgatctccaacaatataaacaaaaataaaataaaagtaacaatcaaattggagtaacccatacagagttggcaggagacggagacagtaagaacttcagtgttccaagtcatagcctagaccaaataaaagcttggaggtaagagaaaacccagctatccaggaagcataaaatgaatgtggatggtgggttccatagcagcagtagaacctggatatgtaaattgtgaccaggtcatgaaatctcctagataccaagtttggaataatgaattttaatatatattataagtaattaggtgaagatataatgatcttataggaaagaatagaatctggtcacagaatagaaaaataagtcagagggggcaaaattggcagtgggccagaagggaaataccaatgcctgggtcaaagatagtgacttctgaaactatttcaggggatagaataaaaagaaaatatatgagcatagtaaaactctaagatggctcctgaagtattggttttgttgcctgggccaatgtaatattacaaagtagttatgtgggaacattatgacttgtatatacaattcttttttatttcaaaatttccttttattgaaaatagttttttcctacaatatatcgtgattatggtttcttctagtactactctttacagttcctccttacccctccctatctggttccacctcttttctgtcccttataaaacaaacaggtatctaaggaataataatgaaataagataaatctaaagcaaaccaattatagcatgacaaatcaaccaaccaaacaaaaagaaccaaaggaaaatgcatagcaaatgcatacaacacttttaaagagtcaaatacaccatcctatgaatgcctatggtatgatttgtattttcccatttttgtatacttctttatcatttcttctcatcatctattataagggatgatctcttcttggctccattcctccccaaagaggagtctaagactatgctactcctccagtctggttggatagcaacactatttcccacaaatagacaaaaaaaaccagaggagcaagtttggctttgttattttttacacttggcctctaaagaaggcaaaacaaaaaaccaaaaacaacaacaacaacaaagcccttacttatcaagcaactttctagaaagacactttgagtcaaatctgtatagagatttgctcatgtggagtatttatatttaagacagtatgtcataaatgtacagccagtagagaagaggggagagtttacttacaagcaaagaaaccaaggatgaaggctgatataaagacgtggggcatataacaagggctcttcaaatggaatccagaggagttatgaacttctgaaagaaaatgcaaaattgtgtatatatctttactactttttggtgggcacaggtcttatagatttcttcagattcttcaagtagaatttggctctatagatgacgtctagacctggtttctctgacatgaatgaagcgacttcaacaggcttctgcatccaactggaccacttccaaagccccaaggaagcttgatagaattgtgaattatgtacttataattttctattgttctttacttaatgaaagccttcttttcaaatcgtatacagtatttaatactacactgttttgatctatctctgtcagccagattagcaagttctttgacataggtttgtgtctaggagaaaagaatacgtgtagagaaaaactgcagaaggacaaaaaacatcataatcaaaggtaaaacaacaagcacagggatactcaaagaaatggtggttactggatgaggacgaaaagcagagcacgtcgtcaaggaaatagagagacatgtggttagccatgtctggtaaggatgggagatcagaagtgagggaaacaaaaacgaagttcacaggagttacttcaggcaaacaagaacaagacatggctgctccatttgccccctctggctgactgctcttccaaaggtcctgagttcagttcgcagcaaccacaaggtggctcacaaccatttgcaaagggatcaggggatccaatgcagtcttctagtgtgcgtctgaagacagctgcagtgtactcatataaaaaaaatatatatttttaaaaagacataaataacaaactgttctaaaccttaaaaaaaagaaaaacaaaactataaatggccactaaggtatataaacctgcagagaaatctggactatcaagaagtctccatgtacttgtcagtaaggataatatcaattactaaagtaaacttgctataaactatggagtcttcactaaagtgaaaatacatggtatgtatatgtatatgtatatgtatatgtatatgtatatgtatatgtatatgtatatgtatatgtatatgtatatgtacataccagaaaacgatgagtcttaaattttaaacttaagatttaaatcagtcagttgtctgtaactgttttattgagctttcttatgcagtgtatggaagccaaaactataccttaaataaatacatgttaacattttgtctttagccaataagaagaaagagaaagagcgcccagagatctctcttccttcagactttgagcatacgattcatgtgggttttgatgcagtcaccggggaattcactgtaagtaagctccttattttgttttgtaagccatgaaaaaaaaacctattttctttatgaaataggtttcaagtaaggcttgctatattccaaaatgtcagtctgaagatggacttttcctggataatcataaatagaaatagaaaatgcgcaacaacactgacaaaattattttgtctatcctaacataagtgtcttattaccctataatttttaatttacttgaaaatatttattttccaaggcacagaaaatgtagttatgctaaggagaccctgcctgaacctgtaccttaatcatataaagtgaatcaaagaatgatttattcaacttgactagtgaaggtgactcatctgaataattcaagctttccagtgggtcctgaattacacagatcagataattacagtgccaaagtctctgcaaaatttgcctagtcactcctttgattttaaaatagtagattatttttaaagattattagtaggtatatttttataaacattcaaaaccataatccccatgtttcaggaagaaaaattgttaattgtatatcacatatgtattagtagctagttgatgagtttacatatatattatatatgaatcatctataataattaccaacatgaattatctgcatacaacaggtctagattgttttttttctttgaataactgcagtgctcaaataccacagtatctcaggtactcaccattttcttcctctaaagaatgaatttggcacccattcattagatgagtgaggagagagatgttgctagatatacgactccgtatttcagctaattgttctatactagtaaacaactcaaccaacgtgtacatcctgaaacaataaagagcttcagatgaatttagaaaattaaaactttgataaaaatcacaataattcttgttttcgttaagctagaaaaaaattacagatattgtagaacccaatttcctgccttgtagcatgtcatgtggttaagtagggggaaagaagcaagacaatttgaactatgctacattgctgaattgacagacaaattttattttatttgttcaattctggaattaagcagtgtaagaatgaaataaaatagggtaaatgtcttggcctcataaattagtgtagactaattatttctatgttctcagtagcaagcaggaaaaatgctcaaaaataatgagactgctgaaattgagatagatacaatttaatgaattttgttatctgagtcaaagacattacttaaatgccatttagtttgagcccatcctttatttcattgctagaacattctcttggctacatttagaaaccacaaactgattatcaaccctaccacccactgtctttcccactggataaaaaatgttttgttttgttttttataatttgaccattgtgtgtttaaaaacatccaaagagagtttagctaattttctgatatttgaaacaggaaaagccctcaaactttacagttatgtctaacaacaacttgtctcttttattttaagagcttcgttttttaaattcctctatgtttttcttctatttaaacctcttatggttttatttgctgttattcttggttttattttcttgttcttttcctttggaggttctactgtgaatgttctctcatttagcattgtggttaacttacactttatttcttctgccttatttgacatcttttgccacgtttctcccatctttagccctttctttattctttctgggttctgaatggaaatcaagggaaactaaatcaccaccatcttgctgactgcagcactaagccttgtccactgtggtctgaattagaacccaatggaccaatctgagaagagtgaggtagaataggtggtagatggacattctagacctgatgcaaccaaaccaaacatcatcctcttctaaaattcatttgaaacaaaatggctttttacagtccactaataggaattcattgtccttgcagacagacgacaagttgagaaatttgaagtactttgttatcatcttggtgatcttttgcagctacttttatatacatttttaagtgatcacaaattcttccttctttattatcttaacctacaatttccaattaatattgtagtatgtttaactttcaaactaacaaaagtaatcagcctctaacacttctattggtaggatttaaaattgagtcttaattgccatagatactattaggttactgtctgttgtgggaaataatattgcgaaatttgataattgttgaattctcagcaatttgttgaattgtagtgaagttgttttacaagaacctgctcttttgaataattgagcaccagtttgatatgttgattggtgattaccctaatggctagttagctcatataaacttgtatacctacatgggcatacacttggaccctaaagctaaaattaggatgggaggtgagatttggggattaaattattacaagtccttacccattatattgccatttttgtcccaaatacttcagaactcccctttccagacctctagacctgtgacggtcgcttcaagtcaatcagagggaaaaatggtatgagtgatataaattatcattttttatgatatgataaatgcttggcctgttatatcatgctgccattctcctgggctacactggacactccccagcttgatgtacacccacttgtgattgtatattctacaaggcatcaatatgtgctcctgcttctgatgctcagactcttaggtcttcatttaggtccaactttttagattatttcctcaatttggagtagtgagatgactatctgattatgtgccattgtgccatatgctcaaattacagtaatcaggtctcattgagaaactagtttgtttcaccttagaaaagagaaattatgttagcattgtagtcatgtggtaagtagcattatctggaggaacttcttcaactgacagcattttttgctgtctagtgattatcacacaacttttccaaaagttttgaagtgccatgggaatgtataatgcctataaatattctaatgattatggcaatgatcatgccagtgaagtctgctttagtggttatgtgcaatgcatacgtggatttgtaacattcaataactcctttggccattatagtattaaccaaatgctattaattgcacttagaatcagaactgggatcatgcatgggctcctgagttccaatttttggcttaaggctttagcatcaaactgcgtgatgaaatgcatgtaaaagtgttgtttcactgtgcttggaataaccataaatgccaggaatcaaggacatgtatcccaaatcaaagcagttgggtcaaagcatgtttctttagcatttgagatatcttaaattagaaaaatatgttactttatatctgatcttatttgtgggaagtggggtttggaactatatcattaaatggaaattattcatgcaaaatttgaaatgaaatgttttcccgttccctgatataaatgcatactaaacctaagcatagtgtctggctttggaaggatggctttagtatcatttcctttaagccacccatgacttcagctacaaagtacagaagaatatagatcaatattgttatacaggcatcctttgaattttagccacatagataagttcaatatgaaatggaaacttagataaccaggattgggaactgaaattcgtacgtttatcccatggccattggctatccataatgacccaattataaaagcaacttacaagttattattgaaaattttcatgatgccatcctttatccctccaaattcttgttgctgctttttggtaatttccccaatcacttaatggtaatttttactattgcctatttatggaggaaccatctggtccaaagtggaattatatatgcaaactttggaacactattgttttctctgttctcttaaatctgtatccaatcctgtccctggtctagtcagtacccccctatatccataactgccccactttaaaagggacccccattcagacccattggtttcatcttttcccaccttctaagttgtcccacattctgttttaactttcttttctttctttatttacgtccattacagccagatctctatggctcacagatgtgcccagggaagctcccagaggtgcgtcacaggcccaaaagaagcttgcatcaaagtgcttctttgagatgtcatagcactgcagtagcaggttcatgtgtgtgcagtagagtcgttgcttggcttatctcacttttttgttgtcattcccaaactctggaggcccacgtcacacattgttttgccgagacttcatgggacaaagccatctaaagtatgtctggatgcatttcagcaatagcgtatccattcctctctccaagctgttcttggaggttggataattgcaaactgcaaaatctgcaggttgaaagtccaggaaagaatactgaatgcttggtgtaaagcaaacctctctggaattttgaataattttccttggttatttttttcaacattccccctctctgttctaagtgcttgatattatttactgcaaattctcacaaggttttgatatggttttatagtccccaacttctatgtggccaatgaagtagggagagagggagagggggaggaaaggaggaaggcatgccctggagaaagctgcaagaaaaatactcagtgcagcataaatgttacggttgagggtttcagtggtcgttgctcctccacaattctagctttgctcctcccaatttgacctcattataaagccctagaaaccccaaattacatttggtaaacaaaaagttgaaactgaccaagggtgaggctttccttttatttggatattctgtttaaatgataccttaaaaaaaaaaaagcttatgatactccagtcatgaaagaacaaaacaaaacaaaacaaaacattgatctgcactatactatactgtgcaaaaatttagagaagtcttgctatgtctgccctgagtcgccagaaaaaaaaaaataagctaagctgtaaacatcatttcatggatgagcagagtcaatatggaggtgattttcatgcgctttttgtttttatcacaatcatactctcacccaccctttttaagttggatcctagttttacctatgtgttttgattagagaagagaatgatttgcatttattacgttactaacgttaaatctagaatgtaccttcagtttcccaagtgtaatccaacaggtagcatgggcttcttggtgcggaactttactggaacatgcacgtgcttctgacaaatgctctaagcagccgttctttccctttggttgtccacagggaattcctgagcaatgggcacgactactccaaacctccaacataacaaagctggaacagaagaagaacccacaagctgttcttgatgttctcaagttctacgactccaaagaaacggtcaacaaccagaaatatatgagctttacgtcaggaggtaagggaaattctgtgatattaaaggggaatgggccagttctcagagcctcctgatgaggccaaactatagcatattgaagtcagcttcagtagtttcggcaaatgacttcagtgtaagtaaacctactgatggggtgggactctgacatcaatgctagaagcttggtttttagctggaaaatgtttattggaacaatgatcagcaaccacaattctatctattcataagtatgaatagtccgtcattttgcattaggtcttaaatatggttatgaggtaagaatataaggatgaacaattatctctggatatatattaattcacctgtgtcataacaatgtaggagagcttttgtgcttaccaggttattttcaccaggtccccaagttgggggaaaaaaggaaaccatcaatgtcttactgcaatggcattgttaatcccaagttccaactccatttgctggtgtgtacctatctgcattattcccaaattgtgacttcattggctcttatgcatgtagttcatttagttaaaaaaaaaagaaaagtaatctgggctggctctatagagcaaatcaattagcatatagagaaaggaggaaatactatatctttattccagcagaaatgagacgtttattaagatttgtaaagggacttgctgaaaatatggttaggacctaatatgagatattttagagaacagaaacttgccatttatcatagagttaatgctaaaattcccttctaattgatgacgagctgtttcttaggtaggatttatgaaacaaaggtgattttctttcttctgacttttcagataaaagtgcccatggatacatagcagcacatcagtcggtgagtcaaaaattaaaaacagtttctcacaatcattgtaacccaagatctaacaatataattgattatgtttggtttcatatattcaattttcagacataaatttaaaaagcagattcaaaaagtataacttagaagcataaatatcaatttcatatatttactatatatagttaataatatatacttataaatactttttatctattatgaaaggtaccttgtagttttgtaaatgtatacaccactgttactatctctacaatcagttttccagtctaaaaatatataacatttgtcctgggtgtggtagcatatgcctttaattccatcattctggaggcagaagcaggcagatctctgtgatttcaagaccagtctggtcttcaaagtgagttccagtacagtcaggactgttacacagagaaatcatgtctggaaaacaaaactaatatacgtgtgtatgtatgtatgtatataggtatgtatatgtacgtgtgcatataatatatataatatgatatatataatatataatttgtgatatagtatcacaagttgtatagaattcacagatttaacaaaattattttataggaaaatatttgactatattgtggtatttgtggaaatactacactatcattgtacttccagctaaaacttgaaaggcactataattttttatattcaaagtatccactatttaccataacacatttttggaaaagacagcccaaacatatagtcttctcggcaacattcccatattgggcagtcatgtgcaaacgcatcataatagtgacacgatgctcctggtaagagggaccttaccagcccctttcctgttttagaaggagaaataaggatgagaggcattctctggagctctttcagcagtcccttaggaaagttaccagcatcatctacatgagattcctccttaatgagaaaattatttttggtttactcagatggaaaaagaaatagtaaacgctcctgaaatggcatgaaaacttacagccaaggccacttggcacagacattagaaagtcaaggtttataggacatccagtactcctgtagagtgcttcccaccataatcaattctcaacctagcccctattagtcaccaatcttgtgtttggtttgttttgttttttgtttttcatttatttactgtaatcctgattatagccccactccctcctctcctccagccccaccctcacaaaccctcccccctgttatgcccttgccttctcctcccctcatgggtaccaaaactccctgacatatcaagttgcagcaggtacacatttaaggtcactctttcccactgaggccaggaaaggcagcctagctagggaatgtggattcaagggcaggcaacaaagtcagagacagcccccactccaattgttaggggacccacaggaagaccaagctgcaaatgtattacaaacatgtagggggcctaggtccagcccctgcatacattttggttggtggttcagtctctgtgagcacttataggcccaggttagttgactatgtaggtcttcttatagtatccttgacccctctggccccctcaattcttcccccaacccttccacaagatgcaatgagcttcttttgatgtttgcctgagagtctctgcatctatttccatcagctgctagatgaagcctctcaggagacagttgtgccaagctcctgtttgtaagcatggcagaatgtcattaatagtgtcaggggttggctctcttctatagggtgagtctcaagttggagcagtccatccctcaatctctgttccatctttatccctgtgcatcatgtaggcagggcaaattttgagttgaagatcttgtgggtgggttggtgtcaccctacttccactggaagtcttgcctggctacagaaggtggtcacttcagtcgtcatatcttcagctgctagtagtctcagcttgggtcacccctacagactcctgggaacaccccttgtcctaggtgtcattcatttgcaacttgtattgatccaatattctaagataggaatgtatcaccgttcactcactcaaggctttccagactatgtgtagttcttttttttttttcatttttttctttttattagatattttctttatatgcatttcaaatgctatcctgaaagttccctataccctccctccggccctgcttccctacccacccactcccgcttcttggccctggcattcccctgtactggggcatataaagtttgcaataccaaagggcctctcttcccagtgatggccaactaggccatcttctgctacatatgcagctagagggttctgcaaccctataggtggaacaacaatatgaaccaaccaatacccccagatctcattatctctatgtatagttcttacatattacatataatgttcctatttaaacccaagataggtgagatatcttagtggttaagagcactagctgctctgcctgaagacctgggtttgattcccagtacccacatggccacctacaaccatctataactccaatgccacagaatctgataccctcttctggcctctgcaggcatggttttggcattaacctgactgtggtgataaggaattaagaaatgagaagcatgttcacaaaagatgggtccagtaaactgtgtgctgtgatagagatgcatccataacctggaaacccaccctgtttattatatacagttgaataaggaggcaagtttaggatacacacagctgaacaaggaggcaggctagctaatcttggtaggaggtctctgtaggagatcagtctcaggatgcagttatccatagggaggatgcggtcattgataactttctgcacatgctgtcaacctccatacttgcaccaggagaaggccttgccattctcatgggtctgaggcattggggttcttgtcatggccatgcttatgtcaacaatacaatttcacttagggtatcatccatttaccacacacagtaccatacaggcatgcatgcaggcaaaacacttgcacacataaaacgtaaacaaattcacatataattgcctttgtgtgggccgataattttgtatgtctcatattgataggattgaaaataataatcatattaatagtaatttatctttactgaaatagtaatttcactttactaaataattacaaattttacttgcaatatgagctagtaatatttgtgtattcatggcaagacttaccattttttacagtttaaagatgagtacattgaagttcagagacatgaacttattttattaggattacaacactacacttatgtatattatttatttttcaaaactgaggcatatgagaagaaatgattttcctcaaaatctgagagttttgtagaggacaacccagaaaatatggcaccaagtccttggagattctgtagtaagtaaaacaacagtcatatacatcagagagaaaatggttacgagtgagggctcttgttttgtgaatttttattttgatggtctgatagaaattattccctgccttacttgagtccataggggtggaagtcatctaagcatttatgcagagctgtaaatagccaagcttgttgttttgatagagagtaaatgctgacttggtgtcaccttagacagccagtgcaataccaacaaataattaagggtaaaggttaaagctttggtatagtgtgacagcttctcaaagatacacaataaaattgccatataattaagctattctccttctgtgtgtatatttagaggagaaagctaggtatttgggagactctctgtccgcctttgtttgtagcagctgatagccaaaagagggaagccaaacaaatatccataagcagaagaaggaaaaaatgtactaaaaacaagtgtatgattgctgttcagcattattttgaaagaaaaatttgaacaggatacaatgcgaatccagaggatctaaaaaaattttttaaaaaaaagcactaataagaagacaaatattgcatgattccaatcataggaattacatagaggggttacatttatattgaaagatggttgccaggatctggggccaaagagaatgtagaactgtttaatgtgtacaaagttttaattttggaatgtgaaagggtgctgatgagtgagtatatagttatgtgactgctcttaacactacttaagtatacaccaggagttgcttgagagagagtaattttatgttatatactttatgacaattaaaaattaaatgaagaggggtagggatgtagatcagtagttgaatgtgtgcttagcatatataggtgcttggttcaatctcgagcacacacatacaaacacacagacacacatgcacgcatgcacgcatgcatgcacgccaacaaaagtcatagaataaaaagaaagaaaataagatgtgaagatttgagcatagtgtttaatcttattcctctacttattgactgtatttgtgaaatagtttagctattctgggcctctttttcctctgagcttttctttactcaagattaaacgggaatgataatagtgtctaactcttaggacttgtatgaatattaaatgtgataataaatatattatactacactatctaccatatgctctgcattaaatataagctgttactattattaatcttatttgcagatggcagcactagtaaacaattcagtatctctacataagagacctgtacatggccatatttgtgccttgctcatactccctcaaagggaacaaaatgtggctcttatatttgatcagtaatttccttctttgacataatagcatcctgggctgcaatttaaacaacagaaacagaaaggaaacaggcaactaggaaaaaatggcaacaacctacaaccaacacctacttcacctcaattaatttaatcttatgtttgtgccatcatgaatagcctggtaaatatatagatctcttaaaatatttttattagttctttaagaatttcatgcaatacattttgatcatactcacctgcaatccctctgtttgactcttcccagatctactcccaaaatccctacaccttcagtttcatgccccctccttttttgaaattgaataaccttttcattgactctaatttgtgtagcccatatacttcagcatacagggccatctactgaagcatagcagttcctcctaggagccacactcttaaagaaaactgacttttcctctccatgaagccatcaattctccctagctcctcagttaaaggtgggagttcatgaatcccttcccatccttgctagaatattttgactggcttgatctagtacaggtctggggaagataaaccacagcttcagtgagttcacaagtaccctggtactgtccgatccagatgatactgttgtgatctggtcctccctgacctctggctcttacaagctttctgccatctcttctataaaggtccctgagccttggcagagggcgttgatacagagccctcagttgcaactgagcactcactgatgcttatcgtcagtactttgaccagttatgagtgaaaatagttttatgttttaggcatgttagttattttaaatgacaactctctaggatgatgtatacactgcattttattttctcttgagatgcaaactttttgagattctttatatttgtttttgtaaaatggaaaaataagtctgtataaaagtgatattctgttaaattagaaaaaaatatatgatcttgctctatggaaatgaaaataactacatattcacttatttagcttgtgtttgtcaaatgcctccttatataagcctttacaaggtttggagttcactcttttaggaaaagatgaataagaccaaaaagatttatattactgtgtggatggtattatgtaacataaagtgtatccacttgctatgttaattcacaggaaagacattgcattgatgtggcaagagaaaaagaaccaagtttttcttttcaaatgttgaagtttagtgcttgttataagatagaaatatgatacatatttgatggatgttgagttagaaaatatatcatataaaaagtgacatttagacaagatcttaaagaacaaatgaaaaatgggtgtatgaaaattgtgacaagtattctaaacaaaaagaaaggcaggagaaaaatcatgttggtgaagagagcaagggagcaagatatgtgggtttgactgatgattatgcaagggaatgaatcacagagcttaacctcaaaagttaaattggggccaactctctgaggttcttacatggaattctaagcattctagctttttctgtatgcaatgcaaggttttttgattagtgcagttagacgattaatgcttaagctttaatgaagagtaattaaacaaaaagtgtccaaacttaagaacagaaggtaagagtagatgaaggttgactagttaaaaaaataatgtctgcttccagactggcaataatgagggccaaagtgagttgtggcaatggaaatgaatactggttttgaattctagacatctttattatttggacatagaaggaaaggatgaggaacaaaaggcaaacatcacatgctcttctcatgaaaaatctatatttgaaaaggtatgaatgtagacagaatatttgggaagaaaaagagggctggaggaagaagaggaagacaagaattgatatgaatatgtacagttacatgacatgcattgtgaaaatgtcaaaatgaatcctattatcttatataagtaatatatgctaatataaaccttaagattaattgtatgcttaatgatgtatgggtagttaaaaagacaaggtaggatgttattttaggagagaagcagatttcctttggaagctgttaggtttcctattggataatttaactttgaaaggctgataattcaagtagcagtaattggtctacaaagctgtgcgcttaagacaaggtttctgttggttgaatgaactgaattggacccttaagttcaatgagactcacttcagtggcactcagtcactttatagaaagagtatagttcacagtgttcattctgtatgtacttggatgtcaaatgggatctgagctattgaacaggaactgaatactctataaaaggtttggcatcttttagtatcctgggtggaaaataaaatacaagcactgttgtattatctaggttttaaactgctgactatgtattgagtacagaatctggtgatatatcctatagtctaatgttctttacagctcatttttgtttatgtgagtgtatgtggtatatagttgtgaacatgttcacacatacatgtacacagtgttctgagacctctcactctgcatattgtccagttgtgggtctttgtatttgttcccatctacctcacgaggtatcttctctgatgatgcctgagcaagatactgatcgatacctgtagcagaatgtgattaggagtcattttatcactacattcctttagcagaacactggcgttttgttttcgctcaagtctgtggacgattcagtcccatgttactgccacacaagcagtattatgaacgggttccatttctggaagtagatgtttaatccaatcagagattgattgattacttctttgagctttgtgctactattgcagcagcacatcttgcaagcaggtcaccattatatagggaatgctttgtagctggatcagtgtttacctctctcctttggtaggagacagagcactttctagtaacacaaacacgtgtcagtagggatgaaggttctgggtcggcatcagcatgacttctctatgttcaaaggtgttatcttcaaccataggaccttaccatcaatttgtggagagcaaccaacagccttatcaatagcctgcattgtttgggggtttccatgggactcccttggagaacaacttggctagatgtaattcatttctgtaactggaagtttccttaggtaacaagagctgtccaactggagctcatctttcccattatttagtaattccatttagataccctttcttttttttttttcttattaggtattttcctcatttacattttcaatgctatcccaaaggtcccccatacccacccccccaatcccctacccacccactccccctttttggccctggcgttcccctgtactggggcatataaagtttgcaagtccaatgggcctctctttgcagtgatggccgactaggccatcttttgatacatatgcagctaaagacaagagcttccgggtactggttagttcatattgttgttccacctatagggttgcagttccctttagctccttgggtaatttctctagctgcttcattaggggccgtgtgacccatccaatagctgactgtgatcatccacttctgtgtttgctaggccccggcatagtctcacaagagagagctatatctgggtcctttcagcgaaatcttgctagtgtatgcaatggtgtcagcatttggaagctgattatgggatggatccctgcatatggcaatcactagatggtccatcctttcgtcacagctccaaattttgtctctgtaactccttctatgggtgttttgttcccatttctaagaaagggtaaagtgtccacactttggtcttcgttcttcttgaatttcatgggtttggcaagttgtatcttatatcttgggtatcctaagtttctgggctaatatccacttatcagtgagtacatattgtgtgagttcctttgtgattgggttacttcactcaggatgataccctgcaggtccatccatttgcctaggaatttcataaattcattttttttaatagctgagtagtattccattgtgtaaatgtaccacattttctgtatccattcctctgttgaggggcatctgggttctttccagcttctggctattataaagaaggctgctatgaacatagtggagcatgtgttcttcttaccggttgggacatcttctggatatatgcccaggagaggtattgctggatcctctggtagtactatgtccaattttctgaggaaccgccagactgatttccagagtggttgtacaagcttgcaatcccaccaacaatggaggagtgttcccctttctccacatcctcgccagcatctgctgtcacctgagtttttgtagataccctttctatatagatatattttagaagcttctactgtaataggtttccatacaactcctcaaatgactcgtagtttgatgtgcccctccaaatactgtttcctttactccctcaccctccgtatccctgtttgatcctgataacacacacacatgcacacacacacacacagtgtccatccatatctatgtattctatttccccttcctagggcaatcccccaccccaagtcccttatcttctctctacctaacctctggttttacagattgtaccttgcttatcaatgacctaacaactacttatacatccacatataagcaaaatcataccgtagttgtttttctgagtctgagctacctcactcaggatgattttctttctagtaccatccatttacctgtgaatttcacattttttattttttaaacagctcaataattttccactgtgtattagcacactggtaagtgtgtgtgtatgtggggtatgtgtgtgtgtgtgtgtgtgtgtgtgtgtgtgtgagagagagagagagagagagagagagagagagagagagagagagagaatgcatgaagaccataatacagtttcaaatgtgttccttaggagaatagattagtttttgaggtgtctctaattggaacctagaagctgcaggttaggctaggctgctgagctactacttgcaagatgtgctgctgcaatagtagcacaaagctcaaaggagtaatcaatcaatctctgattggatttaacatctacttccagaaatggaacccattcataatactgcttgtgtggcagtaacatgggactgaatcgtccacagacttgagcgaaaacaaaacgccagtgttctgctaaaggaatgtagtgataaaatgactcctaatcacattctgctacatgtccacaagcttctttctccccattgctgggattacaaatgtatgtcatcatgcccagcatttgatgtggttactggggctcaaaactaggtcggtccctgggcttctatggcaagcactttactgactgaatggtctcttcaactccaagatctggtgtgttattgataagcagggatgaaatagaataaaattttctgtagcataatatcgaagcagatgacaataatccaactgcaatttttctctgtatcaaacagtccctgaaaggttagtgtttcagtggaattctaataagctgcaaagaaaataatatcatgaaatttgcaggacaatggaaatagaaaatgttctgttaagtgaggtaacccaggtgcaaaaagacaaaactccatgttctttctcatatgtggatcctagcttctaattattaaatgtgtgtatttagaagttaactgtgagcttagcccaagaaacttgaaaggggcacatgggatagaaaagaggcactgaggaataagctgaagagagaaatgcaacacatatgatatgaaaatggaaggaagcagtgctgaagttggggggacagtgaaaacaggggaaccaactgaagtgaagtatgcatgaaatgccagagggagccccattaccttgtaagctagtttttatacaatcaaagtttaatttgaaagggttaaatatgtatgcataaataaaatcagcatcaaataagcatatatttcagtcttttaagtcactaggcatacatctaacatggcagtcacatgttctttcaaatactttcgcaataattctgcagtatatttctcaatagatcatttgtgctggctcatatccaatatataattacactatattactatactgtagatactaacaatattaaaacatttccatattgatattccaaaacagatgtaagttcttcactgtaatatttttgttaataggatgcctcaagtgttctgatctcaagaaatgaaaattcactttaggaacaccttggggagcaaaaccagtgccataaaacaggggaaaaacaattatgcaaaaagaaagcaaaattaaaaatacccacaataacactattcaccagaaatacaatataaacatgtataattgaaatattttagtaaccacattttaaaattaaaaaatgaatgctaaaattaatttaatgatatattttatacaagccagatgaaattcaggctaggtaggagaagaagaaaaaggcacagagccccatccctagcagagaagctatttgcaactgatagctgctgggagagggaccattccttttcttcaataagtgatactggttgtatcaaccacactccaaggcaggttcaatatacagtagtggcaacacaaattggaatccatggcagagtatatatatatatatatatatatatatatatatatatatatatatataaaataaagaacatgaagttggatgggtaggaagcgagtaaaggagctgggaggaattgggggagggaaaggaatatgatcaaaatatatcatttgtctctgctccctccccagtacctgcattacttgtagacaggataaattttgggttgaaagttttatgggtgggatggtgtctctattactcctctggggctcttgttggctacaggaggtggtctcttcaggttccatatcccctgtgctgtgctgtgagtcacagctaaggtcaaccctattgattcttgggtgcatcccttatcccaggtctctgtatcttcctggagatgcctcccacatcctcacccatgccaattgcagacatgtctcctgttcttcctcaggtagatcctgaaccccccattcccctccccatcacctctcccacccagattcctccctccatctgcttctgatgactattttattccttctttttaagtgagatatttaagcttccttgcttgggccttcctttctgtttagcttctttgggtctgtggagtgtaacatggtacctgtatttttatgactaatgtctacttatcagtgaatacataccatgcatgtccttttgggactgggttatctcactcaggaggatattctcaagttccatccatttacctgaaaaaaaaaaatcatgatgccttggtttttaatggctgaatagtattcccttttgcagatgtaccacatgttctttatcctttcttcagttgagggacatccagtttctggctattacaaatgaagctgctatgaacataattgagcaaaatgtctttgtgggatggtagaacatcttttgggtatatacccaagagtggtattgctgtgtcttgaggtaaaactattcccagctttctgagaaactgccaaattgatttccaaagtggttgcacaagttttcactcctactagcaattaagaagtgtcattcccattgctccacaccctcaccaccatgtgctatctcttaaatttttgatcttagccattctaatgggtataagatggaacctcagagttgttttgatttgcatttccctaataactaaagactttgaacatttatttaagtgcttcttgaccattagagattcttctgttgagaattctctgcttaactctgtactgcatattttaattgggttatttgagttgttggtgtctaactttttgagttctttgtaaattttggattttagccctctgtcagatacagagtttgtgtagatcctttccaaatctgtaggctgctgattgtcttattgacagtgtcctttgtcttatagaaactttgcagtttcatgaggtcccatttattaattgttgattttagagcctgagccattgatgtccttgttcaggaagttgtttcctgtaccaatgttttggagctatttcctactttctcttctatgatatttagtgtatcctaatctatgttgaggtccgtgatccacttggacttgagttttatgcaaggtgaaaatatggatctattttcactcttttatctgtagacatcttgttagtccagcaccatttgttgaagatgctttcattttttccattgtatggttttgacttctttatcaaaagtcaaatgtaaataggtatgtgggtttgtttctgggtgttgatttgatttcattgatcaatgtgtctgtttctgtatcaataccatgaagtttttgttttgttttgttttgttttgttttgttttgttttgtttgttagttttaattacaattgctctatagtatagcttgaggtcaggaatgctgattcctcctgaagttcttttaatgttcagagttgtttgactgtcctgggtttttctttcttttttttttttttttttgtttttgtttttccacatgaagatgagaattgttctttcacagtctataaaaattgtgttagaattttgatgggtatgtagcagatgtgcagcttggtcctcatgtagatcccaaacaactggaatgggggttatcccaaaagctgttgcctgtgtgtgggatgtgttctactagctgggctgccttatctggccttagtggggagaggaagtacctagccctggagatgcttgatatgccagggtggggggatacttagggggcccccacccactcagaggagaaggagagggaatgggggaggattgtgggagggttattcagagggagtcagtgagcagaatgtaaagtgaataagtaaaaaaatttaaaatatgtcatatgaaaagtttaaagaatagatatgatggtttttaaaagaaaagagaaaatgaaagaaacaaggatagtctcaactagtatatagttattgctagacaatatgttctgattgattagagatgacagaaatttcctctgaccttcctacttagtgtgcaaaaccaagctcaaaacacattcttgacaagaggcgtgctttctataaaatgacactctatttacagtgggcagtatttccagtgtggttaacaaaggggagaattccaaccatgttcctcattactgtgtagaagcagatcaattaacctaaaaattagcaagaatgcatgctggccatgtaaaaagtaggagttactagaaacagaaaatgtaactttctgtgagatcaaggggagtaaggggatggggaatagttacatggggggggggaggaaggaagagagatgtgctcaaaataagtaatatacttatatcagagtccctatgagagccaaggtaatgtgtaatgaatatttgtcaattaaattgtctattacaaaaaaacctcaatattaaaaatattaccagggcttagctcactaggtaatgtgttttctgtgcaatcatggggacttgaattctgttccccaatacccatgtaaacttcaggaatagtgtgcacatgtcttttattattacagcagtgctgagaggtagaggcacttagctatgggatctgtctagctggcaagctttctctgggttgagttaaaagatttttgtctcaaagaataagaaagagagagagaaagagtgttgtgtgacaccattccttaatctgccaccaaatgcagacgctattgcatacaccagcaagattctgctgaaaggaccctgatatagctgtctcctgtgaggctttgacagtgcctggaaaatacagaagtggatgctcacagtcatctataggatggaacacagggcccccagtataggagctagagaaagtacccaagagctgaaggagtctgcaaccctataggtggaacaacaatatgaactaactagtacccccggagctcgtgtctctagctgcatatatatcagaagatggcctagttggccatcattgggaagagaggacccttggtctagcaaactttcgatgccccagtacaggggaaagccagggccaagaagtgggagtgagtaggtaggggagcagggtaggggggagggtataggggacttttggaatagcatttgaaatgtaagtgaagaaaatatccaataaaaatatttaagaaaaagaaaataaatgtttgcttaccccaaatagcaaagaaaggagagaacaacgtaaatatataccaaagtttacctttttgaaccaattttttattaagactacttataggaacatgggtgaagggtttcttacaggggtagaaatgattcaaagagagctgcatcaccaaagcctaccctgacattggtgacagctcacaaaagctggaaacctggaccacactatagggcctgcaggcagttcaacagattgtagaacatcctttccatgtggctcagttgatctgagcctgtacaggcagcttggctggttttgtggcttctagaaagtttgaaaggtctctgctgcttccagtgtctctcagcaatccttattatttatatacatgcgaggaaggaagagcctagtatatctgcttagtttcggggatttcctaaaacctttatttcctgagcttaagtagttttcccagcaagaaggaatgctttacctcccattagaacttcctgttccttaacaaaactttgaatgaaagaagtgtatctcaaaggatattgctacacatcagagggatataggaagacacctgccttggatctctggtacacacacacacagaggcatgcccacctgcacacacatgtgcatacatccatacatcatacaacacccatacctcatactcatatataaaaattttaaatgctgccatttatcacatcaatgtaaaatcgttaatgctttagtaaaataatttacattttcatatcatgtttacagaatctgagatgtactatactattacaacacaagtcaattcagaccagctacagtttttaatgtgtgtattattcagtattcatgtgtctaatatctgtctgtaccaaacctatactatagtttatgtgagcttgtgtcagaattatctacaagacttgctttaatacactaccaagtgcctgaatttctggttgatagatctgggtggacctgagaatttgcattttaaacaagtctctggatgctgctgctgctgcagagctagtaactgcactttgagaaccatgaccttaattcattcaaaattcacaaatttgcaaccatttccccactgtgttaacataaaacaactaaaatggacattaggtactgtagtaatatatattattagttattattaccatatattggaaatcaccagtaccctctctattggttatattgatcaattgagaacatgttccttggatcttagtgtctgttactgagtgattctttctatgaggattaacaaggaagaagcatttcttagcttctttgctcttagtatttacagagctatatatagcctcatgatcatgcttattatgctaacagaaagtaggcctttaaaacatgacaaactatcattcgggaaattattaatctactcaatacatattcaatgtactaatgccatttaatttgatttttaatgtagtcagtgattttaaaaatagaaaacaaagataataacgtggtccattttatcatgaaattaattcatctctgaatgtgctctggtcttggctactaaatgtagatcattgtgctcatttgtgaaaagatatgtttgttgctatctctacacatttaattattttatctctgttttcttgtttctgaagaaaaataacaaaaagttaataccttgtctttaaacatttgttcttctaagaataccaaaacagcttcggaacctcctttggctcctcctgtatctgaagaagaggatgaagaagaggaagaggaagaagatgacaatgaacctccgcctgtcattgcaccaagaccagagcatacaaaatcagtaagtcaaaaagacaaatatggtatgtcttctttcatttatttctgattctatacatatatagtataatatatatagtatgtaaatatataaatgtataatcatagatgcacacataataatatattctgaaagtaaaactatctatggcggtggttctcaaactgtgggttgctacccaacaggtgtcacatatcaggtatcctgcatatcttatatttacattatgaatcataacagtaacaaaagtgaagttatgaagtagtaatgaaattaatttaatggttgggagtcatcacaacatgaagagctgtattaaagggttgcagcattagaaaggtcgagaaccactgctctagggaaacaacctagaataatgggatggagacaagttgcagagggaaagaacagatgtgggaggaagtatgaaagaacatatgttctatataaaaagtgtacctgtttgaaaacttccttatgtaaatatatatacatatacatatatataatgagttttaacaaacattttgaatagatagatagatagatagatagatagatagatagatagatgaataaacaaacaaacagacctatcaggttagaaaatgaacagaatatgtcaatattgaatacaccatccaaacctaatgtatacacttatgtattttgaatatttagcattgttagtaacatcctactgaagcaagaaaaaaatcagtgggtgtttataaatgactcaaaagatgccttttagaacagattttatagcacatgcctttaatcccattatttaagaggctgaggggataggatccaaagtcccaggccagcctgtgttatatagtaagactatggcccaaaacaaggttaaagaaataaaacaaaatggcgttttgtggttaaggagatgtctgtgttgttaaagtgcttgctgcacatgcatgaggacacgagtttcatctttcagttccagcagtgtgtgcttaaaatcccagtgcttcataagtagagacaagagtctccctaaggcttgcttgcaagtcactctggccatcttcagtttaatgagagatcctgtctcttgaaaatgaggaagagagcaattgagtaacatcaactagcattcatatgtgcatgccacacatgtacatgcatgcatgtgagtgcacatgcaagtacatacaaacctgcacacatatatgcacacgaaggtccaatttagaatgtaattttagaaaaatgttgagcaactaagacctgttgggcatctcttgtgttcccagaggtagagtatagaacataagcctgggagctatagaaatggctcagcagtcacgagtactcacgaaacttctagagaaacctagttcccagcagctgtgctggcaactcataaccacctgtaactccaactctaggggcccctatgcattcttttggccccacttgtacatatgtggcagacacataaacacatgcacacacacacacacacacacacacacacacacacacgatttaagataaaaataaatcattttattttatcatgagcctaaaatcaatataaatttttgttactttttgtttcataaataaataccacatttccatcatttccatcttgctccttgaactccttcatgaccacccccaactctctctctctcttaaattcatgacctcttctataattattgttgttttatatgtgtatactgcacaattaaagaaacaacactaaatgagcctggttttaaagtcttgatttgaagatacaagattatctcattcaatgacttgctaatgatacagaaaaaaaaaatcccacacgtaacttcaagtttgtaaaactacggaggtagaaataaggaaagaaatccatgagaaccagataggaagaattactaagagaggagcagcaagatgcgaattagcatgtaagattttccttaatgttctttaacagtgacgtgacagtcccttgctgccatacttccttacctactgtttgaattgtgaaattgtgctgggtatgtctgtctttcagatctatactcgctccgtggttgagtcaattgcttcaccagctgcaccaaataaagaagatatcccaccttctgctgagaatgccaattccaccactttgtacaggaatacagatcggcaaagaaaaaagtccaagatgacggatgaggagatcctagagaagctgagtgagtgccttcccatcagcaagtagttctcatacagtgactaggaggagacttgatcctttagatcttccaatcttcttgtcggactctaggatctcttatgtcacgaagtaattttttaggactttctgtttctaagagtggttattttctccctcatagtcctactctgacagaaacttagcattttcactttgaatggtcaaaatggtcaatgaagatgtaaaggacaaaatatattatggtagtaagtttaagattacaatactaaaaaagaattaaagtatgtcatgactataccagaaggtccccattgatagacattagtttttaaaaaaaaaatcagccttaaagtccaatagagtacaatagaaaacttgcagcctcagataaaatagcttcccctatctcggtggggagggaggcaggagcagcagttgcttccaaggtgtcattggtgcgcacatacttctgccctttccaatttgacaaagtactcaagattcaagattcagaaataggttttcccctgaaaaaagtcaaggttctatgaattgtattattaaattcataaagaatggctacatattagtaatcagtgctcagtttaactcttacaagtgccttattccttttttttttcctctgcagggtaagatttagtagcataatgagagtaaaggggctgtcactttttacattttttttttcagctaacagagcagagcaaaggaaaagagaaaattcatttgctggccacaaggaggcactgtagtcatggcgacagagccattttgctacgaaggagctagcttaagacaatttttggtttcccaactgatacaggactgctgtcatctagatgatggaggctagggatactggtagggatcaggatgcgacatcccctcccttgcctttcacaacaaaattctgatttggacagaataattactttgtgtctactgcattcaaaatagcttcatatgtagcactatcgtcatttgaaatagagatgtttgtggcagccaaggttgaagttcagctgtcaacactcagacctggaattgctacaatttagcaaactgactttgctatcctccattaaatatgcttctagctttagtgcccatcatttgctctaatagcacaaccgcaataattcttacacgaggagcactttgtgagtggccactttccatatattattttctctacagtcacttatggtagatcttaacgtctacattttacagaacactgaatataaattttaaaatgcttaagtgaccaagtcaccataataatgagtggtagaggcagagtttgacctcacatctttatgcctttaaagcgtgcacttttgcccattagccacttcggttttgcataactcaactactcgtttttcaaacagaggggtgagataaagaaccctcaggaaaatgaggttcagtgattcagataatcactacagttcttcctttgttttgtacatatgacatgaactgtgagacagattacattagacttttaaaatctgacagtcatgcattagtcaaaatgactgttctctggtgtctctttcgaaccttagcacattcattgtcatgaacattgatttattcatttcataagaaagctgagaaataggcattgcatttctgagccatggtttttccctatagactgtgacagtgatatggatgggacctttctggcttatttatcttggtctgcatcaaggaacaacaggacaaacagaagaaggcactgaactaactgttaatgagagctaagttttaatgagaataattgtaaagaaaaaaaaagaattaagtgactgtttttctctattggactttatactttattagagtccagagtcaattgttttcgctctagcaatcaggctacttatatctgccagctttcctttatgcttatgaatcttgccaaggaaaacctacagagaaatggaaaatgctttcttaggaagtacacatctcaagttcagaccttccagccccaaaatgctctaccatatctatgccccctcaatgtgtttgcatactggctgccagaaagaagtcatttaaccttgcctggtctctgtctcttacctatgaaatgggtgtaagaatcataagtacatttaaaaactttctctgtagaatgtgtatcacaagaagacagatactggagacagaaagacctagattcaaaacaatgacctactgatgctatttctgtttcagcctgttgtttaattttttctatttcttcatccacaaaagttgggataataataataatgccacttcaatgaaaacctctggctcacagtgggggactcaacaaatgctcttggtttcattaggagtacaaactttgaaatgataatgaggtccaagtcatatcacaaactctgtgtccctttggaagtctcttaccttctctgaacttccaataatagtaatagccccaatacaatgagagactattttgaagattaaataaacacattcaagtaggttagatatccagggcaataattagtttaaaattattgttttatttccgttgtgccatcattacagaatgggagtgatcttccagtaggatagggtgcttataactgaggacaatctcgtaagtgtggtacctacacagaagtcattgatgtcattggaatcaaaagtgcgaattaatcttggggaagtagtagaggagcctgtgctgagagacaaaggaatgagggttggggaaggaggcagagaagtacaggggtgcccttccacctacatgatagtgaaccctatgaggatgagaaagaaatggcagcttttacttaatcatcctcatcttcaacctcaagaatgtgattgctagaaactgtgcaagccaaaccacagacagagctaccaggcaattcatcttccattcagatacggatggtaggggccagaccaagtaatcattaatagctgaagtgcacagatcatctttcagttttacacagacagatagcttgggaatggcttgttcattgtggtctgtctggatctgttggaaaataaaggaaactcctgaatgctagcaaatgttttgaaaaggcattggcagtcagcacaattttgaagtgcaggaaactctgtttaacctccctccctctaagccccacggccacttattcctctttgttctccccttcccttgcattctaagttccgagttctttttcccaattcaccatcatagataataaaaattaagagaattattacgctcttctcgatgttgatggtggtgatgatgatgatgatgatagtaatacctagatgatggtggtgacacatacctttaaccccagcacgagggaggcagaggcaggtggatatctaaattcgaggtcggtctggtctaacagagcaagaccaaggctacttaaagaaaccctaagcaaagaaaaaaaacaacaaaacaaaacaaacaaacaaacaaacaaaaaacaaaaaccaaaccaacctcctctatgctcaaggggtaaactctgagtaatgagaatcagcttagcttaatatgacagaaaatatattgttgggcattttttcttttggaaccacaacatgaatcccatattcatatactagaacgtagtgatttcttaaaactgtatacttttaaagttgagttgtttcttaattggttggaaatgggctctgctatttctatcacgtttttcttcactgaattttattggttaacatattttttttttttgctttacttgtccccatactttaccttttctttgttgtagtttataaaagcaaattataatggacctaaggagagagatcatttttaaatcttgttttgttacaagcattgtaaaggagagccgcttgtatatttgcctgccagcagtagatggcagcacagactagctggtaaaggatgcagggggtggggacgccattttaattggacagcagttaaattctgaagcacaatttcatcaaaatggttgtctcctaagaatccttatgaaaagatccatttccagatttttttaacacaacataccatggaaataatggttgaataatttactaccataaagcctcattaactgaaccttgccaattgaaattggctgtatttcagaaagtggtttgagctaaagcttatgtgctttttgatcagtctatggaaaagagtttgctcagcaactgcatagcaaactttctctgaaaagtataagccattttaataacactctggtttcaagtgactttaaaatcatcatttcatcaaaagaagaaaaaagatccaggcacttacccattaataactgacttgaagaaagatggatttagtgatgtggaaatccattagacaatttgaaaaataaaatagcaactcacatataactaagttggtggcattctagagacataactcaaataaaataaaatatattcttccacctttcttgaaccgtggacactttttctttcttttcttttttcacaatgaaatgcctaattttgcttgtacttaattccacaagcatttactgagtacttgatatattttatagcttgtgctgtataaggacacaaaggatatactagtggataagactaggttcctattattaaaacagcctaaaagatgatgtgaaagtaatataagacacattaaggaccatggaagaaagttagtgctagagagagagaaaaaggaagttattaactttatttaaagggatcatggagacatcctagaagtgaaatcccagatagcctttcaagcaggaagcttgctgttggggaaaacacgagaaggatgttccaggaccaagaagcaatgtgtgcaaagtcttgaaggtacactgtaattaataaagaatcaaagttagaagaattagttcatcagtttaacaaaaactgtaactctttcagaagtccagagtttgattcctggcagggatattgggtggcttataatgtctgaaagtccagctctacaaaatccaatgccctcttctggcctccttgggtacccaccttccttgcacatgtgactttccctctcctctctctccctatcactcttgttctctctgtccttcacacacacacacacacacacacacacacacacacacacacacacacaccacctacttccacatagtttctctcacactcacatataaaaagtgaaaataagaatactcttaaaagagttactcttaaagtttttttcttctactagctgtgtagaagaggtagcttagctgtcactactaaacgggggctgctcaggaattacacttaatattctttggttagagcataaggttctagctgttaaaggtgcaattttaacatatggtgatctttgaactgggtgccaaggactttgacccttaattataggtgtcaggtatgtctggtatcaacattagagactcatctgaccaggtctgtacttaaagcatcccaagagaggtgcagagcctgggtggacatgacaatgcctggcaaaaggaattctaattaggagatcattagaacaaaatatgagaggagtgtaacagaagcagtacaattaaggaaggagtgagttgaaaaaaggagtcagggaagaaaacagataaagacttagcactaagtaaacctcatatgcagggagtgaatgcaagggatgactcaaagatgattctcagatgtctcaccagactgcttagaggatacattgacaggtccactgcttgaggcagtggattatagcaattcttacagtatctgccatactaaacccaactgaaacatgagcatccatttccaaaggaaagtgaaagaagagagaaggggggaaaggataaaataaaaccagtatgaaactgtcaaataataaagaaaaaaataaagtgcaaagcccagtaggtctggagcatggctcagttgatggagtgctaacctagcattcatgaagctgcggtttctgtccccagtaccacactcacaggatttagtggtgcacactcgtcttcccagcacccagaagatggacataagagggtcagaagttcaatgttaaccttagtcaatcaaacactcccatacaaatcccagtaataatagatctcaaaactgatatataatccataattgaaacatttagctgaatttttccttgaatgtatactgtcatttattaggttttaattaggtcctcaaatagtcatctaaattagtgtgaggtctatctgtactacatggtactctatttgaatatatgttttcttataccgattcaattacttgttctgcgtaaccactgcactgggcaccaaaattaaagggatgaaagtacagatttcctgacttcaaataaaagtatgtctattttgttaagcgtgatcctggaagacttcagacaggctagtgctctgaggttacatttaggtaataattaggaagtcataccttagataggaaaggaaatagaaaagcatgtgtgaataactactcaatggtggatggtgagagcactgctaagatctaaagcagaagggaaggaagacaggagaagaacaattgcttaggttggttagggaaaagccagatgcagctggatggtgaatggtcttcagtgttcagctaagaaatctgggcttcaccctgtagcaagaaagaatttttcaggactatttaggaagtaacaagagtgaggtgcaatgcagcgaagttctcctatcatcctgcagccctaccatctagagtttcgccttctcaactgcaatcccatcagatacctttcagaaaccactctgtaatctcatttaggtttcttaggaacccacggaagataattgcttcaacattccacccaaatcttgcaggcaactatcataatgacaatgaaatatgcctctctcttagagaagcagacattcgtttctgagcagccctgctcttctctattcatgcacttcatgcattaacctttattaaaatagcctcgttataccccgactctgctgtcaaacagcaacaaagaaactgctaatatgtgaagtatttcttcatgaaatgtttaattgttgttattcgttgcatatgcatgtgttgtgtctgtatataagtgtgttcgcacaagtgtcagtacacctgtctatacaggtacatatgtgttcaggtgcatgtgaaggctttaagttgagtagggagttttatttgctcactcttcacctcattcatcaaggcatagtctctaagctgaactccgagctccttaataaaggtgttctagctatccctttctttcaggatcccatctttgccttctaagcacaagaagtacaggtgtgccatgatgtccaactggtattttatacgtgtgttcttggggatatgacactggtcattatgcttgcaagtgctataaatactgagccatcttcttagcctcccaaattatttatttacacacacacacacacacgtatacatatatataattttgtgtgtacatatacatatataatgtttgtaaaatctgaaataaatttaaaaaaacattgaggggtgagagaaatgacttactctctaaagtggttgctgttcctgagttcagatcttcagcacatacctaataataagggtgtgtttgtgtgtgcacataaccctagtgctggggatgttgaaatggatctatacgatgtgttggcctgctaggcttgccaagtcagtgtggtctaggttcagtgagaaatccgtgtcagaaaataagatggaaggccatagaggaatacacctaatgtgaatctgtcatctccatacacgcacacacatgtgcatgaacacacacacactcactcaagtacatacacatgcatgaactatacacaataaatattgagctatacacttcaaatgggtaagttttatgatatttaagtcatatgtcaacaatgctggccaaaggttttgagctctagtagagtcctaagttaagagatacttattttgggaaagtatgagtcttcttactttatggccagacttcttcattagacccatcctcctagcatggaactagtgaacatcaattacttgataggtttcatcttgtgaaattaaatgtagtgggattcttgtcttttcaccaatttagaaaaattatcttgtagaatcatgggtccaagttttaggtattttaatttcctaatctataatattgattttatgataaccatttttaataaatgctgaacttttgtcagtccatttcttgtttcccagatatcagcagtttttaatataagcagtatggattattatcactactttaatatatttcagagtattttaaacaaattaagtatatttttcatatacattgtgaaagttattgaatttgatataatttttactgttaaaaggaaatcagtttctctctctctctctctctctctctctctctctctctctctcaggaagcattgtgagtgttggggacccaaagaagaaatatacgagatttgaaaaaattggccaagggtgagtaatttttattttaaatatcaacaacgtgcacacattcaagtttactgacatctcagatatcccatcaattcatgactcctgttctctgtattatcctgtgttttgtataatcaatagttttctttttgtttttttccgtgctggtgagttgcttggtaactaacatcaaaacacctgctactggaatcttcactgtctttgaggtgatactttgcagtgacattttgacatccatatcatgtgcacattcacactaatttatctagaaaagcaatagagttaggggaagaagtagcttatctgaatgggctcattgcattgtgccctcacatccaaatgcatgtgtggattagatcatccttctttgtcaaactgaacattggcagaaagaaaaggagaaagcccttactgaatgatcaagggttgggcaggcttgactctctgagtactgacaagataaatcaatagtcctgaaatgaggaccaggtctgtcattttcctctactgtacttgttaaagatgtggatttccagacccaactcaccagatatctgaattcgactccaggaatgataatcttgttttttaaaaagtcctcagatgatcatcttcagctagacatgtgagccaatgttgaatcattcactagagatagatgtaggagtcacctgctctatagctcaactggaagtatacatctatctcaagcctcagtgtaccacagccccagaggatgcaataatatttaatgagagttgctctttctcatccatgtagcaaatttaattaattttattcatgtccaagtagaaaataccgcaagacaagtagcagaaagacagtattatatatcacagcaacacagagaaatggcttttagattttattctctgttggttaaaagcaagaaaagatgagggctgcacagatggttctgtggtagagcgtgtacacagaagacagagttgaggtctcagtatccatgtcagtagttgcatctcaaggggatacaatgcttggtctggcttccataagtacctgcactcctgtgtgcaaatccatacacccacatataattaaatcatttttaatggatggatatgcactgtttgggcaaaaaacaccacagattgtcactattcctcatggtagctgtatttggcttagtttcatttggctattgggcacttgctgtgttgctgtccaaactggaatgtgtatgaaatatctcatagacaatttgtgtgttgattgcctatttgggataatattttgattgcatttgtcaaaaacagcagttctcaacatgtgagtcacgattcctttaggggacgaatgcccctttcccaggggtcacatttcagacacataataatgatacatatttataggtagcgatgtgatgctttgatatcacagctgggtgggatggtaagctaggtggcacagcagggaaaaacatttgccatgaaatcttgaccacccaagctcgattgccagaatccatgatgaaaagagagaacttactccaaaatgtatactcaacacacacacacacacacacacacacacacacacacacacacacacacaccatgcaccagtgcacacactataataataaaataaaatttaaaaatatattacatgatgttcaaatcagagtaaacataacgatcttcttggtaaaaattcaaaagacgccttttagctctaaaaaatatatttgtatattatcattgtaggtatgctactttttaatagcacacagaaactccttgctcctatctaattgatggcctgctttcctctattctcccctttcccctactgtaccagagcttccttttccccacattgtcaccagtatttgctaccctttgtctttttggtattaaccagtcttcttcttctggtagaatgataccttctcatggtttttatttgatttgaatttccctggtgatattgtccatgtgtgtcagcttttgaaaacaatcttttgtaagtaggatttggggctttttattattattattattattattattattattattattattgctattgaagttttattttccttatgtgttctagatcctaagctgtatcacatatattctctcacattacatatattctggaagtttttacctcattgatcaagtctttgcagtatagaagcttttagctttatagaatcatatttgactttgcttacaattcacaatctacttctactgaaaaatcactttctaaattagagtttcaataaagtgctttattatgtaactgggttctgagaggtgagaaccggagatgtgcttatattttgattatttgttcccactaagatacagctgaacaattcaatagcattgaatttaagaagtgaaacaaaaacaaaaccaacaaaaaatatttaagagatgatttaatatatctgaggcaatggaaccaaattaatagcttcaaaaacaaagattaggccacaactgagtgacttggatcctcaaagagatttcctcctgtgagtgctaatcacacctggatttgtgaaggaaaaaatggaaagttatatatgaatacctttataaagtatttatcacctaaaattagggggcaggcaaacatgctggcacacttctagtctcagcactcaggaggtggagacaggattaggtgttcaaagtcatcctagaaaccttgacactggcctaggcgaccctgtcatgaaagaagatgaaaaagaggaggatgaaaagcaacccccccctcaaaaaaaatcaatcgtacacaatttaaaataagcagcatatttcctatttggtacagcagcaacatctgttatacattcccagagattgttttttgaaaatgatgaagccagttgacatttcagtcataataagttcttagagattaggaagtctactgtgtttcttcttttgtctccattagtgtccagcacactaagcttagcctagtggcacatattttatatctagtgggccctcagatttttttttgtacagttatgaacaacagccaggctcaaagatggcttgcagagcttctcctgtctgctggccccatctctttgggattcttttctggaaccaaaacaaagtgtttttctatctcgctctcttttttatccatctattttcggccttttcattttttatcactcgtttcctcagtgcatcttcgttcctttttctttcacaatggcttagttttccctggtcacaatgcatggttgctcctctgctgtgtgcagcacatctatctttttcgtgcccattggcttcacctttcactgacaattttctgatacacacacagcacaaatagtcttaatataaaaatctaacaaattttaaaactaaaatcaacatgcacttttaaaacagctagtaaggtataatgtaagagcataagtttgttttgggggattttataatttattatactaattttaatttaatcattttttcccaatggatcattccttactcttaaggttttggtgaatgaacaaaatattttctctagattaaaaaaaaaacacttatattaactttgtttttacttaaatggctcacaactgatttttccatgaattattgccctaagctaggcaatctagtctgtacttccaagacacagtggttttcttttcttttcattaagtcttggtttttattgtttcagtttacctattgttatggtgactttcaaaatcctgtcactaatcatttcgtgctaggaacagtcaacctctcagtattccattttcagctccagggagcacaagagctctatcttccgggctgagtttaagaaaaacctctccattaatcaccctcattgacttggaaaagcgcacttttccagtacgggattctgccatcccaacattcaggcctagggccatagaattaagtttcattgaccataaatcaaaactcagaacttcacgtctaatcattagaagccagaactgtgagcctgagctttaaaaacgacagaatttcactaagttttctatgaaaagtgtcctacaataatgcctaccaaatctagacattttgatcagatgtgtagagaaaggatgagaaaaataaaaaaagagagaaggggagaagaaaggagaaagattcagatagtcccccaaattgttatctcaagaactgtgtcaaagtagaaactaaagtattttcaactctattttcaacatggatggtaaatggattttgataagacaactgaatcacatatttttcttcagtcaacaaatatcatcagaattctgtgtacttcctaaataagcagcaatagtgtgacaaatcaagggacttagtaaggctagcagctgccatgtagatatctcggtgatgtgtatgaattcatttcaagatttttttctcaaattagaatgcactgaaaaatagatcacctttactttcaaagccatagtgtctttctgaacaatgttagtggattagttttgtaaagaagcatcacagatctaaactgttttagatcctgcttagcaaatacttaaatttagtgaacaatggttgagcactcactatgttaaacgtagagctataatatataataaggaaggctgtgggttgagtggagtgcctttaattccagcagtgaagaggatctatgagtttggggacagcctagtctacatagtaaggtcaagggcaactaggactacatagagagatcctgtcttgactcccacacctatttaaagaaccagattctgctagctcgtggtgccctttctatttattaactccctgaatgtctagcagaaagaaatggttcgttgtattaagaaataagctaatcgctgggactctagttctacaatggcacttgcttacaaaatcgaggttccattcactctagaaaaagaaaaagattctgggctaatatccacttatcagtgagtacatatcatttgagttcttttgagattgggttacctcactcaggatgatgccctccaggtccaaccatttgcctaggaatttcataaattcattctttttaatagctgagtagtactccattgtgtaaatgtacaacattttttgtatccattcctctgttgaggggcatctgggttctttccagcttctggctattataaataaggctgctatgaacatagtggagcatgtgtctttcttactagttggaacatcttctggatatatgcccaggagaggtattgcgggatcctccagtagtactatgtccaattttctgaggaaccgccagactgatttccagagtggttgtacaagcttgcaatcccaccaacaatggaggagtgttcctctttctccacagccagcatctgctgtcacctgaatttttgatcttagccattctgactggtgtgagatatgcccagtacaggggaacgccagggccaaaaagtgggagtgggtgggtaggggagtcgggggggggggagggtatgggggacttttgggatagcattggaaatgtaaatgaggaaaatacctaataaaaatattttttaaaaatccaaaaagaaagaaagaaagaaagaaagaaagaaagaaagaaagaaagaaagaaagaaagaaagaaagaaagaaaggaagaaagaaagaaagaaagaaagaagaaaaagaaaagcaggagggtgagaaggtggggcagatccattctcaatgatgagaatttactctgtaatgatctacactttcatcttgccatctccccttgaatccttcttgagctgcccaggccttcattggcattttctctcttccttccttctgcctcctgtagatgatacccataacagcttgtatctagtttttacaaattgtcataaaactttttaaaacataagaatgggaaaacataggaacaattaatgagaaaaaagtaacattttgaagtcaaaaggctatgtccagcctaatttctttaaacatgtttctctgttcatagtaaagcagaatgtgcactccctaagattgaaaaactaacaagagaaggcttttagagtgcctagctaatcatgtgtcatgtgcgtaaatattctgttatgctagtttttactttttagttattatttggggtgactcacccatatgccattatgacatggaacagaaaataatgaatattatagtgcagtcacagagagataaggggacaaagagaatgaatacatgatttatatcaaaagaagggctatgaaaatgaattttcagaagatgggtcattttatgatttgaaatggtataagaacttaagtcatgagatttccacttgaagtacactacaatatttgctttagattctttagttttatccaccttgttgtccttagctctacaacagtgcctgttacaaattctcactattagttgaaccctcattaaaaagagaagaagaaaacgtagacattggactcatagttaaggaaataatgctagaagaatagatatggcataagttatgaaacaaaatgagagacacggttgtaatgtgtgtgaatcaccctttctctgctgtggcaaaatagctgacacacaaaaaaatataaggaaagtttttattttggctcagtgtttcacaggttttagtctaagatctgctagttttattgttctgaagtgagacagaagtcatgatgaaaagttgtggcgccgggcgtggtggcacacgcctttaatcccagcacttgggaggcagaggcaggcagatttctgagttcgaggccagcctggtctacaaagtgagattcaggacagccagggctatacagagaaaccctgtctcaaaaaagccaaaaaaaaagttgtggcaatcagaaagcagagggagttataagatgggagttataacatgataaactcttcaggggcagaaccttagagcactactttctccaaccagatcccatctcttaccagttactacttacctaatcatagaggcagcgctttcctgagccattaatttcttttttttttccattttttattaggtatttagctcatttacatttccaatgctataccaaaagtcccccatacccacccacccccactcccctacccgcccactccccctttttggccctggcatttccctgtactggggcatataaagtttgtgtgtccaatgggcctctctttctagtgatggccgactaggccatcttttgataaatatgcagctagagtcaagagctctggggtactggttagttcataatgttgatccacctatagggttgcagatccctttagctccttgggtactttctctagctcctccattgggagccctgggatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcattctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctagggatttcataaattcattctttttaatagcttagtagtactctattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtacaatgtccaattttctgaggaaccgccagacggatttccagagtggttgtacaagcctgcaatcccaccagcaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttcgtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccatttagatttgaccttagtacaaggagataagtatgggtcgatttgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctggacagataccaggtaccaaagttgaatcaggatcaagttgaccttttaaacagtcccatatcccctaaagaaatagaagcagttataaatagtctcccagccaaaaaaagcccaggaccagacgggtttagtgcagagttctatcagaccttcaaagaagatctaattccagttctgcacaaactttttcacaagatagaagtagaaggtactctgcccaacactattactctgatacctaaaccacagaaaaatccaacaaagatagagaacttcagaccaatttctcttattgaatattgatgcaaaaatcctcaataaaattctcgctaaccgaatccaagaacacattaaagcaatcatccatcctgaccaagtaggttttattccagggatgcagggatggtttaatatacgaaaatccatcaatgtaatccactatataaacaaactcaaagacaaaaaccacatgatcatctcgttagatgcagaaaaagcatttgacaagatccaacacccattcatgataaaagttctggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctacctcttcaacatagtactagaagtattagccagagcaattcgacaacaaaaagagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagtcacaaataatatgaaatatctcggcgtgactctaactaaggaagtgaaagatctgtatgataaaaactgcaagtctctgaagaaagaaattaaagaagatctcagaagatggaaagatctcccatgctcatggattggcaggatcaatatagtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagccattaatttcttaatgcctcctccacctgctggagagcaagctgccaacactggagtctttcggagatggacttcatatccaaagtagaatacttaattttaattgtgaaagtttaagtttttgagaagatactagttggctaaagcagtataacatcaagaacttgtagaaaaatacacaataaaatgggtgtcatttcagcatgcgtcaccagatttccagttattctgcatagaggaaactttcagaaagaaattactgtttgtttcatttgaaatactctcttttgattcactgtttaaaagtgcagtcaagcacattctcgcacagatttcatatacacttgaatataagctgagctatgaaataatttttaaaataaatttggggtttgactttcctgaatacatgtgctattaggtatatagctgcttaaatgtttaagttgttcatttgctccaacttacgtatttaaaactgggccttagacacaattatatatttgtttggtagatttttctactttctcatttcacttcgatatctttctaggtatttttaacatcattgcgtttataatttactagagctcctttaggagtcccatggcagttatataaatatatcatctgactcccatctaagatatttcagatgtgaaatccatacatggctctgtctgtggatatgctaactctttcacaattacacagtcatgtagtattaagatgattgctttctgaatctgcaccttttctgttcatttatatgcatatctacactataacttttatccaaatttttggatgtactataccacttgttaatttttattacaaatttccaaatgttcacgaagtagagaaaatacccatattcactcacctaaatgtaacacatttgtatttatcagctgtttttagtaaactcacaatgacttgtgagacccaaaaattaattgttcaatatcatctaattcctagtttttcccaatgctatttttatagttctattaaagttaacaatcaaaaaaatctacacattatgttcattttgcacttacatttctgtactctaaattgccttttgtcttctaatttttagctttccagcacaattgacttattaaagaaactggtcattgtctgatagaaagcatcatctctgtatttcctacaaatggaaatcagctctaagaggcttagattcaggttcagttgttgacagtattcttcatagatggtgctctttcattttatactacttcaggatgaagggtttgattgtcccctattttgatgaggagtggattagtagaaagattcaaagcaagactatcccctcccgcttcaagttcacatcagtctttcatataatagaatgctgattgatgattattgctaaaattgatcctttcattaatgattacaaaataataaattcattaatctatcattcctgtacttattggcttgcatacttttgttgaaaagaactacatttagtcacctagaactctggttacagggaaatattcaaataaagataaataccttatttattaattatcaagatttgatatgagtcagtacccaaattacatacatcaagaaggctttcttttatatttaaaatatttttataaacttataaatttcatatatttgatttcattgttgtttttaatagtcagactatgtctttggctagtgataattcctttccctgcatcagttttgaaagagttctagaaaaagcatatttatgatatctaacacttgagttgtaaggacataaactctgaaattattaatttatttcctttccaattctgtcactctatataagcatctaaatctcgaataaactgaatatactttaacccagtatttatttcttatataatattaagtgtctaaaaacaaatgcttaagagcaatattatatgatatatttttaagagatttgagtataagacaactcttttggagaggacaaacatttatctgtttgctatggatatattttagcttaaatagtggcatactatgtagctttctctgttatgtgcctatgcttaagaggtggttacatataagtatcttgcttttttaaaatatatgcccaatgttttgcatttgtatgtatccattggtggacatttagggttgtttctgatatattataaacaaagctctcagtaatgacctttgcaaataaatcatttcacatttaagcaaacttattagcataacttcagaagagtagagtttttgcatcaagtaatatatgaattcaaaatttctgagttcctttgcataaagatcttaaagatagctaaatttcatagtccaacaatagcttataaacatgtctgtttgcaaatacagttgtatttggagttatagtacaactataaaaactcatgcccaccatgactttttaaatgcaatacatacatatgggacaaaaatgtgtctatgcggaagatttgtttgccaatatccaatatgtatataatgccaatgtcatgccatatctctccagggattaactcaggtgtatatccaggtttgacaaaaaaatgacaatgagaacacttattttaagatcactttactcctagacattaagacatacatatggccaaaggaattttatgcaatttctggacatttgtcaattgtaccatcaaactaatgataatataattaattcactataatgacaattaagctatattactagttcatgtgcaatcaaacacccaatactggcccctttacatttcttttaaagttttaaaaagtcaacatattatgttatgtatttttcagatttttccctaatgttccatgaggagtcctctttacactctcaggtgaatttcccacattgaagatgaatagttctaaatgttattttttaggggagtttatttaatttttaggttaatatatcaaacaaaatatatcatttagttatggcatgttcatatatatattcctatactttgctctaatttgcgtgcatcccagtgccttcctttctcaaaggagactacgaatagcttcttggtttagataacctaccaaacagtatgctgcttagaactcatgggtaagtgctgagaataaacctctgacccatgtttttgttgttgttgttgtcctcctcattcagagtaagaatagaagttgtgtctagtgtgttattctttgggttggaccacccacccaaaaagcatatgcttcctcattggatctgctttggaccacacaaggcagaagacttctatggggcactaaatagaccataatctaagctctataataggttttgtgatggaggagattggaaatacattagcatttgtttataggccaatggaagatgccctttgttctacttaatgcacttaaatgccttgtgttgtatgctgtcccttgtaaagaaagatgatgccacacattcaaacgccattagcagagattacacattaagtttttttttccagccatagtaatgagcctctattaagccagctgcccccctttcccgtccaggccctcttgaaaccaatggcacacactttgaaacagctgctgagacttaatgttgaagtgagtaactgagagctatctggcatttccagggattaagctctgtaactgtggactcattatcactggactataacccactgggttttctggcctcacatccatagagtgttacagctctgcttagaaacagatgaccgtgaatgatctgggcagagctatgtcctagctaaacaacagaaacatttcccactgcattttatcatctaattaaatgttgtaccacctggctctaattgtattctatatacttaggtcatcgggtgatgtgacctacataattttattctattttactttttaccttagtgacatatttttgagaaaacaaaatttcctgtaaaacaatcaaacaaacaaacaaactgaaccatcactcctaacatctttgcatacagtattcttcacaatgcttaatggatatttaagtgccattcagagatttttatatccattcaggttgaatatgttttatatttactctcatattcattcagcacagcaagagcatgtataatagtatcaaatgaacatttgtgaaccttcatgtcaagtgcatttatatagtaaatcaatttctatataaggacctagtaagtagtgcccttcttaaatattcaggacagttccgtataaatctcagccacatagaatatcttacttgagtaagaaaatcagaagaactaccatgtatgtttatgtcaaaaagaataaaagacatcatgccctgggacaaactgaatggggatgagacaaacatgaacatgaggatggcataagcagaaaacagagaggtaacgagagaatttgggggtggcagcctaacataacagatacaaataggaatttgaggaagaaccacagttgcacttagtattaacgaaaatgcttaagatctaattttaaagtggaacagttagctttacagaaagatgaaatcatattttcagaaaatggatgcaactggaaatcattaagttgaacaaaataaaccagacttataaaaacaaatactgtatgttttttctcatgtatgaaacttatatttaagggtgtttgtgtgtgaggggttatttttctatttaaattccctttatttctttacttttttagtgtattcactttacatcctgctcaccacctccctcctggtcaccccctcccacaatctttccctcatcccctcttccctgaaaaaaaaaaaaaagagatctcaagggaattgggaaaagaaggaaaaacgtgtaatggaatatatgtaacatgacaatagaaaggatatggttgttgaaagagaagatcaggcatggaggagggtcacagtgaagggatatgaataacaaagtatctatggaaatgccataacaaaattcattaatgtgcacattaacttacgatataataaaatgtaaagaaaatggaacatgaaaatgacgttactaaaaaattaagcaaaggcatcaaactggtgcatttttaaactcagctattaactgtataaccagaacaagctattccccatttgcccagttgcaattttactcatttgaaaaatgaggcaactagagttgcacttagtggcactaagagaactcattcatttgtagagagctggcagagagacagtcccaagaaatgtgaaagggatttctaatagccacatcaggaaaaggaaaagtagataggaaaaataaccatactaaatgcagcttatgatcccgactgtgacctcattagcaccaagcttagacttgtaaaacattaagagggaatagcacctctgcctctggtgacctcactcattccccgccccccgccccccgccccccgcccccccccccagctcgctgtgcactactttgcttcctattgctttttttctctttatgtactctgcaaagttgctcttagccttactttcttgacccccatcctctaattcattcgcatgttgacatcaaagtgatttacctcaactgttagcctttccatgttgctgccttggcaactatttaacgtgatttgacattgattcttagaaaaaagaaaaaaaaaagaactggtagaaaatagtgataaactgacttgtggggaaaggggagagattgtgaattgtttgttcctttctagacccttcaggctagatggcagtgtttccattagatggttatgcatttggcttcatcaaggacaacctactgataaagcatctggtacaaagccgagagctgtaattgatgagggcccgtagttgagcattctgttagtttaaaattcttccatcatgctggaggtttaaaagagttctacttcatagttaggagagcattgttacttagttgtttcatatcagacatatccttcccattcttggggcttcgaagttccagtctgtaatgaggaggttaaacttggatggcctggttttccattcaggtcttttaatgtatgatttccttgtaccacctgagggactgagctttgcaataaattaaaattcctataataaataaatattctacttacagcattagatatctaaaactaggatagagggataaaagaataaatataattggctggcaaaaaataaaacaatcaaattgacaaactctttgtccgagaataaagggttttatcccaatttttatcagtttgatttctgtcatctttatgtcctaagatgccaacagatgattgttttaaaattaagatgaagtaaatttttattgtgtgtatatatatatatatttcatcatgttgcagtgtaagcatatgcactaagatatttcaatatactccaacatgctacaaggctcatcttttgggaatctgtgtgcaatgtgcaatgtgattggcatagagaatttcttctttttacctttgtgctttaactattattaagagagggctattagctttaccacctacaaatcacctacaaacaaataacttgttacttgtttctgtgaattaggctatgcaatcttgaccacaaattgcatttattatgagttgaatgcttatgttttatcaagcaaaagtagttatatattactagtgtttagatattttaaaaatcagaatgtgatattcaacactcatataataaatctgaccaagaaaggaaataaatgtgatatttgaattaccactatttaaggtaaatatttaatttctattattaattttgaaacattatgtatcttgaaagctccaggtatgtagagagcttcctagtcatctatggactacaactgggaagatagttgctgtattagaaaacaatcaacaaaatagtaattattaatacttatttggcacttactatgagccagagctgtatgacttttaaggcctttagcattcatttactccaccttcgaaggtaaattactgagagtcacaggtgtaagatttaaaccagcagagatctgaataagtagtcatgaggaatgctatcctcagcccagcagtgagcagtggaggtgattatcgatgaatcttgatggtaatgagagctcttggaggaaaaaaaggaaaggaaaggaaagggaagggaagggaagggaagggaagggaagggaagggaagggaagggaagggaagggaagggaagggaagggaagggaagggaaaagggaagggaagggaagggaaaagggaagggaagggaagggaaaagggaagggaagggaaaagggaagggaagggaagggaagggaagggaagggaaaagggaagggaagggaaaagggaaagggaagggaagggaagggaaggaaaggaaaggaaaggaaaggaaaggaaaggaaaggaaaggaaaggaaaaggaaaaggaaaaggaaaaggaaaaggaaaaggaaaaggaaaaggaaaggaaaaaggaaaggaaaggaaacctcccatgtaatcaagtcagaaatcaaccttcaattgctgaagtataaaaatacctgcgttcagtgatatattagatatgctcgctggagtggcaagaaggtagtaagtttctctacagtatctgaatttattcatttttagttgaaggtcccatagagaagttggtcaaaacaggaacttactgatcagtaatataataatatgttaggtttgcggatgctcatatgaacccatatttagacagaaaaaaagtgaggaggaggaagggggaaatgcctcccactgaacaattgcatctgtccatttaggtgaggggaggacagatgaaggtgagccgttgagttttagttcgtaactcaagctctaggatggcagggcctttaagtcagcaagtctatacaaatggacgttgtaactcctgggatactggagtttcaggattagagctctaagaattttaagacaataaaatgctgaaagaaatggagggaagaggcagaaaagaaaaggaagaaaacaacggatttcaaggtaaatctccaagatgctaagcactaatccctcttgcacttccactcaatcatagttttattccctccagcagcagaaatgcacttcaatggttggaggaacacccatggggaaaagtcaccatgcaggctagctttttgtcaccctagctttaactagagtagttccaatcttacttattttataaacccccatatatggttttcatttaatgtgttctaaacttaaagaaagggggaaaaaaagaaaaacgcaaaactatttctcaagggagaggttgaaccatccccatagagttttccaacagatcatccgttcaaaacccccacctcgagaaggaaagatatgctagcagcgttgttagggttggggtattaggaggttctagccaacagtcagtaaatcagttctcttctgctgtgaaatgaattgctccagcagcaataaggaataataacagcagtggccatattaagcttcagtgatgatctgggctcaaggccaaatgctttcttagattgtgtcatttgatactctgaagtaataaaagagaggaatttctagtgtctcattttacagatactgtctgtcattcttctgcatctggagctatgcatgtgttttagatatctggaaatgaaccaaataaagattttttaaaacatagtttgcaattaggtttgaggagctcctggggcttactgctgctgaagtacccaccaggttgattgagacaatctattcctctgacttcaatctaattatgagttcaaaaggacaagtcacatgctggctcccaactcaggaatgtctgatctcttattccaagaaggaaacgattcctgaagattcagttgtgtgaaatagtttccttattgaaaggaaaggtattgttgcaattgaatttttgcttaagaatgtttttaataaaatgaaaagaaaaaaagaatgtttttattcatgtgctcattcaacaaatatttattggcatcaactataagttctgaatatagaatctacaatctacaatattgtaaacagacctgtttgatatacgcatacatgttgagactcaccaagtgcttattcaggtaccacctagagagtaagtctgatatttagcctagtttcaaaacctaatttgaaagctgagtagaatgtggtttgtacattgaatagcctgggaaggctactcaatctctctgactttcaggatcctgatttatgagatgagaataatagagttgctttatgtataaatatagggagaatctcataaaatgaagtctataaacttctcaacactgtttcttacacacagaacacattcaatacacccttactgctactctggtcactgttttctttctgacaggactgaaattcagttaggggaaattgcttgccccaagttgcacagcttgtgatggtgaagcagtctcaaatctctgttattagtcaaagaagtcttatactacactaccattttcctcttcagggttcaggtgacataagtatcccaagcttttgagaaatattgtagatcatcaaaggagaagagttataaagaaatgcctgacatagagttatggctcatgacagtaattccagtatttgggaggctgaagtagaaagatcacagcaaggacattctgagttacataggatcaagacaaagaaagagagatatgaacagacagacagacagacagaatatttttctaaactcgacctaaatcttagagcattatagtacctagtaaatgaatcactggacagattgttatcctagatgttttgtttgccaccacgaaatggatacctcctcgactgaagataaagatgagaagatcttcagaaaacaaatgtgattcacagaaagatactggaatctcaactggacaatatattgtctctttgcaaagcaaggggaaaatctaagtaaagttaaaatagaagcagaaatactacaaagacttaaggaatgatagatttaaaaagataagtattttacaggagtgaagacacagaaaaatttcaaatttagcaaaaataaaaataaggaaggaagctctataacaaatcctgtccctttgtgtcggtacagcattgacacacactgaaactgatttattaaatgaaggattagagatgcataaaatagctactctgtccatatgctaaaaataatggttgagttacagttgcctaagcaaaagatgaactattattttctgaaatttactttagcataatcagaaggctgcaatatttgttgtttaaatacataaagaatttgaaaaatagggtttctttaggaagaacaaggctagtatgctaatttcactaatgcatagtgcaggacccaggaactggtgccagaaagtgtagtgaaaggtccacccagtccaccaaaggattcattgtgttagtctctgatgtaattattatataaggcagttgcatcagtactgtgcacttgcaatttgctaagacagaagatctagtattaagtgttcttttaataattgttgagaaattgcccctgtgcatcactgaatcttgatcttgctaacttaactcacctgaaaatgaatcacatttttcatacatgggaaaatatcagtaacacatgaattgtttattcattggataattttcacttttccagggcatcaggaactgtttacacagcactagacattgcgactggacaagaggtatgtgctactaagtgatctttattactatattttgtgtttatcaagttttcttgttgacaacttatgtcttagctttgggtagaactaggttaccatgggagatttatttgttggtgtgcaaaacatctgaaatagataatgactgaccaaggacaaggtgtaggtttgtagaacagattcaaaatcataggtaagtaatgtttatattcatggatattttaatagtcatcttcttgtattttattcctcaaaaggtggccataaagcaaatgaaccttcaacagcagcccaaaaaggaattaattattaatgaaattcttgtcatgagggaaaataagaaccccaatattgtcaattatttagataggtaagtgttttatcttatttgcatattttcttcctaagatgttattttcttgtctaattatttgtttaaaaatatttctgaaatgatacaaagtaaaagaggaaatctttgtgaagcatcaaacacctgaaaacatgtttgagggatctagttctaaatgtaagtactttgtatggcttccttcggaagaccatggcttcaggctgacaggaaataaactactacatataggagaaagcagtggtgctttcaacatttcatcaagtgtctgtttggagccatatggcccctgagaggctgagtaaagaaggcagacaacaacaaccctgctttaatgggtactttatgattaactgacagtgaggttgggggaaattgggactttaatcttaaacctttttcctaaagcaggcaattaatgtctctttcatcagtggtattgagtgtgttacaaataggcacttaaagacagagctaactcttctgccctggttaacatctacatctgtttctgctgagtttcagtccttgtgtgcttagcaccactctgctgagttctctgatggtatgcaaagggaataagattaggtctcacctctgtgagcttaagggcttgctgtcagtgttagttcaatagacattgatgtggtagcaagatagaaggatgactgaattttaaagtttgaatcggtgttttgtttgtttgtttgttttttccagtgctccttatggcccatctgcaacagtatgacatcaattccattctgcatttatagttttgtaaaacctcacatttgtaatttttaaaggggctgatttctagggttttctccataattaatgataatggaacctgtgaattttaaattttaagagatttgccttgtgggtccccaaagtactatgatttgaacagcacagaatagaaagactcatttcatagttagataggcttttgcttttgtctggtttgttctttaaatacccctgcaattcaggctggcctggaatttatcacatacctgaggttagccttcaactcagagctgccatgctttatcttcccaagtaggtgggattccaggtgtatgccaccagagcaggcttagccacatgcctattaaggcccagtggagtcattaaggttactcttctctctaagaagattgtgataattgatttcagtaacctcctactgttttcctgagtgctgaggctatccagtgacattggtccctgtttttgagcactgaagtttgttcctcaataatcatttaaagatacttggggtggctctgttcacaatcgactttcattacaaataaggcctgagaatattagagtctctacttctttaatccaaagtcaaaacgtttttgtttttgtttttgtttttgttttcttttcttatagctacttagtgggtgatgaactgtgggtagtcatggaatacttggctggtggctctttgactgatgtggtcacagaaacctgtatggatgaaggacagatagcagctgtctgtagagaggtaagaaaagagaacgtttcttgctggtgaatttgccaatgctttactggttattcagatttttctagcatcaaaatacctacagcatacttttctactgaaaaaatggaaaaagtattaatactatgagtcagtgccatgcccttgtttcacctttgccagacctttatttagttaccttcctgtggctcttataagctctaatatgccatttaggagacactgcatctaagctcatatgcaggagtgtcagtgaacatggccaattgttatgttctcatggaatgcctttctgatctgtggggaatttatacaagataatttttgtgttctgcatgttccatattaatctcctaaaatacaaactacattatatcctcattattttctataaggctattttataatttttactgtgtgtgtactttttggtatttctgtgtgtgtatgttcgtgtgtgtgcagtatgcgtatatatgaatatgaaataataacttttgggacttagttctctacttccatcatgtgggttctgggaattgaactcatgttgaaaagcaaggtagcaagtgttgtgacctattgagttatctcacaggccctagaccgcagtttagacagtttaccccaaccacagaaagtaattattttcacaggattctgtgaatattccttaaaaccctctagtgggcctgacaacctgtcacttaagaagagagataaaagtgcatttactttctaaacaatttgatggtgctttgttttattattttgatcaattttgtttttacaacatacacttttcagtgtagcttcattatgaaattttctacaaaatgaaatggtaactggaaaaccaatgagagtgcaactaagctaaataatatttggtaatctttctgataacacagttctcttctttttaaaaaaaatttattaggtattttcctcatttacatttccaatgctatcccaaaagtcccctatagcctcccccccccccactcccctatgcacccactcccacttcttggccctcgcattcccctgtactgcagcatataaagtttacacgaacaatgggccactctttccactgatgaccggcggctaggccatcttctgatacatatgtagctagagacacgagctccagggggtactggttagttcataatattgttccacctatagggttgcagatccctttagctccttgagtactttctctggttcctccattgggggccctgtgttccatccaatagcatccacttctgtgtttgctaggaaccggcatagtctcacaagagacaactatatcagggtcctttcagcaaaatcttgctagtgtatgcaatggtgtcagtatttggaggctgattgtgggatggatcgccagatatggcagtctctagatggtccatccttttgttgcagctccaacctttgtctctgtaactccttccatgggtgttttgttcccaattctaagaaggggcaaagtttccacactttggtcttcgttcttctcgagtttcatgtgtttcgaaaattgtatcttataccttgggtattctaagtttctaggctaatatccacttatcagagtacatatcatgtgagttcttttgtgattgggttacctcactcaggatgatgccctccaggtccatccatttgcctagaaatttcataaattcactctttttaatagctgagtagtactccattgtgtaaaagcaccacattttctgtatccattccctttttgaggggcatctgggttctttccagcttctggctattataaacaaggctgctatgaacatagtggagcatgggtgtttcttaccagttggaacatcttctggatatatgcccaggagaggtattgtggatcctccagtagtactatgtccaattttctgaggaaccgccagactgatttccagagtggttgtacaagcttgcaatcccaccaacaatggaggagtgttcctctttctcgacatccttgccagcatctgctatcacctcaatttttgatcttagccattctgattggtgtgagatggaatctcaatgttgttttgatttgcatttccgggatgattaaggatgctgaacattttttcaggtgcttctcagccattcggtattcctcaggtgagaattctttgtttagctcagagccccactttttaatggggttatttgattttctggagtccaccttcttgagttcttcatatatattggatattagtcccctatctgatttaggataggtaaagatcctttcccaatctgttggtggtctttgtgtcttattgacagtgccttttgccttacaggaactttgcaattttaggaggtcccatttgtcaattctcaatcttacagcacaagccattgctgttctattcaggaatttttcccctgtgtccatatcttcaaggcttttcaccactttctcctctataagtttcactgtctctggttttatgtggagttctttgatccacttagatttgaccttagtacaaggagatagaaatggatcaattcgcattcatctacatgatatccaccagttgtgccagcaccatttgttgaaaatgttctcatttttccactggatggttttagctcccttgtcaagatcaagtgaccataggtgcgtgggttcatttctgggtcttcaattctattccattggtctacttgtctgtcactataccagtaccatgcagtttttatcacaattgctctgtagtacagctttaggtcatgcatggtgattcccccagaggatcttttatcattgagaagagtttttgctatcctaggttttttgttattccagatgaatttgcagattgccctttctaattcgttgaagaattgagttggaattttgatgtggatttcattgaatctgtaaattgcttttgacaagatagccatttttactatattgatcctgccaatccatgagcttgggagatctttccatcttctgaggtcttctttaatttctttcttcagagacttgaagttcttatcacacagatctttcccttctttagttatagtcacgccaaggtattttataatatttgtgactatacagaagggtgttgtttccctaatttttttctcagcctgtttattctttttgtagagaaaggccattgacttgtttgagttaattttatatccagctacttcactgtagctgtttatcaggcttaggagttctctggtggaatttttagggtcacttatatatactatcatgtcatctgcaaaaagtgatattttgacgtcttcctttccaatttgtatccccttgatctccttttgttgtcgagttgctctggctaggacttaaagtacaatgttgaataggtagggagaaagtgggcagccttgtctagtccctgattttagtgggattgcttcaagcttctcaccatttactttgatgttggctactggtttgctgtagattgcttttatcatgtttaggtatgggccatgaattcccgatctttccaagacttttatcatgaatgggtgttggattttgtcaaatgctttcttcttatctaatgagatgatcatgtgttttttgtctttgagtttgtttatataatggattatgttgatggatttccttatattaaaccatccctgaatccctggaataaaacctacttggtcaggatggatgattgttttgatgtgttctcggtttcggttagcaagaattttattgagtatttttgcatctatattcatagggtcaattggtctgaagtactctatctttgttggatctttctgtggtttaggtgtcagagtaattgtggcttcatagaatgaattgtgtagagtaccttctgcttctattttgtggaatagtttgtgcagaactggaattagatcttctttgaatgtctgatagaactctgcactaaacccatctggtcctgggcttttttttttttttttttttttttttggttgggaaactattaatgactgcttctatttctttaggggatataggactgtttagatcattaacctgatcctgatttaacctggtatctgtctagaaatttgtccatttcttccaggttttccagttttgttgagtatagccttttgtagaaggatctaatggtgttttggatttcttcgggatctgttgttatgtctcccttttcatttctgattttgttaattaggatgctttccctgtgccctctagtgagtctggccaagggttaatttatcttgttgattttctcaaagaaccagctcctcctttggttgattctttgaatagttcttcttgtttccacttggttgatttcgcccctgtgtttgattatttcctgttgtctactcctcttgggtgaatttgcttccttttgttctagagcttttaggtgtgttgtcaatctgctagtgtgtgctctctctaggttctttttggaggcattcagagctatgagtttccctcttagaaatgctttcattgtgtcccatatgattgggtatgttgtggcttcattttcattaaactctaaaagtctttaatttctttctttattccttccttgaccaaggtatcactgagaagagtgttgttcagtttccacgtgaatgttggctttccattatttatgttgttattgaagatcagacttagtccatggtggtctgataggatgcatgggacaatttcaatatttttgtatctgttgaggcctgttttgtaaccaattatatggtcagttttggagaaggtaccatgaggtgctgagaagaaggtatatccttttgttttaggataaaatgttctgtagatatctgttaaatccatttgtttcataatttcttttagtttcactgtgtccctgtttagtttccatttccatgatctgtccattgatgaaagtggtgtgttgaagtctctcactattattgtgtgaggtgcaatgtgtgctttgagctttactaaagtttttttaatgaatgtggctacccttgcatttggagcatagatattcagaattaagagttcctcttggaggattttacttttgatgagtatgaagtgtccctccttttcttttttgataagtttgggttggaagttgattttattcaatattacattgtctactccagcttgtttcttcacaccatttgcttggaaaattgttttccagcctttcactctgaggtagtgtctgtcttttttcctgagatgggtttcctgtaagcagcaaaatgttgggtcctgtttgtgaagccagtctgttagtctatgtctttttattggggaattgagtccattgatattaagagatattaaggaaaagtaattgttgcttcctattatttttgttgttagagttggcattctgttcttgtggctgtcttctttttggtttgttgaaggattactttcttgctttttctagggtgtggtttccatccttatattgtttttttttctgttattatccattgatgggctggattcgtggaaagataatgtgtgaatttggttttgttgtgggatactttgttttctccatccatggcaattgagagtttgtctgggtatggcagcctgggctggcgtttgtgttctcttagtgtctgtataacatctgtccagtatcttctggcttttattaatgtccttcttgatgtcctctactatcatcatgagatatgcttttaaatctgggtctagctttttgggtgtgttggggtgactagaactgggtgaggtgggagtgctgtgttctgatgatggtgagtggtcttggtttttgctagtatgattcttacatttgtctttcaccatctggtaatctctggaattagttgttataattgtctctggtgagagcttgttcctcccatgattctgttagcctttatcagcagacctgagagactaactctctcctgagtttcagtggtcagagcactctctgcaggcaagttctcctcttgcaggtatggtgcccagatatctggcgtttgaacccgcctcctgccagaagttgtgttccactcaccagaggtcctaagatcctgtggagagtcctctagggaccttgggggtgtccgatgactccaagcccaaggtgaccctgtgctggcactgaccggaagggacttgtgaccctggtccagcctggttttctgcttccatgattaatgctgtctcaggtccagtgcgattggattggaacagaagttgtgctccactcaccagaggtcctaagatcatgtggagagtcttctggggaccttgagggtgctgactccgcacccaaggtgacccagtgctggcaccgaccagcatggacttgtaaccctggtcaggccggggttttctgttttcctccacagttctcttctatttccttattctttgacccccacttcttcccatttctcctactctacacatacacatatagcaacaaatcatgttttcttctatgccagaaatggagttgatattcactttgtatgatattctacctgagcctgtattttgtattttttagtattaaaagacaaagacatttctttatatatatatatatatatacctatctatctatatatatgaatgatattttctttatttatatttcaaatgttatcccctttcctggtttcccctctgaaaatcccatatccctttcccactacccctgctcaccaaccccctcaaactcaattccctacactggggaatagagccttcacaggcccaagggcctctcctcccattgatgcctgacaaagccatcctctgttacatatgcagctggagccatgggtccctccatgtatactttttgattggtgttttagtcactgggggggctctggggggtactggttagttcattttgttgttcctcctatggggctgcaaaccccttcagctccttgggtcgacaaggacatttctgaacaagtacctttagtgactttagaactggaagccatcctcaaaattatctgaaatgtacactgaggattacaacaactgaatgagaccaagctgaatccacatcacctaggaaactagagcagagcagagcagagctaggctaactggtcagtaggactgtagtgatgactagtactgtttcttgttttatcctcttcatggtttggcttatagtatggcatgggagccctcaaatacagaagatcaagtatcctccatcttgtaaatgctgatgtgatttgaaaatagtgttaaagcattcagtactcaacttcacttagcaatttatgatcacaaactttcccaaattttgcctcgaaatgatatatagaatttaaaaaattctttgtgatataattagaactttttcctctgatccaatagtgcctccaagctttggatttcttgcactcaaaccaagtgatccacagagacataaagagcgacaacattctcctcgggatggatggttctgttaaactgagtaggtattttcattcggaaatatcagggaatttctgatgttctaatgtctatcttgagaaggtaatgactactaaaagtgactttcctgaaaacaattagatcttgatttgaattaaagaacctgtctgatagtctcctcctattgattataaccagatttagatttcagatttcagattttagattctagtggtatctaaaattaatggatggcagataactaactctaagatggaaagtactgggaggtaactctatctatgcaagtctactgaaaatgacagcacttgtatcaattgtttcagatccttttaaactcaggagcagatgagagattaggaaaagatcaagatatgagctaggcacttgtgagagctcactttaacattaaaggaaggttttgcaacatgagaaaataagctattgtaaaatttttatttgggctcattttaatattttttttcttctctacagctgattttgggttctgtgctcaaatcactcctgagcaaagtaaacgaagcactatggtgggaactccctattggatggcacctgaagtggtaactcgaaaagcttatggtccaaaagttgatatctggtctctgggaatcatggccattgaaatggtggaaggtgaacccccttaccttaatgaaaatccactcagggtaagtcaggaaaatttaggtacttcctactccaccctccaaaaatggaggaaagaaaaaaataacattttatgattccccacactggtcaaaactgaaacttctttggaataagtaacacagagacaacgagttatgatgtataaatttctctgaacttgaagtgccttgttctcagtccctctaacaacaagagactttaatattctttactgtacagccttctgctataaaactctagaaatgaatgaaaggaaagacatgggaaggatgggtgattttaacatgtattgtggttaaatgatctgcctaggaaacctttgtttcataattacgttaacaaagtaaaacaatgcatttttggaacacttatcatttttaagttgtatttttctttgttatcagtaataagtcattgagcaagaacagcttggttgacattgaatgaaacagacatagacatagcaccaacatggtgaaatcacaaacataattaaaagaccatcaaatagaaaagacatgaaaattatttgagttagagaactcaggttcctactacataattggaggtttgatccacaaatgattccgttacccctgcaaagagaaataaaataaaatgagaagccccacctgagcccattgtctttattcagagatgtgcagttgataatgagggtcaaagtaatacaacagaatctgttgcttaaagttgatgtaagtcagaagctattgggttagatgtagactcacagtaaatcagaagcagtatttcacatgcataaaggtcaggagactgttcttaataggaaatagccacagatccaaatctactcttaaaactcatacacagcatcagtgccaaaggcctttgttggtgtcattatcatagagaggctaatactgtgttttatcttttatatacgaactcattactcttagtaatcagtcaagtgtattctcattatgtttggaaactttttattcgagccaaatatatgtgactttttaaggcatttttattagatattttcatttacatttcaaatgatatccccaaagccccttattccctccccccaccctgctccccaacccacccactcctgcttcctggccctggcattcccctgtactggggcatacgatcttcgcaataccaagggcgtctcctcccattgatggccaattaggccatcctttgctatatatgcaactagagacacagctctgggggtactggttagttcatattgttgttcctcctatagggttgcagacccctttagctccttgggtactttctctagctccttcattaggggccctgtgttccatgcaatagatgactgtgagcctccacttctgtgtttgtcaggccaatgcaaaaattttgcatagcctcgaaagagagagctatgtcaggatccatcccatatacaaccaccaaacccagactctattgcatatgccaccaagattttgctgacaggaccctgataaatgtgactttctatatatgcaaagaaatctgtgaactaaacatctagttgtttttgcagttgaaaattgagtaactaagagccatgtttccaatatagagggagaagtgtcccctaattctttctccttttgattctactctggtacgtgactgctggtcctagtctttacactgattagaaaacaacagatgtgagagaatgccttaatgaattctagggctgtgacacttgtctcacaaaacaatctggaagtgggatgtgtgcattgattagctgcccacacgactgagtagaaaagggacatttccccaccatttgtgggtcagccctccatgactttactcaagtccacctctgacctgtggaacagggcatcaggataattaggatggcttttctgtgttgtctaagtacttttgcccaataggaaacatcacggaaagaacacatcagctctgttgtttctatggatttcctcctctaagtcttcaaagtgtagtggcactaaacggatcacagctagtttgctgtctgctttctgctgagtaatatgacctggagaatttaaggattaaataaatggctctggaaggcaactggtctcaggaatgcatttcttgctctcttctgttttccagtcataactgatctccctttagcaaggctgctaattacgagagggggaaaaaaaggaaacgggttttaatctccatagtcatcttctagcctgagttcaaaaattataattaatagttttgtctcttagaatacgtagccttctatcaaaacaagtacttgcagattaaaaaaaaccacaaagttcaggaagcctacattaagactatgaacaaccaaaaaaaaagctgtcagaattccactgataaggatggactaattttgtgtcttactctcttcgtgtgatcagcctctggaagattaatcaacaagtccttgttgagccagccagattccaaagctcttctcttccagacatcagaaatactcttaagctttctttgtaaatgtgctgtcctggtgttttcttagagaaaacacagtgtcttggtctagatgcccttatctgggatttgaaaaaaaacatattcactgaacccatgggaggattggagactgaaagatacagtgtggcactgtaggaagcctgcattttcctggatttcgatgactgcacactgtattggtaactagaaaaatcaagcaactttaggagaggtataaaagaacactcaagtctttcatcaaaattatcccaatctaccaccagttcactatttgtgggatttgaaacagatggaagtagaagggagtcaggagaagaagataaaacggtactctaaagggtggcatgcacttgtgggggctgggaggagaaaactcagttaagtaagtcaggcagatccacctatgtcttgactacatgacttaaacgctcaggaccactgtgcaagtcactttaaacctttctaaccccatttcctttctgggaatagggataatatccatcttgccaaatccacatgaaagtcatgaataatgtatataaatcacagagctccatgctcagctcactgtagaaaatatatgtagaaattcatgaacatgaggagaaaagttatttaaagttgtttttactcactcatttaatggattcagcatttctccaacaacctttcatcctgtggcccaaccatttgcatggaggagagaattctgtagagttcaatataattaccataattagcattaagcagaacaggttcaaagcaaagtctcaggctgtgcattacaaagtttcctgcatttccctgtgacttgtattttgttgttgttgttgttgttgttgttgttgtgctggattcatctgagcaaactatctgtcaaaattgattgtagatatacacgtgattcaaaaaattaactattgattaaaaatattgaatagttcttttgcctgggaataaaaggattgagattttaaaatgtaaataaatgacctaataagctcatgaaatgcttttaaaagctcagagggttattagctgtactaatgatacgatgttggtaacccttccggagacagagaggagacagtcttatctttgtagctcccagaccctgaagtctttacactcagtgtaattggccttggacagaaatgttgttctgtgacccatgggcattcttatgtagccaccaataattaagtgcctcatgccttctgtttgtcaaaggaactggggtttaaagcaatccagcttactctgtgaatatgcaaatcaaagatttatcttttgttgataccaccttttctcctaatggatgatatattttgctaaaatttgttagcataaaggaataaataaggagatagttatttctgtaaaaccaaatttgttctgcttaccagcacaaagaaattaactttctttttaaaaaagtaagtttactctcacacataataggtttattcttaccaggatgtaatggcttttgctattgggaaatttctcagtgatgtccacttgtctatacagaaccttttctagtcccgctttatgtgtaattttctagcccgtttttaagtgtttgctttatgcctttgtttttaactattcatgggcagttattaagcattgagctactggaagacattggtaccagtactagaaacggtcagtggtatggcacgggaaccagacaccctacttgtgttcctccttgcttttaccttgagtcctctgtggaatttaagaaccagtgctactggattccatcccctaggaaaagatgggaactggtactagtcaaaaggcaaacctatatggcaagaccttaatagagtactgtctgcaatgaaatgtagttctccagacctctttgaacacagctgtttaaccaggaatgggcatagtctgcttacacttacctatttcctttaagggaacaacatcaaagcctagttgagatcttcttcacttctccatttttagacctagcaatccagaaacactacatatcacagtttcttttctgttgctaaaattagaacatcccaaaagaaacaacctaatggagaaaaaggtttacgttcataatttcaggatacagcctattgtttggggggggggggagttaaggcagtaggaacttgaagcagccagccacaatatttccatcatcaaggtgagagagcagtgaactaataattgcatgccagtgctcagtcagctgtcttcatcttctacaatacagtgggtaggtctttacaagtcaattaatgtaataaagaaactccccgcagacacgcccataggtcagccaaacccagacagcctcttactaagactctcttctcagatgattctagattataccaaatggaccattaaaactatcacattctcaaaaaggaacgatattaattcatcatacctctccaggagatgagtttttctttttaattctgtctcttctgaaaatgatgttcatctttaaaataagctagcagctttgttcctcacatatattagaccataatgtagccatgggtgtgactatattgaaaggagtacgttacctcaatgactatggagaaagaaggatagaatccaaatgaaggcctgttgtcacatttagagacttcttacctctttaggaacacttaaagtactacacaaagggcattttttcttgctttttcttttcctcatataacctaagaaattctagacagactgtatgtctcaagaacatcatgcataataagagaagccctactgaacaacagcaactaagggccaaactgcatcttgttccctccaaccactggatcctgtgctgtgacttggaatgtctgggtttgatggcgcgtgctcatttggaattaaagtcagacataaacttcctgaacaccagagaagcaagcatactttgctagcactctgtcaatattgttttgaacgtatttcagggagagctgggagcattcccttctttttccataagccactgtggaacagcaagctttattgatgggttgttgacacccctcttcctttgaaggcttaacctatgcctaaaaggaggggagagttgggctaactgcaagtaaaataattatagaatagtaacagtgcttctttttaataagaaaaaatattgcctgtcagaagataggaagcccttaagaatcattggttgttaagaattcggcatcggaaaatgagacttggccatatgaaaactgcaagtttcatttagatcatacagaagcagacagttcaaactggtgaattatgacccagaagaaagccaagggagaaattgattccatcgcaaactaaaatccaagagactaaccaggcaaagaaaagggaaagtttaaaaaccattgttggcccagagagattcctgtatcctgtgatttttcttatcattcctcagagaactttacaggctccgttggtttgggtataacccagggatgcatagcctgttcctctaataagtaccatactgttggctaaggaattaagtccatgcaaatcaaagatcattgtaaagaaacaaatcatgggttgaggttgtacatttgcctgctgaaatgttttatcttatggcttttgaaatatgaattcacaagaaaaatcagcattttcctgaaattgaagatcactactgcttttttttgtctgatttatgtcctttttaatttggtcacaaaatcattttagaaaagcatttgcactctgatgcaaagatcctcaggaattctttgctgagttgcacaacactccaagttattttcatcaaggcaggggaaaaccaagagttttaaccagtggttctcaaccttcctaatgctgtgaccgtttaatatagttccccatgttgtggtgacccccaaccataaaagtatttgaattgatactttataatggtgactctgcaactgttatgaattagaatgtaaatatctaatatgcaggaaatctggtttctttttgagacaggatttctctgtgtagccctggctgtcctggaactcactatgtggaccaggctggcctcaaactcagaaatccacctgcctctgcctcccaagtgctgggattaatggcattcgccaccactgcccagcgttatgcaggaaatttgatatgcaatcccatagtggttgtcaccaacaggttgagaaccattgatttaacccttattccaagaactgagctgacctttttgccttgccacttgtgttcgcttccctttcttttcctcttctttgcttctggtgatggaaagaaggaaacatttcatcctcacatggtaaacagtagcactgctcatctaggagatgctgatgaatggggaaatattggaaaaaaaagctttctggcaactttattgattatgtgagtctagagtgaattctatttcgaagtctatcagacaggaatctattaccttgtataggttacttcttgctgtggttgtatttccttgttcctttggatgatttcaatttgactaagatgttgccttcctagtgtgaaccacaaagcacaaagcccttgaatcaatccacagaattccttgggttttattgaagggaacaagagtgagggcacctgacagggttcttggtcccattgggagatttcctctttaattcattttctacactgtgtaatcaaatgaggctcacttaaagaaaaacataagttttagggttcttttttttaattctgtgtgctttggttttaggtagctatagatatccctgaccttgccaggaatactctagtgttatcctgaagtgtgctttaagtgaagtggtcttcagaaaacacccgagacactcctagctcataaccttcacaccaaatctgtctagaatgtaaagaccaccccactccctgccttaccaaacaaaaagaacctggaccatggtgtgaaacatgctgcatgtgtgacttggtaacctcacactgatatgaatcataaaaagcactgcagtgattaaaaaaacagtcacagggatgaaatgatatgcaaataaatgcataatatttaaataataccttaagtcagaaggcatgagctaatgaaatgagcggtgtagaaggtgattattatagtcaacttttcagtaatagttatttctcattttaatttcattttaacttttaaatttgttgtctaacaaacaataattatgtatacatagtactggagtagagtggggtatttcaatgcactggtcaaaccagagcaattagcatttttatctccttatcatttcaggaccagagaaatggagcaacagcagaagacagagccctttgacatcacctattgtctggcctctacctccatttctgtctcctctttctaccaactgccttccccctgttggctcttagctcctgcacttgccttgttttcttctgtttcctttccttctcacagcttctcacctttccctgacttcctgcatcattctcttgtcctgcttttgaaaaatctccgtggttatcctgacttccccctttcaaatgctccgtagttccaaaccttgagtactgctaaggtcacacagggtcacatcgtgaatgcaagttgcctgctacacatttcttaacaagacattagaatgagcacatggattgtcagagtcatctggtgtttattttatggcggtgactaaagctttctgcttgggaaaaggaagtactccaaagctagcctgacacctaatcagtcagtattacctaattaccttttattatcaacctataagttcattttaaatgactctctttaagggttaagcagcaaaacaacatctcctcataatttggtgagagatgagaattgtatgtaaaacaatagagaggtaaattagagcacaatgctatatcgtgctgtagtgtgaagttgaaacaaagtatatatgtctagtggtttctttttgcagactagattctattaactctcctagaaaaaatcgaggaatgtcagagcctttcacaaactccataaacacactagaagcagcaatatgttttggcattttacctcttaaatcccaggtcatgaataaactagatcataaggtgtcaacttgaacattgccaaattttgctcataaacgattgagtaaaaaaaaatgaaataaaaaaggaattgtagcagcaggaggttgcaggaaccagcaagaataaaggccagaatacagaatgcatgaattcaattatccctccaattagatacactgatttttctcttagtatttgggtaaattcagatacacataaatactagcaatataaacctgcagcacacacacccacacatgcatgcacatgctcatgcacgcatgcacacacacactcctccctctttcccccttccagctatgtatgtgtcctttgttctccattttcaaactagtagagaatgattgaccacagaaggacccatttcctctgtacagggaaaagctgaatcatgtatgccaggtgttcacaaatagtatgccgcatttcttttttttttttttttttttttttttaagatttataatatcagggtatttatttctttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgcgggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttatagcacaagccattgctgttctgttcaggaatttttcccctgtgcccatatcttcaaggcttttccccactttctcctctataagtttcagtgtctctggttttatgtaaagttccttgatccacttagatttgaccttagtacaaggagataagtatggatcgattcgtatgccgcatttcttgacttcccctgtctgtctctgcctagagactgtgaaaagcaggagagggtatcatgcagcagttaagaacatggagtgttaactcatactccctgaattcaaatattgattacttctaatctaagagtgactagaagtatggcactggacaagttattcttaactgcacaaggcagtttttttccgtgtcagttaagagtcataataacttacctcaggaagtagttgtatggattatgtgagctaataataattatgaaatcagttttatatagtcatactagcttctgatcatatgtgtactgatgttaacatttggatacatatgccttcttactcttgctgtttgattttattgtacactcagtaggttttgtgtggactaggttgggagtccactcaccatgtataaaataatttccatgggaaaatggtctttgaatcccaaatactctactaacaaagagatttctcaaccataccctatcctctttgtaaagtgtttcattattttggtgctgagacttcatatgcttgcaagcatatttccatgaaagtctcctggtttgtttttcaatgacttaatgtaaactttataatctgctataatgaactcaagtcacaaactaaagctttttaattaagtagtcctattgcaacactgccttaatggaaatttatgagttacatatggattgtcttgagactccttttgagaaatgtggtaacttccacggtgaaggctttgatctttttcagctgcggaaattgccaataaggtaaattcgattatttctccaattagatacactagttttctcttagtgtgtgagtaaattcagttgcacattaaggctagtgaaaagtttaatgtgtgtacgttattgtcaagatacttacagttatcatggtgatgtctgcaatactagaaaactttagctaatgtttattcattggaaaacagctaccatatttttaatgtaaatacagtctatgtcatggttctatattgcctcaccttaggaaaaatataacccacttaatattctaaaatgctatattataaggaccttgcctgtttagtctcagctagaaaagataaatttttgaaactggtgtttctcgacacagttttctcaagttccttttatctctttcatctgtatttttttttcaatcaaacatgtgcttagcttgagcctggtgtctcacccatttgctagtatatccttatgtatactacacagaacatccttgtttcttccctagtgagcagtggtacttggtgtgactgatacacaagctttggctagtgtgtatgtgtgagagtgggaagagaaagtccctagggtgagattggaacagaggaaagctgacaaaggaagtaggaagcaaaccatataccatatgccatgccaatccttactgtgttttgtggaccaatgaagtattgttaggaatgataaataggaagaaaagcaaagcccctttgactgaattatcttttatgtgagcagaggattctcaaatctctactatttctctctaccttctcctctccaccccctcaaatgttcttggagaggaatttggggcaacaccacctgaatcccttatctttgaacaataggaggccactaagagcttttaagtagataaatgagtgacaaaaaccatgtgttgagctacagttgttgaaggggtgtgcttaagaatgaagcgatccgaataaggaaaatcaacgaggactaaactaaagctgcctgagaaagtcctgttctaaagcaaaggtgctagagagaggcggacaactatgaaagccatataaatgttacattgggagaacctagtaaaacaactgtagaaggttaggaggccgatgctatgaagaaggagaacactgggactttactttcttgcttacattagaagcagctacacaaggtctctagtccagtttctaatagccagctcattttccttgaattttcagttactctttaaaagtatcacatggtcattaattttccccaatcttcttcatctcagacttggctttgctggaaaaaaacaaacaaacaaacaacaacaacaacaaaaaaaaacaaaaaaaaaatttaaagacccttttggttgtcatgtttgtgttaagccacagctgtatttgtgtctcattcacaaggcagtgggtagcaattttctctttttatgaagatagcccccagctcacaaacgggatgtgttctaaaagttcatttttaagttaattatttggaacctagagtgctttttctcatagaaacagccttatacatagtgattaggttcccaggcgagtcaacaaaagccagtttattccataatgcaagtgaatgggtgaatttttttgccatggaaattgggtagaagtaatactgttgcaattacaatgaaaacaattattgaaaaagaaatagtgtgaggtttttgttttcctcgaagggcagtgtttgatgaaaaacatatttaatcctaggaaaatgaagtaaaagacccggggattagatgccaccatatttgaaatgcattttaactactgtttcagggtggggttaaaatgatgaaatcagtcttgtgtttatcacagaaaaaaaattgaaagctgcaaaatatattttaagaattaagtccctgacaattgtgatgccagagggagctaattttaacaagttgatttgttttgactttccttaaaacatgccattgcatagtgcatgttcattgtatatattaatagtcttcagaaaagcattctgattcttgtgttagtgtgttcttggataattctgtaccccatttgtctatcctgtcagctgctgcccatctccttccttttcctcaatggctcctcttctacttcaatgtcgtacatacacatgcaaatatatacgtgtgtgtgtgtgtgtgtgtgtgtgaaatctagatttcattcatgaaagaaaacataatgtttgtctttctgggtctggctttttttttttaatttatcgacttccatccattttccaaagaaagacattacatttgtcttttatatctcattgcatcagtctaacgatagttaaggtgtatccccatgatgaacttctagtataacaataacaactattatttttaatgaaggattatcagatcaatagccaaccaggttaggagtcagcagttaagcgatccattaatacaacctattctcagtcctacattccaacagaaactatgtccatgcaattctctaaaatgggctaaaatataaataagaagaaaattgacttgtatgcataattttactgtgcatatgctgattagagttgaatatttttttctttataggccttatatctgatagccactaatgggaccccagagctccagaatcctgagagactgtcagctgtattccgtgacttcttaaatcgctgtcttgagatggatgtggatagaagaggatctgctaaggagcttttgcaggtgaaaataaaatgagtcaatttacaaagagaaagttatgctgagcttacccatgtcaaaatgtgacagcaagatatctctgttgtagttagaatcggactattggcattcaattttagaccctgggcatgctaaatatagggattcatctataatatcattgattgatcatgttgccttgctttttaaagaatttgcattttaatctataattctcctttgttctttctgaaatctggttctgcaaagaaagactgtgactctggtattgatggggagtggggtgttgttctaaactttatttgtgcctctggatgttatatgcaggtgctcttggccagaggtgattttctacataacttccacatctttccatgcctgtcaccacatctatatctcacatccaaagatgccaaagatacaatatcattaatgtaaccacacagataaatacaacgtagaatcaattatgtggttataatactgggggaaatgaacttcacagttctgactccaaagtccctgtagcttttgtcacacagaagaactctgttgtggcagttttaacatacctttcaacactttgtgagttatctccataaaggagttgatgggttgaaactgtgatggaaatgagagctctattagaaattaaatagcaaaccaagataataagagtaactttgcagtgaacaagaggtaggaaaggaaggaaagataaaaagagaagcacagctagagaaattacccaaggagctaatgggaactgcaaccctataggtggaacaacaatatgaactaaccagtaccccggagctcttatctctagctgcatatgtatcaaaagatggcctagtcggccatcactgcaaagagaggcccattggacttgcaaactttatatgccccagtacaggggaacgccagggccaaaaagggggagtgggtgggtaggggattggggggtgggtatgggggacctttgggatagcattgaaaatgtaaatgaggaaaatacctaattaaaaaaaaagaaacataaaaaggaaaaaaaaaagaagcacaagccctgaggtagtagaatgtcacagatctgcaaagaagcaaccatttaaaagaaataaaggagctttgcttgcatcgactcttgcagatgagccaatagaagtggaggagacacagctattgggtttggcagcaagggagccaataatttcagggcaaaattgattttaatgctcagttgaagatagtttttcaagcctgagagatatgcagcaccattcttcagtttaagaaatgtaatgtctggccattactgagtgaacctttccaaactctatactaaagagtttctagctatgccaagtaaatttccataggatttcatgacagttaaagaccaaaaaaggaaaagaaaatctgaaggacaaaagctggcagggattctttaattagtgagtactcgaaacacaattaaatgcaaaggagcatatttgaaaatgtaaaattacactaatgcagtagttcttaacctgtaggtcatgacctctttggggatcacatattagatatcctgcatatcagatatttacagatttacagatattacaactcataaccagcaaaattagaattatggagtagaaacaaaataattgtatggctggggggtcaccacaacatgaggaactgtattaaagggttacacattagcaaggttgacaaccactctattcatgggaagggagaattctagtaattctttttttctctcccttttacagcatccgtttttaaaattagccaagcctctgtctagtctcactcctctgattatcgccgcaaaggaagcaattaagaacagtagccgttagaactgcaagccttacccctcacggtctccaggatgagtaagactgaaataaaactctgctgcaggatccacagaagaagagacagtcaaatggagtgggggctctttaacttttaagtgaatagaaacttcttataaacctttttcctactccctcagattatgtaatttatttgtaagcctgaactgcagcccacacagggcagcaatgtcgaagtagccattaagtggccacttccaccgtgaagcgaaagagccagtagtgaatcccctcattttgtgcatttactttgaagaaaaaaagatttctcaaagatgcacactccctcttcatagtgctgtgtttgtttttaagttagagagtagtccctctttcattcgaacctctttcaaaatcccttacccaacgtgatgttttttcacttgcattgtcattagatgttcagaaaaataaaagatgtcaaaatgtttttttaaaaaagaaaaccaaaaaagaaaaaaagaaaaaacaaaacaaaaaccaacaaaaatgaaaaaaaaaaaaatagaacaagtgccgtgtgaagccgtggacgtccatgccctaatagagtcgcaagcttttcttcttcttctgtagtggtggcttgatttgtctacccattttctgcatttgtattggaaaaggtttcctttaagacattttccaaaaccagagaggactatgagtgttcaggatggtcttttaaacgttgtgtcataacaaagctcgaattgtgagatcctttcacatttcgcatggatgctaatgtagtagttgaattgtcatgtaaagcagcttgttggcctctgtgataacagaaaaaggacacactgaaaatgtggcagtgctgctgggtgagtccaggtgatcctaaacctaggatatcctgatgagagaaaccttacttacacaaagatgggactttgtctgagagccaaaaggaaaatgcatcactcctcattgggcagtaaataagcaaagataatagtgaatttattcctctcttgtgcgcctgtaacataagcattgtacaataggcacattctgaggaaatagatccattagccaatgcttttcatgataaaaatattcatttttgggcaatttgtaacacataagaattttttaaagagctagagatcagagatatagtaaagtattcaactctttaagaaatggaaagtcaatgaaagttacatcccagttaacacatggctctaaatacttgaaaatgatttttctatgtatctccaatctctttttcggcacttgatcttggtatgttcttatttagtttcttgggcttttgtcctttaaaagcatgttcataaaggtgttggaagttcaccaaaaaatttaattttgatctgtattcatatttcctaagaaatagcccaatggaattccttttgtggcttgaggaaaattccaaaatttgactattatttcactatttatagttattaaaaatttattaatcttctgtgagtagaaaaacatctggaaggtgtctgcatagaaaaggatatgtctcttttgagtgtatagtcagttgtatgaattctagaaagttgtttctctaagcctttgacaagccaacaatctatgttatatggcatttcttaatttgtagagttagagaaactgaatagacattacctacattcagtggggggagcaagatgaggagcagatgcccctctgccctgtgaggtccatctgtccatttaagcatccatcctttccttgaagtgaaagcactttctctagagtttctgctgatcatctagtacatatgtttatgttgagagatggtaccactggtggatttcctattttcctatattagaagatttgggaggggtttactcattccctgaaaatatccaccatggaataaaagacaaatgtgaaaagaaaatcaaatgattatattaatttcaagtttattttgcaaagagatatctgggcctaaaatttaaatgtcacacctctttagtgagagaggaggaaccttaattttttattctactttattttaaattgaggattttcccacttgttgtgccagggaattccacaaaatacctgggatgtaaatagaatccaattgattgatggttatgctcagctaatagagagaacccaaaccctggttgggaagtccaagacatcagttaacaccttttgcatgttgtaaaggcctttattattgttgctgttgttcttgttcttgttgttcctgttgttgttatccttatttagaagaccctggagctgtggtccttcaggtcactgttggcagagaaatggctgttcttgatgccctccactctgcctattaacagtgaagggccaggtacttatttaccatcactttgtatcaagatttaatagtctgttccagtaggcattacttgtacaaaattatacctgtgtacattttcaaatgagaacagcttctaaagtcttttacttgtgttgaagagttacatatatttctaataagtattagagagaaactatttctcatgccaaaatgatgctgaagggtccatacttgctatacttgaacaacttagcctccagatggttagtagtttattccctttccttgatttcattttgagctcatcttaatccaggtgaggctgttcagatctttaacattactagtgtgccctgagacatttgtgggcacatttttgaatgtcaattcaaaaatgtcccgaggtaagaatagggcagtggcaaagtcagggaggggtgagaagcacagtaaagtttatttatttaagaaagaatagaacattaatattgtagcaaggatccagtttgttgtcaaaatcccatgtggttttggggatgacgtaatccccctaaatcaatcaacatgttggataatgacttcgttcttgctgatcttgtctgtgtgttattgtaaatatttgtgagtccatgctccattttggctactggatggccaagtcacatgaaaagatttaactcaagtatttattctttaattgtgttcttcagatttctttcaggcatatgaattgcacctccaatgtttagttgaaccacctattcctcacatctatccctcccctatgaagcacattccattgctaaaagaaaaaaaaaagaaatataaattgcttcctgttttctgtataactgttttgatagtttaagatgtttgtctataatggatatctctcacctcaaagatcgtgtaaataattatatccatttcctcaatgggtcgtttctttctaatgaggctgccagttctcagagagagtctatgaagtcacttttaaataatacacacagggattacatctatgtaaaaagaagtgtgaatatggataaagactgggaacacagaaaactgaaatcagttgtgatagggtggtggggttctgtgattttttttctttccgaaattttctttctttgatattgatatattaataatttaagtaaataaacaacagaaggggaactatagaaacatagaagagatgccagaagcaggtgccttctggccagagcccagagcatgcagggcacagatatttcctagttacaattattctgtaggctttatacttgcctgggtactgaggttggcacacgctcaggtatggcacatgctttcttatgagactattatctaagtcaagctaaggagacatcactgctagaactttaaatgcattcttctgctacaaaacaggctgccctcagctttaatatggcatccaggtatgtattttgtttgccttagattggagggctgacaacctaattagccccattaataatacttgttttagatgccacctttctagcttgttttaaaagattttcaaggtcaattttggaaggatagaagggaaaaatagctagtttccaccagcttcttgcataacagggcctatcattctgataggagtcttttttcaataactatagacaaatcccattggtttccatggaaattaccatatacaattaagcctaactctaaaattattaagagaaatatttaagattgctaatattcagttccaggccagtactaagcctattagttttggcttgggatggtctctttatgcccttgtgctgcatgattgtagcatgtaggcagcaattgtggttttttttttctttagaaagggagaccaggcatgaaagggcaattttcttctaactcaccaaagaaattttaggtgaggacttcactaatgtatgtttcacagtgtcatcaaaagcagaccatatccctagaaaactcacaggcatttacttagctattcataatacatatggaagtcttaaccctgccatcctggttgaatctagtccttttctgagctctttgaagttaatattcactcaaacaaatgaatggcgtgtggtataaacatctcccagtcttggaagaagaagcctgaaattcagcatttgtaaactgacagtctaatgggcctgggatttggaataactttaacatacaatattgaacatatatttgcatgtggattggaaaggaagtaaatagggccttgggaataagggaaatgtttctcctatgaaagagtttttcataaaagacttatttctactataatttctggtttttgactttcagttttatctcttcttttctgcttcacactccttcagtgatcaaatatatctaaccaacctctaatgcatggggatgtctgtttatcatcaaacagtatctcactgaatctgcaaatgtgggacttgagatatcaccatgtgcacacctctgactatacaaacactaccaacttgtagcattgactgccacttaagtccattgaacttgcaaggtgaacttagaaaatctaagtagtgccaccagacacagaagctgccatcaggtgaatgctgtctcattataccattagtaaggcaagtaccatgttcatctgagtcagtgcctaggcaaaaactgacactaatggtagagaagaagaactaaccatacccaggaaggagacctagatgttagcatggctgttttaccgaactctgtgaccgcgagcaaatcacttaacccttctattttattcatctataaaataagggtattgaagtaactgctcttcaaggtctttccaaaagttttgacattgtgtggggtaacagtttcccttgcaagttcaacctgacaaagtgatggcaagtatcacaagcttaagcctggatctctactttgcagctccatagaaccatgtacaatagaaaaattcaagtaaataaagttaacagcaccagggaataatgttgatcaaactcatggaaaccttccaacttcctcacaaatgttttgtttttattttaatgtcttttttccactgaatgttcccagttttccttttctatacactgtacgtaaaatctggtttccattaagctgtggctagcatttgctactagaacagaaattcactgtcacatttcatagaataaaactgtactttgggcctctctattcctatgaggcagttatgggtcttagagcattaaagtaaaaatggcgcaggatggcagaacccaagcattttaatggctaagataacagagtggacctatgtacggacaagttgcaaaatgagcaaccgaaaaatagcaattgcatgcttttaactggcaaattaaatgttgggatcaaagaaaacatttctcgtggaaattcccacagcaattggctagttatttgagtatggtgctgaaaaagaagagaggctagaagttagtttaatggatggtccctattgcctgcctacagcagagtgtcaaccagcccggagtgtgaaattcaagttcaatgtgtgtgcttgtgtgtggtgtgctttctggacccacatatactatattcattagtgatggtaagatctttcaccattaatgggttgagcttaaaaatctcagtagatctgacagtagctgccagattacatggatgccgatgtctactggggttgaactcataacatccagataaactagattgaggaggatctccattttcaccgtttatcggagttgtatctcatttggctgtgcattacttttgtcaaaatgtgttgttatttgttaacccatgtgtagtgaacttcttctgtaattttggattaatggtatttatggtcttatgtttgtttggtttttaagtaagttatttcttttgtagatttgctgatggtatgactccatccctctgccctcagcagctgatctttttaaggattttcatttctgatattgttattttaaattgtggttgaagcaatagaaatttgaaatatggattgtgcatgactgtgtcttgagtgtaaaaatattacagtttgaaacttggacctaaagtattgcaaataaaacgacaaacatcaa

SEQ ID NO: 317 - DNA, 1540 bp, mus musculus
ctactgtttgggaaggtcaccagccttctcatactgaaggggaagacccaagccttcgatgagatgcacatccaggaagttgctgacatcacacatcagcagtaccagtgccatgctgacagcccaactatgtgtagttctctaaacacaaggtggtcaagaccaatagctcccccaaacaaggtgcatgccaatgggttggcctcgcaggtggtgaagtccagtacatttgggaaacctggctttcatggactccagtggcccacggacaccagaatggcgatggctgaccagaaagaatgccggtcaggatcatcatgggaaaatctctgtgacccagtgatcctggatgttctgcaccagactttctccaagtgtggcattgtcctcggtatcatcatcttcactaagaccaaccagttccaggtactgctgtactatgctcaccgcttgagcatctagcatgctaagctgtctctagacagccagaacacctacaatgcttgctgcataccacatatcaacttttccaaggtcacagtgccagttggttttttgtccacttgacaataaaccaagacctatatatctgggaagagggaatcttatgtttttcactgccttcataagtttagccttacataaattggtgggggtattatcatgattaatgattgatgtggcaggacccagcccactgtggatgctaccacttgtggacaggtggtcttggggtatgtaacaaagcagactgggaaagctgtaaaagcaagccagtacacagcatttctccatgacctctgcttcagttcctgtttctaggttccgactccttccctgacttcccttagtgacagagggtgacctgagaggtataagctgaagtaacctttcctccccgcattgctcttggtcatgttttatcacagcattggaatcctagctaggacacgtcaccatctgcagcagcaagtacaagagtcatgactgtgctctctgaggcctgcctttggggaacagacagcttcttggagcaggccatggtgacagcattgtcccttttgaccctaatgtctgcttcctctccaacctccaccaagcataccatcagcagcagttacagctgcagcaggctgcttcgccatttcaagtctgctggtgtcagggattccatcttgctggttagcaacttgaatactgaactcacacagccaagcccctttgttctcttcagtatctatggttacatgaagaggtgaggcacccaaatacgttgtgtgggaagccaacatacatcacagtgtcaaagcaccaaagtatcctgctgcctcatgagggcctggaagagcatggtttcaccaaagactctgacagcttgcctctgcactgcttcaagaagctaggctccaaattctttaagaacttcttcctgctctcagccactctgcacctcaccaacatcccttccttgttgtcagaggagttcctcaagaacttatcaatcatcaagggcatgaccaagggcttaaaattcttctag

SEQ ID NO: 318 - DNA, 24598 bp, mus musculus; identical to SEQ ID NO: 106

SEQ ID NO: 319 - DNA, 1011 bp, mus musculus
cgcctccagcttcgcgcggggatcgccgactggcccgcttgcgcagccgctgttccttctacccacggaggaagcatgggcgtccagggcttccaagagttcctggagaagcgctgtcccggggctgtggtgcctgtggacctcctcaaactcgcgcgcaccgtctcgcgccagcagcagcagcagcacctgcaccgccagctgccgccagcagccctagcgccaggggctccacgcatcaccaggggctctgctcctctgccgccgccgccgctcccgcccgctgcctttggtgcttactccgggggcgcggggccgtctcggcaccatcaccctgctcaccatttccaccaccatggccaagcgccgccagggctgcatccgccgccgccccctccgctgcctggggctcgggtattggtagacgcgggctcggcgctgccgcggctctatggtggctaccagacggattgggtttgtggcggccagtggaatgccatgctgggctacttgtcagcgctgtgccaggcttgtgcctatccgggcggagacggcctggagctggtggtcatgttccctgggggcctggggaaggaccgactggccgagtggggccgtcggtgccaggcggagcggcagactgcgcaactgatcgtgggacacgtgggcaacaagggcacccctccaccgcgggcctggttcctgccacctgcctgtctgagccactgcgtgaggctagcactcatccgcttccgggtcaaggtgagggaggggttagatttttaaatgaaatgccccacacctgttccttccagactaaacacctaaccattcaccgacctacctgccacccactcagtcagctaacttactggcgaccattttatcccctcgtgcccccgtcatatggcctattaattcccttacctacatgattgtatctctagccatgccatccccgtaaccccctttactcacacaattggcctacctgttggttctagcagaatt

SEQ ID NO: 320 - DNA, 35829 bp, mus musculus
ctccaccttcacctcccgtgcccgagcctcgtaagatggcggcgggctcgtctctttcccagaacgccgccactctcaatatggtagctgtttaccatatctctccacccctctccgcctcaactgcctcgcgattttgaataaactttattgattgctttgaatctcctacaaccccccgagagtggcttctcccggcgacctctccggcggtctttctccagccgccgcaagcctgtctcgcgaagggggcagcgacaaagccacttgccagtgcgcccggcggccccgaccccgacccccagccccggctgagacctcggtctctagaaggctctgagggccagacggtgggagggctgaggtggacactgcccgaaagccccgtcagagcccgggcactgcgtgacgcggcatgtggtttctaggagaaggcaagtcagcttcacagtttggcagcggcaatcccagcattcagcgcgcgccgcctcgggccggaactgcccggccagcctgtgcttagcgcagagctgggttgccccggagcgagcccagcggcaggcgagtctctggggctgagctctgttccctgaggacttgccccctgcagcctcgggcatgaagagagctctgtagcgtttgggaccgtggacattttttatcaggtttggggcataaaaaaggttcctgtcagtgtgtgtgtggggaggcgtagagagctcctcgtaagttttgggggctgcaagcaagctgcgttctaatttaagacgagacgtctgtcaggtgaggggtccagccgaaccctcggcggtcggaggggattgcaaggcaatgcctgccatttggagctgtggaggggaaaacaaattcttcgcttagtttcgcggcggcgaggagattctagtgggtttcctggggcttcgaagagatccttttcagtgtcagggggggagatgagctccctgtcagctttggagtggaggacgaaattgcggtttatttcattttggagcagaatgagactccttactgctcgggagggaatgatactgagaatgacgaaaaggatcatttaaactctcccaacgcgatcccaggactgtgatttgagttgggtgcctagtcttgtttgtcttgttcccgaaggctttggggggtggggtgggggggcgtaattcggaataacctgcggagaccttcagggatttccgcatctctgcttcttcctattttggggggctagacagggtctctggtctctccctcagcttccctcttcccagcctcatcctttatgccgcggtttgcgtcataataaagggagctgagagtcctgggaagcaagagggcagtgaagagagggggttcagtgagggattaaataagcttcccgaaagctttcagatatttacatgaaacccggaaagaagttgtcactgacttcagggccaaagaaggtaggggtctgggggaggcgtttggaaggcagggcagagcagatagcagaacgttcttgctgttctttccaagtgaaagaaatcctgaagggtgggtggactttctccacttaactcctgcactctcaccagctgtgttgagtcctggctcggttactccctttttcagaactggaggttggtacccagggggtggggtgggggcggagacacggaacgatttggaaacccggggccggaggagtcacttggtaaagaagtgttgtttgtgtctagccatcgtctagagaaggcgcttgttgctgccttcagacccagtaaagcttcaaaactggcacggcgcaaaacgatccaaccccctgtgaagatggcctcggtgcctgtgtattgcctctgtcgactgccttatgatgtgacccgcttcatgatcgagtgtgacatgtgccaggactggtttcacggcaggtaagaagggcaggccaggctggtcagggagcattggccaggtgtgttgttttcacttgctctctcctcctctcagccctgttttctacctactgctcagaaactagcccctccgtcaatttactagacctaggtttttctatcgctccttgcccaacaactaggtcctagctgacagtggtctgtggtttctctctgtttccctatgtatatttattgtactttgtgtatgtacatgaatatacatatatatgtatatatatgcatacgtatttgattttctagctgcgttctagctacaaagaaattatcagttgtatggttgtgttttccctcgtatcctggctttgggggaggcagcactgcatttttgagatatctgagtttaagaacatggatttctttgtaacttactatcagtggccttggccaaagttgcttttgcttctgtgagcctcacttacaaatcaatacctctttcatagctgtaaagcagtttgcttgcattctataaatggatgcagaaccagaaaaatattttatttctgtgccgtctgcaggactgtctaactacattaaaattaaaagacgtagggtaaaacaacaggacaaatgcacctgtctgtcacccaggtttccagtgagattagtgtatataataaaaatcaaaatattatcctattactgagggaatttgtatactggagtttaataaaaaacagtattcgggaccattctcttactatataagttctagaatgttaagttgtcaatttttaaaggagctgttcctgttatactcaaaaacaaagtaagggtggggtcagtgggtctcatgttcaaggcctgcctgagccagttcaaggccagcatggcaacttagcacgattctgtctcaataataataataataataataataataataataataatgtaaagagcttgggatataattcagtggaaagctcttgcctcaaaatatcaaaaaaattaaaaaaaaattatttaatcttatagttgcacatatgtctgttacttcctagaggtagagataccttttctgtttctttttagtatttctagtgctaaatatgcagtagatatttagtacagttttgaataaataagcaagtcataatgaaaaaaacttatttcactatggcccttagtttggaagtgtgtatgatatctctttaaaagggcttttgctcacagtgtagaaatctgaaaacacaacaggaatgaatgtttcctaacttcttaccctgtgtcagactccataactgacattccataaattattttgtctgtacccaagtctgaaagttcaaatttttcttctacttgtgcgggtttctgtatccgggtgtgtacacatgtatggaagccagaggtcagcctcaggcttccaggcctcagtcctcaggaaccagccatcttgttggttttttttttttttttagctagggtctccccgtggcctggtactttataagtagcctaggcaggtgggccagatagccgcagggattttcccatttctctccctaccactgggattatatggacttgaatctttcttacatatgttctggagattgaactaaagtcctcatgtttgcctagtaaacactttactcactgagccttctccccagcctaaaagttacacttgtgggagagcacactcctgtgagtatgtatgtgtatatgcatccatgtgtgcacatacgcttgaggagctatcaggtagctttctttactgctctccaccttatctttcatgccaaacctggagcttggcttaggctagctggctagcaagctccagagatacatttgtctgtttgccctcattgctagtgttgcaagcatttatggccatgctcagttttatggtagttttggggatttgaactcaggccctcttactttcatagcaagctgagccatctccctagttcctgaaagttagattttaaagtgtgagtgtgggtgcgtggggggtggcacttgtgtgtacatagcatgttatgaatgtggagatcacaagacaacttggaggagtcaattttctccttgcaccatgtaagaccaggaataaactcaggttgtcaggcttggtgacaagtaccacctagtgaggtatttcatcggcccaacccagattttttttttttttttggttttttgaaacagggtttctctgtacaaccctggctgtcctggaactcactctgtagaccaggctaccaggctggcctcgaactcagaaatttccctgcctccgcctcccaagtgctgggaccaacccagatttttaaaagaattaattttttttaaatgggctttagggcataggcctgtaattacagttactttggagactgaggaaggggattgcaaagtcaaggctggcctatgcaaaaaaaaaaaaaagattttttttcttattatataggtgagacatgtccactatagaaaatacaaaaaaaaaagaataatagaaggaaataaaaaagtcatctatgggtctgttggatacaattcactgttaatttttttgctgctgctgtattaattcttgttctttgacttaaaacatatgtttttataggttgcgattatattataaatactattttgtgatctccctcagtccacacccagcattttaatgtgggtatttgccaggttgttagaaaaaatctacaagatttcttttctttttttttattagatattttcttaatatacacttcaaatgctatctcaaaagtcccccataccctcccccctgccctgttcccctacccacccactcccacttcttggccctggcattcccctgtactgaggcatataaagtttgcaataccaagggcctctcttccctgtgatgtccaactaggccatcttctgctacatatgcagctagagacacaagctctggggatactggttagttcataagttcatattgttattctacctatagagttgcagaccccttcagctccttgggtgctttctctagcttctccattgggggccctgtgttccatctagatgactgtgagcattcacttctatatttgccaggcactggcatagcctcacaagagacagctataacagggtcccttcagcaaaatcttgctggcatatgcaatagtgtctgggtttggtggctgattatgggatggatcaccgggtgggtagtctctggattgtccatccttttgtcttagctccaaactttgtaactcctttcatgggtattttgttccctattctaaggaggaatgaagtatccatccattagtcttccctcttcttgattttcttgtgttttgcaaattgtatcttgggtgttctatgtttctgggctaatatccactcatcagtgagtgcatatctaatgacttcttttgtgattgggttacctcactaaggatgatatcctccagatccatccatttgtccaagaatttcataaatccattgtttttaatagctgagtagtattccattgtgtaaatgtaccatattttctgtatccattcttctgttgaggggcatctgggctctttccagcttctggctaatataaataaggatgctatgaacatagtggagcatgtgtccttaccggttggggcatcttctggatatatgctcaggagaggtattgctggatcttccggtagtattatgtccagttttctgaggaacctccagactatcttccagagtggttgtacaagcttgcaatcccaccaggagtgttcctctttctccatatactcgccagcatctgctgtcacctgagtttttgatcttagccattctgactggtgtgaggtagaatctcagggttgttttgatttgcatttccctgatgattaaggacgttgaacattttttcaagtgcttctcagccattcggtattcctcaggtaaaaattctttgtttagctctgagcaccatttttttaatggggttatttgattttctggagtccaccttcttgagttctttatatatattggatattagtcccctatctgatttaggataggtaaagatcctttcccaatctgttggtggcctttttgtcttattgacagtgtcttttgccttgcagaaggtttgcaattttatgaggtcccatttgtcaattcttgatcttacagcacaagccattgctgttctgtttaggaatttttcccctgtgcccatatcttcgaggcttttccccactttctcctctattaatttcagtgtctctggtcttatgtggaggtctttgatccacttagacttgagctttgtacaaggagataagaatagatcaattcgcattcttctacatgataacaaccagttgtgccagcaccatttgttgaaaatgctgtcctttttccactggatggttttagctcccttgtcaaaggtcaactgaccataggtgtgtggattcatttctgggtcttgaattctattccattgatctacctgtctgtcattgtaccagtaccatgcagtttttatcacgattgctttgcagtacagcttaatgtcaggcatggtgattctaccagaggttcttttattgttgagaatagtctttgctatcctaggtattttatttttctagatgaatttgcaaattgccctttctatctcagtgaagaattgggttgaaattttgatggggattgcattgaatctgtagattgcttttggcaagatagccatttttacgaatgttgatcctgccaatccatgagcatgggagatctttccatcttctgagatcttcttcaatttctttcttcagagacttgaagcccttatcatacagatctttcactttcttagttaatcacaccaaggtgttttatattatttgtgactattgtaaagggtgttgtttccctagtttctttctcagtccattcatcctttgtgtagagaaaggccattgatttatttgagttaattttatatccagctattgcactgaagctgtttatcaggtttagtagttctctggtggaattttgggggtcacttatatataatatcatatcatctgcaaatagtgatattctgacttcttcctttccaacttgtatccccttgatatccttttgttatggaattgctcttgctagaacttgaagtaccatattgaatacttagggagaaagtgggcagccttgtctagtccctgattttagtgggattgcttcgagtttctctccatttactttgatgatggctactggtttgctgtagattgcttttattatgtttaggtatgggccttgaattcgtgatcttccaaaacttttatcatgaaggggtgttggattttgtcaaatgctttctccgaatctaatgagatgatcatgtgttttttgattttgagtttgtttatatagtggattacgttgatggatttccgtatattaaaccatccctgcatccctgggatgaagcctacttggtcaggatggatgattgttttgatgtgttcttggattcggttagcaagaattttattgagtatttttgcatcgatattcataagggaaattggtctgaagttctctttgttggatctttgtgtggtttaggtatcagagtaattgtggcttcatataatgaattggatagagtaccttctgtttctattttgtggaatagtttcagaagagttggaattaggtcttctttgcaggtctggtagaactctgcactaaacccatctggtcctgggttttttttggttgggagactattaatgactgcttctatttctttaggggaaatgggactgtttatatcgttaatctgatcctgatttagctttggtacctggtatctgtctaagaagttgtccatttcatccaggttttccactcttcttgagtatagccttttgtactaggatctgacaatttttggatttccttaggttctattgtaatgtctccttttttgtttttgattttgttagttaggatactgtcccttggccctctagttagtctggctaagggtttatctatcttgttgattttctcaaagaaccagctcctggtttggttgattctttgaatagttctttttgtttccacttggttgatttcagccctgaatttgattatttcctgttgtctactcatcttgggtgagtttgcttcctttagttctagagcttttaggtgtgctgtcaggctgctagtgtatgtgctctctagtttctttttggaggcactcagggctatgaatttttctcttaggactgccttcattgtgtcccataagtttgggtattttgtggcttcattttcattaaaaactaaaaagtctttgatttctttctttatttcttccttgaccaaggaatcattgagtagaatgttgttcaatttccacgtgaatgttggctttctattatttatgttgttattgaagatcagccttagtccctggtgatcagataggatgcataggataatttcaatatttttgtatctgttgagacctgttttgtgaccaattatatgttcaattttggaggaggtaccatgatgtgctgagaagaaggtatatcctttagttttaggataaaatgttctgtagatatcaattaaatccatttgtttcataacttctggtagtgtccatgtgtctctgtttagtttctgtttccagggtctgtccattggtgagagtggggtgttgaagtctcccactattattgtgtgaggtgcaatgtgtgctttgagatttactaaagtttctttaatgattgtggctgcccttgtaattggagcgtattcagaattgagagttcatcttggtagattttacctttgatgagtatgaagtgccctccttgtcttttttgataactttgtgttggaagtcaattttattcgatattagaatgactactccagcttgtttcttcggaccatttgctaggaaaatggttttccagcctttcactctgaggtagtgtctgtccttttctctgaagtgggtttcctgtaagcaaccaaatgttggatcctgtttgtgtagccagtccatgtttttttattggggaattgagtccattgattttaagagaaattaaagaaaagtaattgttgctgcctattatttttgttcttaaagttgggattctgttcttgcagctgtcttcttttagatttgttcaaggatcaatttcttgctttttctagggtgtagtttccatccttatgttggtggtttccctttattatcctttgaagggctggatttgtgcaaagatattgtgtgaatttgcttttatcatgaaatactttggtttccccatctatggtaattgagagttctgttgggtatagtagcctgggctggcatttgtgttctcttagggtctgcataacatctgtccaggatcttctggctttcatagtctctggtgagaagtctggtgtaattctaatagacctgcctttatatgtcacttgacctttttcccttactgcttttaatattctatctttatttagtgcatttgttgttctgattattacatgtcaggaggaatttcttttctggtccagtctatttggagttttataggcttcttgtatgttcatgggcatctctttctttaggtttgggaagtcttcttctataattttgttgaagatatttgttagccctttaagttgaaaatcttcattctcatctactccttttatctgtaggtttggtcttctcattgtgtcctggatttcctggatgttttgagttagaatctttttgcattttcactgtctttgattgttgtgcccatgttctctgtggaatcttctgcacctgagattctttcttcaatctcttgtattctgttgctgatgctcgaatctatggttccagatttctttcctagggtttctatctccagtgttgcctcactttggattttctttattgtgtctacttccctttttaggtctagtatggttttgttcatttccttcacctgtttggatgtgttttcctgtttttctataaggacttgcaactctttagcagtgttctcctgtatttctttaagtgagttattaaagtacttcttgatgtcctctaccagcatcatgagatatgattttaaatccgagtcttgcttttcgggtgtgttggggtatctaggactggctgaggtgggagtgctgggttctgatgatggtgagtggtcttggtttctgttagtaagattcttacgtttgcctttcgccatctgttaatctctggagttagttgttatagttgtctctggttagagattgttcctctcgtgattcttttagcctctatcagcagacctgggagactagctctcttctgagtctcagtggtcagagtattctctgcaggcaagccctcctcttgcagggaaggtacactgatatctggcatttggacctgcctccttgctgaagatgatggcctgaaacagggcctgtctcagaagctgtgttgcttctgtagtgtgcactctcacctttgcagactagtctctgagggttccgggacccaggatggctccctcacctgctccgcatagccctctcgggcagatacctctcctctggcagggaaggtgcccggatgtctggagcctgaaatgtggtctgtcccagaaactgtgttgcttctgcctttcccagaagctgtgttgcttctgtagtgtgcactctcacctgcacagactagtctctgagggacccgagacccaagatggctcccccatctgctctggtagagccctccttggccgacctacagcatgtttttgatatcttcttgtctatatgtttatcaccacttacttggtccttccctttatggttgtatacttacattatttgtactttcttacaatcaatgtgaggcggtaaaacctggggattctgggaaggtttttgtattctgatgtgattattggttaaaacaaaaagaaaaccacgactggtggacatgtttttgtacagtagatatttgacatttagaatgataaaactactgaaactttaagaattattaaacttacaaatgttttatgagtttatggatccgatatgtctttaataacatttctaaggtatattctgcttttgtttttacattctagcacaagtttcatgaaagcattcagttttaaattttcttctgcttctttctgtgggctgccagagaacaaggcacctagctgaaaaccagatccttagttagtggctggctgttcttgcttactcagtacacccctagcccaacatactcactgtactcttaagtttttactttaggtcaattggaaattacaaaatattgtggagttttcatgattgcttccaatagttaaccacgtagacccagtgtgtatatgttgtatgagtatgtatatgcttgtatgtatatgagtatgagcatatgtttgtgagcccaccaaggccagaggaggacattaattgttttgttgtatcactctgttttattctcttgagatgatttatcactgaaccctgagttaaactggtggctagcaagtcccagtgatcttcttgcctttgcccctcccaggactgggattactgctacactgactttttacccaggtgctaggatctgtgtactaaagtcctcgaacatgcaaagcactctttcaccaccgagtcatctctgcagcccaaatcctacagatttcatatccacaaatgcccaaagatgatagacttttgaatttcagttagggattatggtacataataagttgctacctggagtggttatagtaaggaaggccactatgatatttttgatgataagaatctggaactgtggaggttaagtgattttctgagtatgaatttgaatttcaaattaattgtttctagagtagtgttctcaaatttagaaaaaaaatgaataatttcattcctcttgtaaggcagtagtgttgtgctaaacactatgttttgtagaacagtgcactttaaactttagtgtgtatcaattatttgaaagacccatttaaaaaaaaacaagatagatcccaacctcagtttctgactcagtgtgtgtgtgtgtgtatacacatatacatatatgtatatctatgtatatgtggcgggggggggggactgcacatgaactacatagcaaacgtgcaggtcagagggtaacttttcaggagttagttctctgattctgccttcttgaagcaactcccttgtttctgctgcactattactccaggctagctaatctgtgaacttgtgggcagctctcttgttttcacctcccatctattttcacctcccctctcccttaggagtactggggtttacagatgtacaccactgcatctgacttttttatgcatgttccagggattaagtttgggttttaaatggtaagtgcttttacctgttgagccatatcagcagccagacctatatgtattttaataatactcaccccccattaccctctttcaccctctcaccccctcctgattcccttcctattcccaactcttttcttctacttttatgtcttttttttttttttgataactcattggatttaaggaggcctccttatcaggattacttactagcaacttagcagtggctgaaccactaaagatttgcttttatatctccagggaaggttggagctttgtgagcccctcccttttccaggacagaatgttagaagaacaatcttgtgcaaatctacaggtaatcaagagtttaacagccatgtcatgcccagaactctgtgttccaaactgctctcccaccgtcctcgggtttttacatttttctgtttcttccaagatgtttcatgagccttgaagggagtgctgtgttctatttatacacaggaaatcatttattctttgtcctgtggttatgagtttgcatttacaaccatttatactactagaaagagaagggcttctttcctgtttttgtttgtttgttttttattgttattgttggtttttggtgtttggtgtttttttgtttttcttttttgagacatttgagacagggtctcactatatagccttggctggcctggaactcattctgtagaccaggctgaccccagagacccgcctttgtttgcctcccaagcactgagattaaaggaatataccaacatgattagcaagagaaacttcttttactaagctgagagcagtaatattctataggcatgaacatggttatttagatggtaatttgatggtacattatgttcactgagcagaacaactgtagtagcttaatcacccgggcctgtgatctctttaactacaagcttttgacctgttttatggtaccagtttttctttgcatggaattccttgtttgttttgtttagaggaaaatatttctgtttaaattaagtttgttagtacgacacccccccccccccccgtttggctgaagaaaaccgacttttcttcctctgtagccactgactgccaatagtttctcagctaggggtagaacctcacctctatgctggagggttttttttaaagatttatttattttatatatgtgagtatactgtcactgtcttcagacactccagaagagggcattggatcccattacagatggttgtgaaccaccattctgggaatggaactcaagacctctggaagagcaatcagtgctcttaactgctgaggtgtctctctagcccatctgtactggagttttaaccggtttgatcttatgcaagttttgtgctgtgctaagaactctatttgttatgggtttttgagtgcaatgactccaacctgtccagaagacattatttcacagcagtctactcttaaagtttttctgccccttcttccacaatgcttcctgatccttaaggaaaagagtgtgatataaacttgtaattttttttccaagacggggtttctttgtagcctaggctgtcctggaactcactctacagaccaggctgtcctagaactcactctacagtccaacctggcctggcctcaagagattccccctacttctgcttctcaagtgtgccaccaaaggtgtgagccaccattgcccggctaatccctatcttacaatctcctaaccccccccgcccccttctcttaggttctctgagcctttcagggagagaggtgtgatatagatgtctcatttagagctgagcactccacagtgacttactctctgcattttgaccagttgtgagaaattgtattaaacatcatccactacataaagaaacttctctgatgaaggggcctatagatatttagaaatatttagaaggtagtataatgaagggaagatgaataatggaggtaaaggtttaagtggggagtagatatgagggtgaagcgggggaggtaaagggataaccagcactaaagatgtttgaaaaagccatataaataatagtttataagcttcctgttatatgtacatacatacacacagacaagcttaatttaatttacctcacataccaggataatgcctatctcagaagctgtagattatcaaaaagcccagtgccaggggtaaaatactccatatgggaaggtggtcatagaggtcactcccctccaaaaaaccaatacagagtattgttattgttcttagttattcactagaacttgttggtaagatcctgttgctgaagacaccatatactttgatcacaggatatggaaaactcaagcaggttctgacctggaagcattcttcctactaggtaactttcatagtatcagaaggtgtttttgtaggctgctgggaaagaaaaaccatcaacactcttacccagctgtgaatcctgtgagctacaggactggcctggcatgctcattggctcaatagtagcatgaatactatggaggtaaccagcagctttctaattggacttaaggcctgatccacaatgggaaactcatctatgttctgtaaacctgcccaagaacttgttgttaagcaagttataggctctgctaatataattttgctaaagggatataatatcaaaacgccttctgaattctttttttaaaaatctagttctgttccttctttcctcccacctccctctgcttcctcctctttctttattcttccctcctttctgtgtgtgagcttttgtgtatgtatgtgccatggtgttcatgtgggggtcaaaggtcaacttgttggcatcaattctctctacaatgtgggtccttggcatcaaactcattaggcttacagaacaagcacctttaatctgcttaatggctttaccaaccctcttttttttgtttctccctctttcaaaattaacttttatttatgactatttatggacaggcatgcatgcctgtttgtgtgtacctgtgtgtgtgtactgactgagtccttgtgcttgcctgtgtgtgtgaattcatacctatgtgtgtgtgtgtgtgtgtgtgcatgccagcatgggcataagtccctgtgtgtacattcgtgcctgcgtgtatgtgtgtgcatgtttgcatgtgtgcttgcatgtgtctccctgcatgtttgtgtgtatatagttttgtatatagtttttttctcccctgcagctcaatcccagacaataccaggcaagcattctgtcattgaattatccccagtctttatccctttccttttagtctacatttaaacatgaaatgagattttatttttaaattaagtatgtgtatgtgttgtatgtgtgtgttgctcgatttgtgggcagggggagggcttgcatgtggaagttagagaacacatttgtagagttgattctccttttacctttctacataaattccaggaactgaactcagggcttcaggctttgagggaatcatcttgccagcctctgttttagtttttgaaaggggtcttacatagctcaactgacttcaaacttggctatgtagctaaaagtgaccttgaactcctgatccacctgctaccaccccctaaacttggattatagacctgagataacatttttggttttattcagtactggggattgaacccaggactttgtgtatgctatgtaagcatggtaccaaaatgaacgatccttaatctttcctctgttctatatgcctctgtttatattttccctcctttctgagggttacttaaacctgttttataattccatattgcttttttctttagtatatttgagtgtggctctgtatacattttcactttttactacagtcacctggtatttgtatttttccagttcaagtgaggagtaaaaatttctctttaagttcttttaatgtgttctacatacattgagaactacatcagaatgtttggttctgtattttaacaggttctctagatgttcttgatatttagaaaatgagaaactttcaggccagtggtggctcacgcctttaatcccagcactcaggaagcagaggaaggtgaatttctgagttcaaggccagcttggtctgcagagcaagttctagaacactcaaggttacactgtctccaaaaaccaaaaaaagaaaaaaattcgaggaacatgagtcagttggtagattgcttggttagcattgatgaagctaaggttggatcctagcatcacataaacctgccatggttgtacagtctgtaattctaatactgaagactatggaagccaggaggattagaaattcatggtaatctttgctatatagtgagatgaggccagcctgggatacatgagaccctgtctctgaaaacaccctgagaaattcttgtcttgttagaaaatggtgacttaccagagtctgcgttgatgagaaacggttttattttgaacatatatcaatatgggacttgctgatagattggattgggattgtgaaagaaagaggtaaggagtgacttcattttgaggagttttagtataaatgggaatagagtaatgggacagtgactgagaagcttacaagatatgtagagaatggactgttttgtctgtaacatcaggtcattttggaatttagttcttttaaatggcaaactcatatgccaggtactgagcagagagcagaaacttctcgggtacatggagcttgtttagtttctttagcactactccaagtcctttgcctggaggcaatggagccagtgatgagaactatgggtacctttgcttctgtttttgtagattgtgttctatctgataaaggttgttgcaagaatcccaaaccaaaaatggatttggattttttctgagatttttttttaaatgaaggaaggtaaaatatactctttctttctttatttatgaatgaagatattggctttccaagttataggttggtgacaaggcctagctccctgagtattctcagagagcagaggctgagcatattggaagacagatagaatcttgagcaaaatttgtctggctgttctggctcctctgatctttgggtcccacttagttccacagccctggacgaagcaatcaagtgcctgattttacattcttgtagcatttggttctacttacggttacattttagctgcatacttggttagatattacgggctcatgaagaccaacatttttgtattatgcggctacttaaacttagttttgtaattgctagcaatttgcctaactattcagactcattttcttattgttatagatagcatttatcatgtattaagcacttgaatactttaagttcattgaatcctagcaacatctctaaaaggtggttactagtaatttttctgtttcacaacttatagaaactgggacacaaagaatttatataaacttcctatgctcacacagttatatatggaagaagtaaaattcaaaccagatagtttggctcctatatctttttattttttatttttttcgagacagggtttctctgtgtagccctggctgtcctggaactcactctgtagaccaggctggcctcgaactcagaaatccacctgcctctgcctcccaagtgctgggactaaaggcgtgcgccaccacacccggcctctttttatcttttttttttttaaagatttatttatttattatatgtaagtacactgtagctgtcttcagacactccagaagagggtgtcagatcttgttacagatggttgtgaaccaccatgtggttgctggcatttgaactccggacctttggaagagcagtcaggtgctcttacccactgagccatctcaccagccctctttttatcttttaacctctgtgttttagtgtctcaatgctgtacagagtgtctctggtttgttataaagattaaatattataatatatttaaagtccatagcttagttttcttttatgtaggcttttcttctcagttacttatatgtaggctttaaatttactcattcatttggcaattattgttctgttttacttactttgtagcacttaatgaaactgttctgccattgcctgtctctttccctctagaatgctcattctataggaatctacatacaattaatatttatttgtatactcatttacttagtaaatatttgttgagtgcctacactgagcccagcttaatttcagtgctccatgttatactaattctcttcaccaaggaagctaccctgagtaagacagcatttactactcttggtacttggtgataattgttgagacagtgcattaactttggcttatctgcctccctagtttaaggaattatctagcccattgcatgtttgctgaattagtatggatagtaaatgaaaaaagactgggagatggaagatctgaggacttttggtgaataccagaatttttgtgtgctggatgtagtcagcacaaatggcaagtgaataaacatttattgttggtcagcataggtagaggtgaaataggtagtatgcagcaggagtgtctgcagtacagaagaggagcaatagcaccatgggctagcaatatgaatccagctggttttactcctccccacctgcaaccaatgtaggccacaatataataatgaaccatacaaagtggtatagcccactgtggagtgtggtcttactcattctatcaaatagcctgatggttttacttttgtccatttttttgtggtgttagagatcaaacacttatggcctcattcatattagacaagtatttaatctctaaaccacatccccaggccttttttagattaagggtggcttcatgagcatgtgaatcctgttgtcacatggagccctacagttgaggtttaatgcaatgcttgttgttccaaaagtcttaatatattttaactttggatttttgtatgtggcatcagtggattgtgtgctgagaacttagatcctagagttctctggtcctacatcttctttcttgccttcctgaaaaggatcatggctaattgcctgagactctgtccttaagtggagatgtggaaaaattcagggtccagagcatgcatactgtactgagtgatttgcctttacccccaagagagcgtgacaggaaaaataaaaaactcatattgccaaggttaggtctataattataattactcaggaagctgaggcagaagaatcacaaggcagtttagtgagaccctatctcaagtaggatgtttgttttgaatcagggtctcattatgtagttacagctgttttggaactcatagaccaggctggccttgcactcacagaggtctacttgcctctgcctctcaagtgctagaattaaaggcatacactgctatacttgtattgagaccctatctcaaaaaaggagaaatagagctagagttttaactatgtgacagagccttgcatgtatggccctgggttcagtccctagccacaaaaacaaaacaaacaaaacccagaaaaaaaccagtagtaacaactgaacttcatgtgtattagttacttttgtattgctatgataagcaatacaaaatgcatgcctgaagcaacttgtagaaggattggtttattttgtgtttatagttccacagggataagagtccattacaatcatcataatgacagtggtggaggtggaggtggtgcatgtgcatggaagaaagcaccaggaatggcagtaggaacagcaacaagcagagaaacctcgtggcttttgaaaccttagagcccaccaccagtggcatactttctctagcatactttctctaagtctagccaagcagtgtaaccaagtgtgaaccaagtgttcagacacacaagaacatggatgatatctcattcaaattccacatcatggtgacctgaaagaccacagaaagtaaaaagctcctttttatgtttctgaagaaggggctcttgctttttatttatagtaagcatattcatttatataattgatgctgtgtgtgagggataaaagatgacaccagagatgcaaggcctttttaggccatgggcaattcattcttaaagaaaaattgggagtacatacataccatgcatgtccttttgggtctgaattacctcactcaggatgatattttctagttccatccatttgcctgcaaaactcaggatgtccttgttcttaatagctgtgtagtattccattgtgtaaatgaaccacattttctgtatccattcttctgtcgtggggcatctgggttatttccagcttctggctatcacaaataaggccactatgaacatgtgcccctgtggcatggttttgtggcattttttgggtatattcccaagagtggtattgggtgagggaaaaggactgaagctctgagggccagcagtaagaatggaaacaggcagccttgggagataggaggttggggggtacccttcagaatgcaccagagacttgggaagtaagaaactctcagaactcaaagagagggaccttagatgaaatgcccgacagtagagaaagggaacttatagagcccaccttcagcaggaagacaggacatcaaatgagggatggggttgcaatcccaaagtcacaactctgctccataatagttcctgtctgaatgaattacagggatggaaatggagaggagcctgaggaaaagaaggtccagtgacaggcccaaagtgggatccagctcagggggaggccccaaggcctgacactgttactgaggctatagagcactctcaaaaagggacctaacataactgtactctggaagacccaacaagcagctcaaagaatcagatgcagatatttgtacccaaccaatggacagaagcagctgacccctgttgttgaattagggaaggctgaaagaagctgaggagaagggtgatcctgtaggaagaccagcagtcttaattaatctggacccccaagatctctcaaacactggatcaccaaccaggcagcacacaccagctgatatgaggccatgaacacgcatacagtagaggactgctgtgtctgtgctcattcagagctgacgcacctaaccctcaagaggaagccccggggagtttagaggtcaggtgggctagggtggggtggggggtggggacatccacgtggaggcagggtggggaggaggtatgggatgtgaaacagtcgaagggtggacgggtgtgtgtgtggggggggggagttaaaatatggagtgtaaaaatgtaaataataaattaaaaaaagaaaaagaaaaaatagggagggactggagagatggttcagcaattaagagcacttgctgcttattttttcagaggagctgagttcaaatcccagcacccatgtcaggtattccaaaactacttgtaacttcagctccaataccctctttctgcttctaaggacaccctctaatacatgtacacacacaaaaaaatgaaaataagagcctttgaggggttttgggtatgagataatgagagattacatttttaaaaatgtaattaattgatgttatgtgtttttgtatgcctgagtatgtatctacaccatgtgtgtgctgcagcccaaggaggtcagaagaaggtgttggatctcctagaactggagtttctggatcctctgcttaattactgagccatttctctagcccacacttcaatttttagtgatcattttggtatggagaatcatttttcgtggagacaaagttgaggtttggagtctatttgagtgagtaggacaatacttctagttagagatcataatctatgttatggatgcagcagtaaggatgacagaggcacacaagtgagagctaaagaattaagatatagaactgataattttgagtttttttaccatgtttaaattgctacccattccaaaagggggccattttgagctatataaatgtagatagagatgtttggctgtgaactctcagaaaggggcagacaagaaggaatgaaaggaaaagaagagtgggtttttaaggtcagtatacatgtttacatagtattgtaaagaaagagaaagaaacagggtgagagattgaagataccatagaaagaagggacagataattgataaaataaaaaaatgtgatctgggtgccagcactggctttaggaggaaggaaagatagcatttccacttttaacaggaggaaagggtgggtgaaagaagaagagctgttattagaagtcaaattttttcttgtctgattatttcctttctgttttatttttcaagaaaggaagtaaatcatttgcatggagagaggggagagagaatgggatcaagtttactgtggattatggaaaggaaagagctgagtaggaaattatgggagaattatcagtcagtataatctccccccccccacctcttccacccaagtacctctctccctctgcctcctgtgattattttgttcccctttctaagtgggattgaagcatccatacttgggccttccttcttgtgtttgtttgttttgttttgttttttgaagtttttttttttggggggggggggagagtttccagactgggtttctctgtatagccctggctgtcctggaactcactctgtagattaggctggcctcaaactcagaaatccgcctgcctctgcctgccttccttcttgttaagaccatgtgaagctgatagaacacttaacacagtgctccttagactgtatgatgaagaacaaggacatatttttctttatttttggtctctaatggattaattattttataaaataaaaagaggatgactagtaaaacaatgtaatcaaaaagcaatataacaaacctcaatttttcattattagattcaatggctattaaaacatcctgccagttttttgagaagtaatactgtcgttttctgtacttactatagacctgtagacagatcagtagtagtctatggattagactagtggttttcagccttcctaataaatttcatacagttcttaatatgtggtggccctcaaccataaaattattttagttgctacttcataactgtaattttactactgttatgaattgtcatgtaaattaataaatgtcttatatgcaggatatctgatatggtcatgacccacaggttgagaataactggattacactttgagtagcactagtatggagaaaataatttccttgtacaccaactgtatttgtttaaacttgcaaagtaaggttctgttttatattgttttgtttttagactgggtttcatctagccaaagctgaccttaaactactgattcctctgctcctatctctgaaattttgagattacgggtttattagttacttttctgtcactgtaataaacaccatgaccaaagcaactaaaaacagaaagtattaaattgggcttatatatgtttcagagggttaggacccatgatgaaaaagagaaggcatgacaacagaaacaactgaaagctcacatcttgaaccttaagcaggagtagagaccacactagggttggtaggagtctgttgaaatctcaaagactgcgcccccacaccctgacacaaatcctccaaggtcatacctcatcctttccaaatagttccactaactggggactatgtatccaaatgtatgagcctatgagggccattctgattcaaaccaccacagcacacatgtaccaccatgcccggcaagtatttcttgaaggggaagctagagcagtttatgtatcatggtataggattgctgagggtgtgacacggaagttgagagaggagacaggcagtggctgtttttggtagaaaaggcatatctgtaagagttcaggagtgatgacagcacagtttcctttttgagcagtgtccaaatataggagggacatcagacataaaacacgtatgtcatggaaatgagtgcctcgggtccaaacaaaagatttatagattaggccaggtgacgcaggccagtaactttgggaccaggaagttaaggtaagtttgaagtgagattgtgctatatagtgagaccctatctcaacaagcaagcaagcaaacaaaaaacaaactttagggtagtgagaatgataatgtgaatatggcaaaaagtaatgttaactgtcatttgtcatttatgttgtgccagtctctgtgttcattgtgttaatgaactttatgcacattatctgctgacctctacaaagttgatgctaatgtcccaatttcttgatatgctacaggtttatagacatagagttattgttgcagagatgaaggtaagggagggactggatttcaggattgatgatcataatcttggctgaaactatttgagctctaccatatttttatataccttgttatatgtggttgataaaaggcttaaagcatttaaaccatagccagaaattattttaagggttcttgtcatctttcttggtgagggaagggcttaatatgtgaaattactttgtatatatacatacaaaattaaatctaaatgaagcttcaaaatgattacctatatttcttcattcataaatgttgttggctctaaatatttctggtggttttatttaataaaatatctcagcaaagttctaagtttgggttctagtattttgagtatgttaggcaaaataaaatattaaaataagacttatttttaaaaaatctttttgtattttgagattttttcgtatatatcccaggctggtctaatacttgagggtagcctgaaacacatgataatcctctttcctctacctctagaatgctggaattagaagtgtggattagaggactagaacatctggttctttttaccttttttgcttttttgagacagggtttctctgtgtaacagccctagctgacctggaacttgctctgtagaccaggctgccattgaactcacagagatctgcctgcctctgtctcccaagtgctgggattaaaggtttgcaccaccactgctcagtccctctttttaccttttaaatgtaactatttggaacattttaaatgaattatttggggggggggattggtgagatggcttagcaagtaagagcactgactgttcttccaaaggtcctgagttcaaatcccagcaaccacatggtggcttacaataatccataatgagatctgatgccctcttctggtgtgtctaaagacagctacagtgtacttacatatactaataaataaatctttgggccagagcaagtggggctagagtgagcagaggtcctgagttaaatttccagcaaccacatgatggctcacagccatctgtacagctacactgtactcatatacataaaataaataaatctttaaaaattactgggtttatatatttctgtttattcacatactgatgctctagtctctttcagctttgagtattctgactcctaatgaatttttgccttcattgttttataccagtagaattttgcattgatgaaaatgttttataatatgtacaataaccagcatgtggctggtgaaatgtaactggtgtgatagaggaactgcatttaaattttacttaactttattttttaatttatttttatgtgtatgagtgttttgtccacatgtctgtctgtctgtacaccaagtgcctggtgctagtagaggccagaagaaggaaccagatcccttggaattagagttagagaggattgtgggccactatttagtaatcaaactcaggtcctttgaaagagcaagcagccactgttcttaaacaccaagctatctatccagccttcagatgtacttaactttaattgatataaatgtaaatcgccatatactgtactcactgatatagaacttttttttttaaggtttgggctcatgtgatgatattttcttttttttaattgaatttcattttattttattagatattttctttatttacatttcaaatgctatccccaaagtcccccatactctcccctgccctgctctcccacccactcactcccacttcttggccctggcattcccctgtactgaggcagataaagtttgcacgaccaatgggcctctcttccctgtgatggccaactaggccatgttctgctacatatgcagctagagacacgagctctggggggtactggttagttcatattgttgttccacctatagggttgccgaccccttcagctccttgggtgctttctctatatagaacttttaaaaaataaaaatcttataaaccttggctatgtttttttctttttcagttgtgttggtgttgaggaggagaaggctgctgatattgatctttaccactgccctaactgtgaggtcttacatggaccttccattagtaagtagatcttataatttgtatcaggaagtaataaggcaagaaacaaagcaaaggtagctttggatagcctctgcctcatatgtgtcttccgtaggaaacagcagaagcccatgcacgtccaacagggcctggagctgttgccctaagagagcaaaaatgcatagccttatctctttcccattttagcacctacctagaggaagtacactcttctttaccaggagctttcctgagtataaaagagcatctttaactgtagatgcccctggggttttagattcttagctcctggccgttctaactcattaccacttgtctttttctggtttagtgaaaaaacgtcgtggatcttccaaaggacatgataatcacaaggggaagccactgaagactggaagctctatgtttatccgagaacttcggggcagaacttttgacaggtgaggaaatgttaagcattagagctatgggacgctggacatacttcctttcagctgttccactggctgtgccattatgtgcctccctcatgtctggatatcttctaggccctgcaaaatctccggggtgggaacttctgttttggtcagttcctaagtaacagtgaccagagtttcacttgatgtttagagtacattatgacctatttacagaaatctgcagtagctgggaagcagcttttgtcttagtcaacttataagcatctgaacaatgctagaatttggaggctttttttggtttctcctagtacaaagtaatggatttcattatgacatttccacgtatattattaaatatactttgattataattactcattctatgaccctttatttccttcccctttcctattccatattcatagcagctccccattaaatgtctgcaagagtttttaatggtcagcaaatttaattctctcattatagaggagaggaaactttaaaactaaaaatagagagctgtagtgtgttttttcaatcaaaaagatacttttttttttctttcaacttacctggatttagtaaaaatgaattgaacaaaaataatgagttagaaattaatgaataaagaagtatcatatggttttaaatccattggactgttttcaggtttcttgtacttcaagtattatttagattgattttctaggttattagtttaaaaaaattaaaggctgtcagtcccctctgtacctcagacccctcagattccttcttctacttacatcagctaattttttatattttttcaaaaatagtacttgtatccacatatatgtggttgtatatccctttttatttttgacacaaatggaagcattatgttttgtatattacctttatttttaaacctaaataatatgtcttggaaattggtctacaacagcatgcataggtggttcttcctttcaggatcatttattatttcattgaatggatacatattttatttgaccaatcctatagtgatggacatttaaattgattccagcaatttgctgttattaagaaaacttctattggccataccttttttcttcagtaatgagcattgaacctaggagtcacacatgctaggcaagtactctaccactgagccatatttgcagcctcagtgaatatctcttaagtttttgcatgtgtgacaagtatagatgtagatttaactgtgtaaaagtaaaattgttagatcaaaaaggatatgccttaggaatctgtaaatattgccagttgtttgcataaagcctgtacaacatcacagacattttgtcaaagctctgatgatttttatgattaaattttcaaaatttagtgaaatctttttattttattaccttaattatgtaagaggttgatttttgtatatttatgggtcatatttattgatagctttctcttttctaaagcatttcccatattttttactgagaaaatattttcatgtaacatattctgatcatgtttttccccttcagttcctcccagattgttcctatctacccaactctgcaccctttctttctctgtgtttagaaaacaaacgtacaaagcaaaaaagaaaccaacccacaagaatctctctctctctctctctctctctctctctctctcacacacacacacacacacacacacacacacacaaaacctaacaaagcaatatagaacaaaacgtctacaaaaatacctttgagtttattctgtgatggccatctacttttgggcatagagcctacccttaagtgtggttaataaattgggcagtggtggtacactcctttaatccttgcagcagcagaggatggtggatttctatgagtttaaggccagcctgatctacagatctcattccaggatagccagggttacatggaaaaaccctgtcttgaacaaataacaaaaaagtgtggttaatacttctccaatgagacttcattggagaaaactaacttattatattatatattattatattatcatatattatattatactattatattatgtatattataattatatattataacagctttccttgcagacaattttagcttttaattcagatcaatttatttattatcattttagtaaaaactgggtcttgtctcttacatgtttttcccctagtacctttatgactttcgtttttgcagtttaaattttgggccatccagaattatatagagtgaaacagatacagagcttattatgcttgtttcaatacaactaatttcccttttcttcatagtcttttttttcttttttggttctggaggttccaatcatggactcattgcaagctaagctaatgctctggcactgtgtatacctccatctatctaccactctcttgtctccattatgactaggagtagttgagggggtagagaataatatgatcaaaatatattgtatgaaaaaatttaaaaacaattcccatcttgtaagtacatgcattaagaaagtggttgtaaatactgttttttaaaagctcagtctttgctctcttcgccaagagaagattggatgttgctattttgggttagaacaaatgagtcaaaattgttagttatatctcttcttaggtaagctattgactaatttcctttgttgttcagaaaagaacatcctgttcaccatatcttccctacctctgtcagtgaccttgtctactgctttggaaacatcatgttttttcctggcatatgaagtttatgccattagttgtcaacccatataagactccctcagaagactatatcccttttgtgagaggccattaaggcctttagtgagcagaatctcaaggtcatgttttttttttctctatggcccacacagctcagatgaagtgattctgaagcccactggaagtcagctgactgtggaattcttggaagagaatagcttcagcgtgcctatccttgtcttgaagaaggatgggttggggatgacattaccctctccatcattcactgtgagggatgtggaacactatgttggtaagacaccacagactctcttaactgtgacattaactgttcctatcagaatttaaatcatgcttggcatggtggctcacgatacctttaatctcagcacccagagagcagaggcaatcagatctctgagtttgaggccagcctggtctacatagtgagttccaggatagtcagagccacatagagagaccctgtcttgaaaaacaaaacaaacaaaaagactagagtcatttctctaatccacctttttatatttgctttccagccatcttgagagtatgatgtgaaggccttgcctagctagagtcattctttggcaagacaagagacataatactactcttcttttcctttttagctttatttttttttaattcagctattttatgtacatgcatgctctgtcttcatgcacatcagaatggggaataagatcccattacagatggttgtgagatactatgtggttgctggaaattaaactcaaaacctctggaagagcactcaagtgctcttaaccactgagccacctctccagccctaggaacttgtgtgtgtgcgtgtgtgttgggggctaatgacagtatttatttgattcattttcttcttaataagactacataaaagtaggttgagccaatttttttattaattcgttttatttatttacagtctaaaagttgtcttccttcctggtctattactccctgagttcttcactcccttccccagcctctgacagggtgctctcccactcacctacccatcctctccttaccctcaccagcatccctccccactgaagcatcaagcttccacaggattaagcgcattctctcccactgaagcaggacaagacagtcctccagtacatatatactggtgctacatatatacatgtatgctccttgtttttttggcttagtctctgggaactctgaggagtctgggtcagttgacactgttgttcttcctatggggttgcaatcccctcaccttcttcagtccttcctccaactcctccattggagtccccgacatcagtccaatggttggcagtaagtatatgcatctgtcttagtcaggtgctagtagagcctcccagaggacagccatgccaggctcccatctacaagtacaacatggtctcattgagccattttcttttaacctgggaaattttagggatcatagtctctgatacctgttcttactatattttactggagcatcagtgaaggaggagactagaagagaagacataaagaagcagatccatggcagttagactatgtgagagtttctatcagatagctccatagcccccacccagatcttgagagagtgtgatagatttctactctctgccctgaacacatagtatctgaagatagaattcctgggtatatggccattctaggtgctggtgagggaacaagaagtttttgtccccgagagacataactcagtacagaactcgtgtctttatttcaggttctgacaaagagattgatgtgattgatgtggcccgccaggctgactgcaagatgaaactcggtgattttgtcaaatactattacagtgggaagagggaaaaagtcctcaatgtcattagtttggaattctccgataccaggtaggaggggaggtaacagaaaaagcctgacagggcatctaaaacttgtagatatacttgaatttatattttggtttgattccttcattctagcagttttgtttctcattttggagaagggagttggcttatactttaaagggcactgattcaattttataataactaagtcagtttcttcagtttctagcagagctagattatatagaatctattgtactaatctgtcctttgttctagggcatcttcctttgatcttttcctagtatttatatttttatttatgactgtcctaaatgaagaataagtcctcagtctttggaaatagattttaaaattgcaagtagtttttctaagggtaggttgcctacatttaaaagggaaaaattatatatttttttaaaagatttatttattttatgtatataagtacactgtagctgtcttcagacacaccagaagagggcatcagccaccatgtggttgctgggaattgaactcaggatctctggaagagcagtcagtgctcttaaccactgagccatctctccagtcctataatctttaaaatatcctatcagtacttacatattcaggactgtggtgaatattaagaaattctaacatatctttttcttttaggaaatttactaattgcttattggcattttaagcttcaaataattaataaaaagatttgcaagaagttgcaaaaactggacagcaaggtcctgtgtacttttcattttcccacagtggtgacatgattataatattaaaatccttgctgttgcttttaagattaaagaacctaaaggtatttaaaaaaactgtagtttctttaactatcgcttaatccagaaagcctgtgcgatagcttgcagacatgcagaaaaggggaaaaagaaaacgggaacagaaagaaaataaaaatgaggaaccaggttgcatatagataggtactgtacatatgaatgcgtaattctttgtttaagtagttggtggaagtagttagtggaaatagattgcagttttcattgactttcctgaaggtcaaaacaaagaggagtgcataatattaaaagatttgtggatttatgtgggataaaacagccagatgtatggaactgccctctaggaggttttctgtaattgtaagggcttttcataaagaagatattaaagtagggaaaggacagactgttacaaagtgctgaatgagtcgactggggaagcgaaataaataatgggcatgacaatttagtaataggaatggccacttactattggggaaggatttggggctaggatttaggactggatttggagctgagtggagtggagtgggactactgttaaacttttaggaataaatgttgtatatacctttgggttctgtggagaaaatgattttttaaaatttgttttatcttactgcagtattttattcaggcttaaaccttcaattttcagtcagctcacgcttcttttcaccttctttactaggctttcaaacctcgtggaaacacccaggattgttcgcaagctgtcatgggtggagaacttgtggccagaggaatgtgtctttgagagacccaatgtgcagaagtactgcctcatgagtgtgcgggatagctatacagattttcacattgactttggtgggacctcagtttggtaccatgtgcttaaggtaggaatgagtatgacacctggaggcagccagacccatctgcctcgcatattctatctaggcaatacttgacatgattaactctatcgtgttaattttgaagacagaattcctgggtataaggccattttaggtactggtgaggagacaagaagttttttcccctgagatacagaattcatttctttacttcaggttctgacagagatattaatgtgattgatgcggcacatgtgggtgtgcctctacaattttgatgcttaagcaaaaaagttgttgaaggtaggcatggtggcttttgcttataatttcaacacttgttgggttgtggcaggaggcttgacatgaataagaggtcagcctgagcttcatggtaagtttcagatcagcttcagtttagcttgagctaaagaatgagagactgtctcaaaaaaacccaaattaaaaaaaaaaaaaaaccacggagaggaaggcatgcagcaggccctaggttgcacccctagtactaaaactacttttttgaggtctagggacatagcttactggtgtagtgctttcttaacgtgtgcaaggtcctggcttctatctcaagtaccacagatgtagatttttttggatagcaataaattacttaagatattccctaccttctttaatgaaggaattctatttctcgcaatatatatgaaaatgtctatattaattgtagaaatttcttggtaacatgagttttctctccctcaaactttaatatatgtactgtagaattcatttactttctccaaagtaaccaaagtaaagtggctgtatttgttttttttttttctgagacatttgggagtatttccagacatagtgtctccttgtgtctaataattcattatttagttcttaacaacggtattttcttaagtaattacaggatagttatcaaaataaggtaattgataggatagctactatagtagctactctctataaaggctgccagttttttcaattgtatagtacatacagttgtgtcacgcatcatagttttctgtgtttaaatttttgatatattagctaagctatggagttatccttatgctaaggtgtggttctttttcactaagttgtctatcagatgattatccaagcaaaacataattaggaaataaaatattcttccagcagataatccatcatctaatgaaatataatcttctagaagaagtccttggatagttactgaatttttaaacttattaactttgattgcaggtatgagaaggaacactgtataactggcatttaaaagcagattcaattttcttctcatcagtaatatggccttaaattctagggctagtagtattgatcttacctatagatgccatttttcatttggtattacatctaaaataagagcaattggtatatatttctcctaacttaaatagatttaaatacccctttcaaatattttttgggaaatttggagaaaatctgagcagtttatttaaaaatgtttcttgatgggtttgagaaacagctctggcatgctgatatagatgtgggtggagactgggagagagatttgaccatttggagcacccttcctcgagaaggacttttcttgaaatctttagtatggtatctttttatttcagggtgagaagatcttctacctgatccgcccaacaaatgctaatctgactctctttgagtgctggagtagctcctccaatcagaacgagatgttctttggtgaccaagtggaaaagtgctacaagtgttctgtgaagcaaggacaaacactgtttattcctacaggtcattcctgggtccctctaggggggaggatgggaaaggcagaaagaagggagatagtggtactgtaccaaaccctgtccataatttattaatctcattatgtgacattttttttctcattagctaagaggttaaaactagacctcaagaaaatttgtatgttggccagtaggtagcatggttttgtgtggaggccgcagatgacagaacaagcaggaggaggctgatggagcattatatacggggttaatgttaactgggtataccaatagagaacaggactcagtcctatgattctagggatactaactcagaggctgatgttctagtctataacattgaatggcc

SEQ ID NO: 321 - DNA, 112617 bp, mus musculus
ctccaccttcacctcccgtgcccgagcctcgtaagatggcggcgggctcgtctctttcccagaacgccgccactctcaatatggtagctgtttaccatatctctccacccctctccgcctcaactgcctcgcgattttgaataaactttattgattgctttgaatctcctacaaccccccgagagtggcttctcccggcgacctctccggcggtctttctccagccgccgcaagcctgtctcgcgaagggggcagcgacaaagccacttgccagtgcgcccggcggccccgaccccgacccccagccccggctgagacctcggtctctagaaggctctgagggccagacggtgggagggctgaggtggacactgcccgaaagccccgtcagagcccgggcactgcgtgacgcggcatgtggtttctaggagaaggcaagtcagcttcacagtttggcagcggcaatcccagcattcagcgcgcgccgcctcgggccggaactgcccggccagcctgtgcttagcgcagagctgggttgccccggagcgagcccagcggcaggcgagtctctggggctgagctctgttccctgaggacttgccccctgcagcctcgggcatgaagagagctctgtagcgtttgggaccgtggacattttttatcaggtttggggcataaaaaaggttcctgtcagtgtgtgtgtggggaggcgtagagagctcctcgtaagttttgggggctgcaagcaagctgcgttctaatttaagacgagacgtctgtcaggtgaggggtccagccgaaccctcggcggtcggaggggattgcaaggcaatgcctgccatttggagctgtggaggggaaaacaaattcttcgcttagtttcgcggcggcgaggagattctagtgggtttcctggggcttcgaagagatccttttcagtgtcagggggggagatgagctccctgtcagctttggagtggaggacgaaattgcggtttatttcattttggagcagaatgagactccttactgctcgggagggaatgatactgagaatgacgaaaaggatcatttaaactctcccaacgcgatcccaggactgtgatttgagttgggtgcctagtcttgtttgtcttgttcccgaaggctttggggggtggggtgggggggcgtaattcggaataacctgcggagaccttcagggatttccgcatctctgcttcttcctattttggggggctagacagggtctctggtctctccctcagcttccctcttcccagcctcatcctttatgccgcggtttgcgtcataataaagggagctgagagtcctgggaagcaagagggcagtgaagagagggggttcagtgagggattaaataagcttcccgaaagctttcagatatttacatgaaacccggaaagaagttgtcactgacttcagggccaaagaaggtaggggtctgggggaggcgtttggaaggcagggcagagcagatagcagaacgttcttgctgttctttccaagtgaaagaaatcctgaagggtgggtggactttctccacttaactcctgcactctcaccagctgtgttgagtcctggctcggttactccctttttcagaactggaggttggtacccagggggtggggtgggggcggagacacggaacgatttggaaacccggggccggaggagtcacttggtaaagaagtgttgtttgtgtctagccatcgtctagagaaggcgcttgttgctgccttcagacccagtaaagcttcaaaactggcacggcgcaaaacgatccaaccccctgtgaagatggcctcggtgcctgtgtattgcctctgtcgactgccttatgatgtgacccgcttcatgatcgagtgtgacatgtgccaggactggtttcacggcaggtaagaagggcaggccaggctggtcagggagcattggccaggtgtgttgttttcacttgctctctcctcctctcagccctgttttctacctactgctcagaaactagcccctccgtcaatttactagacctaggtttttctatcgctccttgcccaacaactaggtcctagctgacagtggtctgtggtttctctctgtttccctatgtatatttattgtactttgtgtatgtacatgaatatacatatatatgtatatatatgcatacgtatttgattttctagctgcgttctagctacaaagaaattatcagttgtatggttgtgttttccctcgtatcctggctttgggggaggcagcactgcatttttgagatatctgagtttaagaacatggatttctttgtaacttactatcagtggccttggccaaagttgcttttgcttctgtgagcctcacttacaaatcaatacctctttcatagctgtaaagcagtttgcttgcattctataaatggatgcagaaccagaaaaatattttatttctgtgccgtctgcaggactgtctaactacattaaaattaaaagacgtagggtaaaacaacaggacaaatgcacctgtctgtcacccaggtttccagtgagattagtgtatataataaaaatcaaaatattatcctattactgagggaatttgtatactggagtttaataaaaaacagtattcgggaccattctcttactatataagttctagaatgttaagttgtcaatttttaaaggagctgttcctgttatactcaaaaacaaagtaagggtggggtcagtgggtctcatgttcaaggcctgcctgagccagttcaaggccagcatggcaacttagcacgattctgtctcaataataataataataataataataataataataataatgtaaagagcttgggatataattcagtggaaagctcttgcctcaaaatatcaaaaaaattaaaaaaaaattatttaatcttatagttgcacatatgtctgttacttcctagaggtagagataccttttctgtttctttttagtatttctagtgctaaatatgcagtagatatttagtacagttttgaataaataagcaagtcataatgaaaaaaacttatttcactatggcccttagtttggaagtgtgtatgatatctctttaaaagggcttttgctcacagtgtagaaatctgaaaacacaacaggaatgaatgtttcctaacttcttaccctgtgtcagactccataactgacattccataaattattttgtctgtacccaagtctgaaagttcaaatttttcttctacttgtgcgggtttctgtatccgggtgtgtacacatgtatggaagccagaggtcagcctcaggcttccaggcctcagtcctcaggaaccagccatcttgttggttttttttttttttttagctagggtctccccgtggcctggtactttataagtagcctaggcaggtgggccagatagccgcagggattttcccatttctctccctaccactgggattatatggacttgaatctttcttacatatgttctggagattgaactaaagtcctcatgtttgcctagtaaacactttactcactgagccttctccccagcctaaaagttacacttgtgggagagcacactcctgtgagtatgtatgtgtatatgcatccatgtgtgcacatacgcttgaggagctatcaggtagctttctttactgctctccaccttatctttcatgccaaacctggagcttggcttaggctagctggctagcaagctccagagatacatttgtctgtttgccctcattgctagtgttgcaagcatttatggccatgctcagttttatggtagttttggggatttgaactcaggccctcttactttcatagcaagctgagccatctccctagttcctgaaagttagattttaaagtgtgagtgtgggtgcgtggggggtggcacttgtgtgtacatagcatgttatgaatgtggagatcacaagacaacttggaggagtcaattttctccttgcaccatgtaagaccaggaataaactcaggttgtcaggcttggtgacaagtaccacctagtgaggtatttcatcggcccaacccagattttttttttttttttggttttttgaaacagggtttctctgtacaaccctggctgtcctggaactcactctgtagaccaggctaccaggctggcctcgaactcagaaatttccctgcctccgcctcccaagtgctgggaccaacccagatttttaaaagaattaattttttttaaatgggctttagggcataggcctgtaattacagttactttggagactgaggaaggggattgcaaagtcaaggctggcctatgcaaaaaaaaaaaaaagattttttttcttattatataggtgagacatgtccactatagaaaatacaaaaaaaaaagaataatagaaggaaataaaaaagtcatctatgggtctgttggatacaattcactgttaatttttttgctgctgctgtattaattcttgttctttgacttaaaacatatgtttttataggttgcgattatattataaatactattttgtgatctccctcagtccacacccagcattttaatgtgggtatttgccaggttgttagaaaaaatctacaagatttcttttctttttttttattagatattttcttaatatacacttcaaatgctatctcaaaagtcccccataccctcccccctgccctgttcccctacccacccactcccacttcttggccctggcattcccctgtactgaggcatataaagtttgcaataccaagggcctctcttccctgtgatgtccaactaggccatcttctgctacatatgcagctagagacacaagctctggggatactggttagttcataagttcatattgttattctacctatagagttgcagaccccttcagctccttgggtgctttctctagcttctccattgggggccctgtgttccatctagatgactgtgagcattcacttctatatttgccaggcactggcatagcctcacaagagacagctataacagggtcccttcagcaaaatcttgctggcatatgcaatagtgtctgggtttggtggctgattatgggatggatcaccgggtgggtagtctctggattgtccatccttttgtcttagctccaaactttgtaactcctttcatgggtattttgttccctattctaaggaggaatgaagtatccatccattagtcttccctcttcttgattttcttgtgttttgcaaattgtatcttgggtgttctatgtttctgggctaatatccactcatcagtgagtgcatatctaatgacttcttttgtgattgggttacctcactaaggatgatatcctccagatccatccatttgtccaagaatttcataaatccattgtttttaatagctgagtagtattccattgtgtaaatgtaccatattttctgtatccattcttctgttgaggggcatctgggctctttccagcttctggctaatataaataaggatgctatgaacatagtggagcatgtgtccttaccggttggggcatcttctggatatatgctcaggagaggtattgctggatcttccggtagtattatgtccagttttctgaggaacctccagactatcttccagagtggttgtacaagcttgcaatcccaccaggagtgttcctctttctccatatactcgccagcatctgctgtcacctgagtttttgatcttagccattctgactggtgtgaggtagaatctcagggttgttttgatttgcatttccctgatgattaaggacgttgaacattttttcaagtgcttctcagccattcggtattcctcaggtaaaaattctttgtttagctctgagcaccatttttttaatggggttatttgattttctggagtccaccttcttgagttctttatatatattggatattagtcccctatctgatttaggataggtaaagatcctttcccaatctgttggtggcctttttgtcttattgacagtgtcttttgccttgcagaaggtttgcaattttatgaggtcccatttgtcaattcttgatcttacagcacaagccattgctgttctgtttaggaatttttcccctgtgcccatatcttcgaggcttttccccactttctcctctattaatttcagtgtctctggtcttatgtggaggtctttgatccacttagacttgagctttgtacaaggagataagaatagatcaattcgcattcttctacatgataacaaccagttgtgccagcaccatttgttgaaaatgctgtcctttttccactggatggttttagctcccttgtcaaaggtcaactgaccataggtgtgtggattcatttctgggtcttgaattctattccattgatctacctgtctgtcattgtaccagtaccatgcagtttttatcacgattgctttgcagtacagcttaatgtcaggcatggtgattctaccagaggttcttttattgttgagaatagtctttgctatcctaggtattttatttttctagatgaatttgcaaattgccctttctatctcagtgaagaattgggttgaaattttgatggggattgcattgaatctgtagattgcttttggcaagatagccatttttacgaatgttgatcctgccaatccatgagcatgggagatctttccatcttctgagatcttcttcaatttctttcttcagagacttgaagcccttatcatacagatctttcactttcttagttaatcacaccaaggtgttttatattatttgtgactattgtaaagggtgttgtttccctagtttctttctcagtccattcatcctttgtgtagagaaaggccattgatttatttgagttaattttatatccagctattgcactgaagctgtttatcaggtttagtagttctctggtggaattttgggggtcacttatatataatatcatatcatctgcaaatagtgatattctgacttcttcctttccaacttgtatccccttgatatccttttgttatggaattgctcttgctagaacttgaagtaccatattgaatacttagggagaaagtgggcagccttgtctagtccctgattttagtgggattgcttcgagtttctctccatttactttgatgatggctactggtttgctgtagattgcttttattatgtttaggtatgggccttgaattcgtgatcttccaaaacttttatcatgaaggggtgttggattttgtcaaatgctttctccgaatctaatgagatgatcatgtgttttttgattttgagtttgtttatatagtggattacgttgatggatttccgtatattaaaccatccctgcatccctgggatgaagcctacttggtcaggatggatgattgttttgatgtgttcttggattcggttagcaagaattttattgagtatttttgcatcgatattcataagggaaattggtctgaagttctctttgttggatctttgtgtggtttaggtatcagagtaattgtggcttcatataatgaattggatagagtaccttctgtttctattttgtggaatagtttcagaagagttggaattaggtcttctttgcaggtctggtagaactctgcactaaacccatctggtcctgggttttttttggttgggagactattaatgactgcttctatttctttaggggaaatgggactgtttatatcgttaatctgatcctgatttagctttggtacctggtatctgtctaagaagttgtccatttcatccaggttttccactcttcttgagtatagccttttgtactaggatctgacaatttttggatttccttaggttctattgtaatgtctccttttttgtttttgattttgttagttaggatactgtcccttggccctctagttagtctggctaagggtttatctatcttgttgattttctcaaagaaccagctcctggtttggttgattctttgaatagttctttttgtttccacttggttgatttcagccctgaatttgattatttcctgttgtctactcatcttgggtgagtttgcttcctttagttctagagcttttaggtgtgctgtcaggctgctagtgtatgtgctctctagtttctttttggaggcactcagggctatgaatttttctcttaggactgccttcattgtgtcccataagtttgggtattttgtggcttcattttcattaaaaactaaaaagtctttgatttctttctttatttcttccttgaccaaggaatcattgagtagaatgttgttcaatttccacgtgaatgttggctttctattatttatgttgttattgaagatcagccttagtccctggtgatcagataggatgcataggataatttcaatatttttgtatctgttgagacctgttttgtgaccaattatatgttcaattttggaggaggtaccatgatgtgctgagaagaaggtatatcctttagttttaggataaaatgttctgtagatatcaattaaatccatttgtttcataacttctggtagtgtccatgtgtctctgtttagtttctgtttccagggtctgtccattggtgagagtggggtgttgaagtctcccactattattgtgtgaggtgcaatgtgtgctttgagatttactaaagtttctttaatgattgtggctgcccttgtaattggagcgtattcagaattgagagttcatcttggtagattttacctttgatgagtatgaagtgccctccttgtcttttttgataactttgtgttggaagtcaattttattcgatattagaatgactactccagcttgtttcttcggaccatttgctaggaaaatggttttccagcctttcactctgaggtagtgtctgtccttttctctgaagtgggtttcctgtaagcaaccaaatgttggatcctgtttgtgtagccagtccatgtttttttattggggaattgagtccattgattttaagagaaattaaagaaaagtaattgttgctgcctattatttttgttcttaaagttgggattctgttcttgcagctgtcttcttttagatttgttcaaggatcaatttcttgctttttctagggtgtagtttccatccttatgttggtggtttccctttattatcctttgaagggctggatttgtgcaaagatattgtgtgaatttgcttttatcatgaaatactttggtttccccatctatggtaattgagagttctgttgggtatagtagcctgggctggcatttgtgttctcttagggtctgcataacatctgtccaggatcttctggctttcatagtctctggtgagaagtctggtgtaattctaatagacctgcctttatatgtcacttgacctttttcccttactgcttttaatattctatctttatttagtgcatttgttgttctgattattacatgtcaggaggaatttcttttctggtccagtctatttggagttttataggcttcttgtatgttcatgggcatctctttctttaggtttgggaagtcttcttctataattttgttgaagatatttgttagccctttaagttgaaaatcttcattctcatctactccttttatctgtaggtttggtcttctcattgtgtcctggatttcctggatgttttgagttagaatctttttgcattttcactgtctttgattgttgtgcccatgttctctgtggaatcttctgcacctgagattctttcttcaatctcttgtattctgttgctgatgctcgaatctatggttccagatttctttcctagggtttctatctccagtgttgcctcactttggattttctttattgtgtctacttccctttttaggtctagtatggttttgttcatttccttcacctgtttggatgtgttttcctgtttttctataaggacttgcaactctttagcagtgttctcctgtatttctttaagtgagttattaaagtacttcttgatgtcctctaccagcatcatgagatatgattttaaatccgagtcttgcttttcgggtgtgttggggtatctaggactggctgaggtgggagtgctgggttctgatgatggtgagtggtcttggtttctgttagtaagattcttacgtttgcctttcgccatctgttaatctctggagttagttgttatagttgtctctggttagagattgttcctctcgtgattcttttagcctctatcagcagacctgggagactagctctcttctgagtctcagtggtcagagtattctctgcaggcaagccctcctcttgcagggaaggtacactgatatctggcatttggacctgcctccttgctgaagatgatggcctgaaacagggcctgtctcagaagctgtgttgcttctgtagtgtgcactctcacctttgcagactagtctctgagggttccgggacccaggatggctccctcacctgctccgcatagccctctcgggcagatacctctcctctggcagggaaggtgcccggatgtctggagcctgaaatgtggtctgtcccagaaactgtgttgcttctgcctttcccagaagctgtgttgcttctgtagtgtgcactctcacctgcacagactagtctctgagggacccgagacccaagatggctcccccatctgctctggtagagccctccttggccgacctacagcatgtttttgatatcttcttgtctatatgtttatcaccacttacttggtccttccctttatggttgtatacttacattatttgtactttcttacaatcaatgtgaggcggtaaaacctggggattctgggaaggtttttgtattctgatgtgattattggttaaaacaaaaagaaaaccacgactggtggacatgtttttgtacagtagatatttgacatttagaatgataaaactactgaaactttaagaattattaaacttacaaatgttttatgagtttatggatccgatatgtctttaataacatttctaaggtatattctgcttttgtttttacattctagcacaagtttcatgaaagcattcagttttaaattttcttctgcttctttctgtgggctgccagagaacaaggcacctagctgaaaaccagatccttagttagtggctggctgttcttgcttactcagtacacccctagcccaacatactcactgtactcttaagtttttactttaggtcaattggaaattacaaaatattgtggagttttcatgattgcttccaatagttaaccacgtagacccagtgtgtatatgttgtatgagtatgtatatgcttgtatgtatatgagtatgagcatatgtttgtgagcccaccaaggccagaggaggacattaattgttttgttgtatcactctgttttattctcttgagatgatttatcactgaaccctgagttaaactggtggctagcaagtcccagtgatcttcttgcctttgcccctcccaggactgggattactgctacactgactttttacccaggtgctaggatctgtgtactaaagtcctcgaacatgcaaagcactctttcaccaccgagtcatctctgcagcccaaatcctacagatttcatatccacaaatgcccaaagatgatagacttttgaatttcagttagggattatggtacataataagttgctacctggagtggttatagtaaggaaggccactatgatatttttgatgataagaatctggaactgtggaggttaagtgattttctgagtatgaatttgaatttcaaattaattgtttctagagtagtgttctcaaatttagaaaaaaaatgaataatttcattcctcttgtaaggcagtagtgttgtgctaaacactatgttttgtagaacagtgcactttaaactttagtgtgtatcaattatttgaaagacccatttaaaaaaaaacaagatagatcccaacctcagtttctgactcagtgtgtgtgtgtgtgtatacacatatacatatatgtatatctatgtatatgtggcgggggggggggactgcacatgaactacatagcaaacgtgcaggtcagagggtaacttttcaggagttagttctctgattctgccttcttgaagcaactcccttgtttctgctgcactattactccaggctagctaatctgtgaacttgtgggcagctctcttgttttcacctcccatctattttcacctcccctctcccttaggagtactggggtttacagatgtacaccactgcatctgacttttttatgcatgttccagggattaagtttgggttttaaatggtaagtgcttttacctgttgagccatatcagcagccagacctatatgtattttaataatactcaccccccattaccctctttcaccctctcaccccctcctgattcccttcctattcccaactcttttcttctacttttatgtcttttttttttttttgataactcattggatttaaggaggcctccttatcaggattacttactagcaacttagcagtggctgaaccactaaagatttgcttttatatctccagggaaggttggagctttgtgagcccctcccttttccaggacagaatgttagaagaacaatcttgtgcaaatctacaggtaatcaagagtttaacagccatgtcatgcccagaactctgtgttccaaactgctctcccaccgtcctcgggtttttacatttttctgtttcttccaagatgtttcatgagccttgaagggagtgctgtgttctatttatacacaggaaatcatttattctttgtcctgtggttatgagtttgcatttacaaccatttatactactagaaagagaagggcttctttcctgtttttgtttgtttgttttttattgttattgttggtttttggtgtttggtgtttttttgtttttcttttttgagacatttgagacagggtctcactatatagccttggctggcctggaactcattctgtagaccaggctgaccccagagacccgcctttgtttgcctcccaagcactgagattaaaggaatataccaacatgattagcaagagaaacttcttttactaagctgagagcagtaatattctataggcatgaacatggttatttagatggtaatttgatggtacattatgttcactgagcagaacaactgtagtagcttaatcacccgggcctgtgatctctttaactacaagcttttgacctgttttatggtaccagtttttctttgcatggaattccttgtttgttttgtttagaggaaaatatttctgtttaaattaagtttgttagtacgacacccccccccccccccgtttggctgaagaaaaccgacttttcttcctctgtagccactgactgccaatagtttctcagctaggggtagaacctcacctctatgctggagggttttttttaaagatttatttattttatatatgtgagtatactgtcactgtcttcagacactccagaagagggcattggatcccattacagatggttgtgaaccaccattctgggaatggaactcaagacctctggaagagcaatcagtgctcttaactgctgaggtgtctctctagcccatctgtactggagttttaaccggtttgatcttatgcaagttttgtgctgtgctaagaactctatttgttatgggtttttgagtgcaatgactccaacctgtccagaagacattatttcacagcagtctactcttaaagtttttctgccccttcttccacaatgcttcctgatccttaaggaaaagagtgtgatataaacttgtaattttttttccaagacggggtttctttgtagcctaggctgtcctggaactcactctacagaccaggctgtcctagaactcactctacagtccaacctggcctggcctcaagagattccccctacttctgcttctcaagtgtgccaccaaaggtgtgagccaccattgcccggctaatccctatcttacaatctcctaaccccccccgcccccttctcttaggttctctgagcctttcagggagagaggtgtgatatagatgtctcatttagagctgagcactccacagtgacttactctctgcattttgaccagttgtgagaaattgtattaaacatcatccactacataaagaaacttctctgatgaaggggcctatagatatttagaaatatttagaaggtagtataatgaagggaagatgaataatggaggtaaaggtttaagtggggagtagatatgagggtgaagcgggggaggtaaagggataaccagcactaaagatgtttgaaaaagccatataaataatagtttataagcttcctgttatatgtacatacatacacacagacaagcttaatttaatttacctcacataccaggataatgcctatctcagaagctgtagattatcaaaaagcccagtgccaggggtaaaatactccatatgggaaggtggtcatagaggtcactcccctccaaaaaaccaatacagagtattgttattgttcttagttattcactagaacttgttggtaagatcctgttgctgaagacaccatatactttgatcacaggatatggaaaactcaagcaggttctgacctggaagcattcttcctactaggtaactttcatagtatcagaaggtgtttttgtaggctgctgggaaagaaaaaccatcaacactcttacccagctgtgaatcctgtgagctacaggactggcctggcatgctcattggctcaatagtagcatgaatactatggaggtaaccagcagctttctaattggacttaaggcctgatccacaatgggaaactcatctatgttctgtaaacctgcccaagaacttgttgttaagcaagttataggctctgctaatataattttgctaaagggatataatatcaaaacgccttctgaattctttttttaaaaatctagttctgttccttctttcctcccacctccctctgcttcctcctctttctttattcttccctcctttctgtgtgtgagcttttgtgtatgtatgtgccatggtgttcatgtgggggtcaaaggtcaacttgttggcatcaattctctctacaatgtgggtccttggcatcaaactcattaggcttacagaacaagcacctttaatctgcttaatggctttaccaaccctcttttttttgtttctccctctttcaaaattaacttttatttatgactatttatggacaggcatgcatgcctgtttgtgtgtacctgtgtgtgtgtactgactgagtccttgtgcttgcctgtgtgtgtgaattcatacctatgtgtgtgtgtgtgtgtgtgtgcatgccagcatgggcataagtccctgtgtgtacattcgtgcctgcgtgtatgtgtgtgcatgtttgcatgtgtgcttgcatgtgtctccctgcatgtttgtgtgtatatagttttgtatatagtttttttctcccctgcagctcaatcccagacaataccaggcaagcattctgtcattgaattatccccagtctttatccctttccttttagtctacatttaaacatgaaatgagattttatttttaaattaagtatgtgtatgtgttgtatgtgtgtgttgctcgatttgtgggcagggggagggcttgcatgtggaagttagagaacacatttgtagagttgattctccttttacctttctacataaattccaggaactgaactcagggcttcaggctttgagggaatcatcttgccagcctctgttttagtttttgaaaggggtcttacatagctcaactgacttcaaacttggctatgtagctaaaagtgaccttgaactcctgatccacctgctaccaccccctaaacttggattatagacctgagataacatttttggttttattcagtactggggattgaacccaggactttgtgtatgctatgtaagcatggtaccaaaatgaacgatccttaatctttcctctgttctatatgcctctgtttatattttccctcctttctgagggttacttaaacctgttttataattccatattgcttttttctttagtatatttgagtgtggctctgtatacattttcactttttactacagtcacctggtatttgtatttttccagttcaagtgaggagtaaaaatttctctttaagttcttttaatgtgttctacatacattgagaactacatcagaatgtttggttctgtattttaacaggttctctagatgttcttgatatttagaaaatgagaaactttcaggccagtggtggctcacgcctttaatcccagcactcaggaagcagaggaaggtgaatttctgagttcaaggccagcttggtctgcagagcaagttctagaacactcaaggttacactgtctccaaaaaccaaaaaaagaaaaaaattcgaggaacatgagtcagttggtagattgcttggttagcattgatgaagctaaggttggatcctagcatcacataaacctgccatggttgtacagtctgtaattctaatactgaagactatggaagccaggaggattagaaattcatggtaatctttgctatatagtgagatgaggccagcctgggatacatgagaccctgtctctgaaaacaccctgagaaattcttgtcttgttagaaaatggtgacttaccagagtctgcgttgatgagaaacggttttattttgaacatatatcaatatgggacttgctgatagattggattgggattgtgaaagaaagaggtaaggagtgacttcattttgaggagttttagtataaatgggaatagagtaatgggacagtgactgagaagcttacaagatatgtagagaatggactgttttgtctgtaacatcaggtcattttggaatttagttcttttaaatggcaaactcatatgccaggtactgagcagagagcagaaacttctcgggtacatggagcttgtttagtttctttagcactactccaagtcctttgcctggaggcaatggagccagtgatgagaactatgggtacctttgcttctgtttttgtagattgtgttctatctgataaaggttgttgcaagaatcccaaaccaaaaatggatttggattttttctgagatttttttttaaatgaaggaaggtaaaatatactctttctttctttatttatgaatgaagatattggctttccaagttataggttggtgacaaggcctagctccctgagtattctcagagagcagaggctgagcatattggaagacagatagaatcttgagcaaaatttgtctggctgttctggctcctctgatctttgggtcccacttagttccacagccctggacgaagcaatcaagtgcctgattttacattcttgtagcatttggttctacttacggttacattttagctgcatacttggttagatattacgggctcatgaagaccaacatttttgtattatgcggctacttaaacttagttttgtaattgctagcaatttgcctaactattcagactcattttcttattgttatagatagcatttatcatgtattaagcacttgaatactttaagttcattgaatcctagcaacatctctaaaaggtggttactagtaatttttctgtttcacaacttatagaaactgggacacaaagaatttatataaacttcctatgctcacacagttatatatggaagaagtaaaattcaaaccagatagtttggctcctatatctttttattttttatttttttcgagacagggtttctctgtgtagccctggctgtcctggaactcactctgtagaccaggctggcctcgaactcagaaatccacctgcctctgcctcccaagtgctgggactaaaggcgtgcgccaccacacccggcctctttttatcttttttttttttaaagatttatttatttattatatgtaagtacactgtagctgtcttcagacactccagaagagggtgtcagatcttgttacagatggttgtgaaccaccatgtggttgctggcatttgaactccggacctttggaagagcagtcaggtgctcttacccactgagccatctcaccagccctctttttatcttttaacctctgtgttttagtgtctcaatgctgtacagagtgtctctggtttgttataaagattaaatattataatatatttaaagtccatagcttagttttcttttatgtaggcttttcttctcagttacttatatgtaggctttaaatttactcattcatttggcaattattgttctgttttacttactttgtagcacttaatgaaactgttctgccattgcctgtctctttccctctagaatgctcattctataggaatctacatacaattaatatttatttgtatactcatttacttagtaaatatttgttgagtgcctacactgagcccagcttaatttcagtgctccatgttatactaattctcttcaccaaggaagctaccctgagtaagacagcatttactactcttggtacttggtgataattgttgagacagtgcattaactttggcttatctgcctccctagtttaaggaattatctagcccattgcatgtttgctgaattagtatggatagtaaatgaaaaaagactgggagatggaagatctgaggacttttggtgaataccagaatttttgtgtgctggatgtagtcagcacaaatggcaagtgaataaacatttattgttggtcagcataggtagaggtgaaataggtagtatgcagcaggagtgtctgcagtacagaagaggagcaatagcaccatgggctagcaatatgaatccagctggttttactcctccccacctgcaaccaatgtaggccacaatataataatgaaccatacaaagtggtatagcccactgtggagtgtggtcttactcattctatcaaatagcctgatggttttacttttgtccatttttttgtggtgttagagatcaaacacttatggcctcattcatattagacaagtatttaatctctaaaccacatccccaggccttttttagattaagggtggcttcatgagcatgtgaatcctgttgtcacatggagccctacagttgaggtttaatgcaatgcttgttgttccaaaagtcttaatatattttaactttggatttttgtatgtggcatcagtggattgtgtgctgagaacttagatcctagagttctctggtcctacatcttctttcttgccttcctgaaaaggatcatggctaattgcctgagactctgtccttaagtggagatgtggaaaaattcagggtccagagcatgcatactgtactgagtgatttgcctttacccccaagagagcgtgacaggaaaaataaaaaactcatattgccaaggttaggtctataattataattactcaggaagctgaggcagaagaatcacaaggcagtttagtgagaccctatctcaagtaggatgtttgttttgaatcagggtctcattatgtagttacagctgttttggaactcatagaccaggctggccttgcactcacagaggtctacttgcctctgcctctcaagtgctagaattaaaggcatacactgctatacttgtattgagaccctatctcaaaaaaggagaaatagagctagagttttaactatgtgacagagccttgcatgtatggccctgggttcagtccctagccacaaaaacaaaacaaacaaaacccagaaaaaaaccagtagtaacaactgaacttcatgtgtattagttacttttgtattgctatgataagcaatacaaaatgcatgcctgaagcaacttgtagaaggattggtttattttgtgtttatagttccacagggataagagtccattacaatcatcataatgacagtggtggaggtggaggtggtgcatgtgcatggaagaaagcaccaggaatggcagtaggaacagcaacaagcagagaaacctcgtggcttttgaaaccttagagcccaccaccagtggcatactttctctagcatactttctctaagtctagccaagcagtgtaaccaagtgtgaaccaagtgttcagacacacaagaacatggatgatatctcattcaaattccacatcatggtgacctgaaagaccacagaaagtaaaaagctcctttttatgtttctgaagaaggggctcttgctttttatttatagtaagcatattcatttatataattgatgctgtgtgtgagggataaaagatgacaccagagatgcaaggcctttttaggccatgggcaattcattcttaaagaaaaattgggagtacatacataccatgcatgtccttttgggtctgaattacctcactcaggatgatattttctagttccatccatttgcctgcaaaactcaggatgtccttgttcttaatagctgtgtagtattccattgtgtaaatgaaccacattttctgtatccattcttctgtcgtggggcatctgggttatttccagcttctggctatcacaaataaggccactatgaacatgtgcccctgtggcatggttttgtggcattttttgggtatattcccaagagtggtattgggtgagggaaaaggactgaagctctgagggccagcagtaagaatggaaacaggcagccttgggagataggaggttggggggtacccttcagaatgcaccagagacttgggaagtaagaaactctcagaactcaaagagagggaccttagatgaaatgcccgacagtagagaaagggaacttatagagcccaccttcagcaggaagacaggacatcaaatgagggatggggttgcaatcccaaagtcacaactctgctccataatagttcctgtctgaatgaattacagggatggaaatggagaggagcctgaggaaaagaaggtccagtgacaggcccaaagtgggatccagctcagggggaggccccaaggcctgacactgttactgaggctatagagcactctcaaaaagggacctaacataactgtactctggaagacccaacaagcagctcaaagaatcagatgcagatatttgtacccaaccaatggacagaagcagctgacccctgttgttgaattagggaaggctgaaagaagctgaggagaagggtgatcctgtaggaagaccagcagtcttaattaatctggacccccaagatctctcaaacactggatcaccaaccaggcagcacacaccagctgatatgaggccatgaacacgcatacagtagaggactgctgtgtctgtgctcattcagagctgacgcacctaaccctcaagaggaagccccggggagtttagaggtcaggtgggctagggtggggtggggggtggggacatccacgtggaggcagggtggggaggaggtatgggatgtgaaacagtcgaagggtggacgggtgtgtgtgtggggggggggagttaaaatatggagtgtaaaaatgtaaataataaattaaaaaaagaaaaagaaaaaatagggagggactggagagatggttcagcaattaagagcacttgctgcttattttttcagaggagctgagttcaaatcccagcacccatgtcaggtattccaaaactacttgtaacttcagctccaataccctctttctgcttctaaggacaccctctaatacatgtacacacacaaaaaaatgaaaataagagcctttgaggggttttgggtatgagataatgagagattacatttttaaaaatgtaattaattgatgttatgtgtttttgtatgcctgagtatgtatctacaccatgtgtgtgctgcagcccaaggaggtcagaagaaggtgttggatctcctagaactggagtttctggatcctctgcttaattactgagccatttctctagcccacacttcaatttttagtgatcattttggtatggagaatcatttttcgtggagacaaagttgaggtttggagtctatttgagtgagtaggacaatacttctagttagagatcataatctatgttatggatgcagcagtaaggatgacagaggcacacaagtgagagctaaagaattaagatatagaactgataattttgagtttttttaccatgtttaaattgctacccattccaaaagggggccattttgagctatataaatgtagatagagatgtttggctgtgaactctcagaaaggggcagacaagaaggaatgaaaggaaaagaagagtgggtttttaaggtcagtatacatgtttacatagtattgtaaagaaagagaaagaaacagggtgagagattgaagataccatagaaagaagggacagataattgataaaataaaaaaatgtgatctgggtgccagcactggctttaggaggaaggaaagatagcatttccacttttaacaggaggaaagggtgggtgaaagaagaagagctgttattagaagtcaaattttttcttgtctgattatttcctttctgttttatttttcaagaaaggaagtaaatcatttgcatggagagaggggagagagaatgggatcaagtttactgtggattatggaaaggaaagagctgagtaggaaattatgggagaattatcagtcagtataatctccccccccccacctcttccacccaagtacctctctccctctgcctcctgtgattattttgttcccctttctaagtgggattgaagcatccatacttgggccttccttcttgtgtttgtttgttttgttttgttttttgaagtttttttttttggggggggggggagagtttccagactgggtttctctgtatagccctggctgtcctggaactcactctgtagattaggctggcctcaaactcagaaatccgcctgcctctgcctgccttccttcttgttaagaccatgtgaagctgatagaacacttaacacagtgctccttagactgtatgatgaagaacaaggacatatttttctttatttttggtctctaatggattaattattttataaaataaaaagaggatgactagtaaaacaatgtaatcaaaaagcaatataacaaacctcaatttttcattattagattcaatggctattaaaacatcctgccagttttttgagaagtaatactgtcgttttctgtacttactatagacctgtagacagatcagtagtagtctatggattagactagtggttttcagccttcctaataaatttcatacagttcttaatatgtggtggccctcaaccataaaattattttagttgctacttcataactgtaattttactactgttatgaattgtcatgtaaattaataaatgtcttatatgcaggatatctgatatggtcatgacccacaggttgagaataactggattacactttgagtagcactagtatggagaaaataatttccttgtacaccaactgtatttgtttaaacttgcaaagtaaggttctgttttatattgttttgtttttagactgggtttcatctagccaaagctgaccttaaactactgattcctctgctcctatctctgaaattttgagattacgggtttattagttacttttctgtcactgtaataaacaccatgaccaaagcaactaaaaacagaaagtattaaattgggcttatatatgtttcagagggttaggacccatgatgaaaaagagaaggcatgacaacagaaacaactgaaagctcacatcttgaaccttaagcaggagtagagaccacactagggttggtaggagtctgttgaaatctcaaagactgcgcccccacaccctgacacaaatcctccaaggtcatacctcatcctttccaaatagttccactaactggggactatgtatccaaatgtatgagcctatgagggccattctgattcaaaccaccacagcacacatgtaccaccatgcccggcaagtatttcttgaaggggaagctagagcagtttatgtatcatggtataggattgctgagggtgtgacacggaagttgagagaggagacaggcagtggctgtttttggtagaaaaggcatatctgtaagagttcaggagtgatgacagcacagtttcctttttgagcagtgtccaaatataggagggacatcagacataaaacacgtatgtcatggaaatgagtgcctcgggtccaaacaaaagatttatagattaggccaggtgacgcaggccagtaactttgggaccaggaagttaaggtaagtttgaagtgagattgtgctatatagtgagaccctatctcaacaagcaagcaagcaaacaaaaaacaaactttagggtagtgagaatgataatgtgaatatggcaaaaagtaatgttaactgtcatttgtcatttatgttgtgccagtctctgtgttcattgtgttaatgaactttatgcacattatctgctgacctctacaaagttgatgctaatgtcccaatttcttgatatgctacaggtttatagacatagagttattgttgcagagatgaaggtaagggagggactggatttcaggattgatgatcataatcttggctgaaactatttgagctctaccatatttttatataccttgttatatgtggttgataaaaggcttaaagcatttaaaccatagccagaaattattttaagggttcttgtcatctttcttggtgagggaagggcttaatatgtgaaattactttgtatatatacatacaaaattaaatctaaatgaagcttcaaaatgattacctatatttcttcattcataaatgttgttggctctaaatatttctggtggttttatttaataaaatatctcagcaaagttctaagtttgggttctagtattttgagtatgttaggcaaaataaaatattaaaataagacttatttttaaaaaatctttttgtattttgagattttttcgtatatatcccaggctggtctaatacttgagggtagcctgaaacacatgataatcctctttcctctacctctagaatgctggaattagaagtgtggattagaggactagaacatctggttctttttaccttttttgcttttttgagacagggtttctctgtgtaacagccctagctgacctggaacttgctctgtagaccaggctgccattgaactcacagagatctgcctgcctctgtctcccaagtgctgggattaaaggtttgcaccaccactgctcagtccctctttttaccttttaaatgtaactatttggaacattttaaatgaattatttggggggggggattggtgagatggcttagcaagtaagagcactgactgttcttccaaaggtcctgagttcaaatcccagcaaccacatggtggcttacaataatccataatgagatctgatgccctcttctggtgtgtctaaagacagctacagtgtacttacatatactaataaataaatctttgggccagagcaagtggggctagagtgagcagaggtcctgagttaaatttccagcaaccacatgatggctcacagccatctgtacagctacactgtactcatatacataaaataaataaatctttaaaaattactgggtttatatatttctgtttattcacatactgatgctctagtctctttcagctttgagtattctgactcctaatgaatttttgccttcattgttttataccagtagaattttgcattgatgaaaatgttttataatatgtacaataaccagcatgtggctggtgaaatgtaactggtgtgatagaggaactgcatttaaattttacttaactttattttttaatttatttttatgtgtatgagtgttttgtccacatgtctgtctgtctgtacaccaagtgcctggtgctagtagaggccagaagaaggaaccagatcccttggaattagagttagagaggattgtgggccactatttagtaatcaaactcaggtcctttgaaagagcaagcagccactgttcttaaacaccaagctatctatccagccttcagatgtacttaactttaattgatataaatgtaaatcgccatatactgtactcactgatatagaacttttttttttaaggtttgggctcatgtgatgatattttcttttttttaattgaatttcattttattttattagatattttctttatttacatttcaaatgctatccccaaagtcccccatactctcccctgccctgctctcccacccactcactcccacttcttggccctggcattcccctgtactgaggcagataaagtttgcacgaccaatgggcctctcttccctgtgatggccaactaggccatgttctgctacatatgcagctagagacacgagctctggggggtactggttagttcatattgttgttccacctatagggttgccgaccccttcagctccttgggtgctttctctatatagaacttttaaaaaataaaaatcttataaaccttggctatgtttttttctttttcagttgtgttggtgttgaggaggagaaggctgctgatattgatctttaccactgccctaactgtgaggtcttacatggaccttccattagtaagtagatcttataatttgtatcaggaagtaataaggcaagaaacaaagcaaaggtagctttggatagcctctgcctcatatgtgtcttccgtaggaaacagcagaagcccatgcacgtccaacagggcctggagctgttgccctaagagagcaaaaatgcatagccttatctctttcccattttagcacctacctagaggaagtacactcttctttaccaggagctttcctgagtataaaagagcatctttaactgtagatgcccctggggttttagattcttagctcctggccgttctaactcattaccacttgtctttttctggtttagtgaaaaaacgtcgtggatcttccaaaggacatgataatcacaaggggaagccactgaagactggaagctctatgtttatccgagaacttcggggcagaacttttgacaggtgaggaaatgttaagcattagagctatgggacgctggacatacttcctttcagctgttccactggctgtgccattatgtgcctccctcatgtctggatatcttctaggccctgcaaaatctccggggtgggaacttctgttttggtcagttcctaagtaacagtgaccagagtttcacttgatgtttagagtacattatgacctatttacagaaatctgcagtagctgggaagcagcttttgtcttagtcaacttataagcatctgaacaatgctagaatttggaggctttttttggtttctcctagtacaaagtaatggatttcattatgacatttccacgtatattattaaatatactttgattataattactcattctatgaccctttatttccttcccctttcctattccatattcatagcagctccccattaaatgtctgcaagagtttttaatggtcagcaaatttaattctctcattatagaggagaggaaactttaaaactaaaaatagagagctgtagtgtgttttttcaatcaaaaagatacttttttttttctttcaacttacctggatttagtaaaaatgaattgaacaaaaataatgagttagaaattaatgaataaagaagtatcatatggttttaaatccattggactgttttcaggtttcttgtacttcaagtattatttagattgattttctaggttattagtttaaaaaaattaaaggctgtcagtcccctctgtacctcagacccctcagattccttcttctacttacatcagctaattttttatattttttcaaaaatagtacttgtatccacatatatgtggttgtatatccctttttatttttgacacaaatggaagcattatgttttgtatattacctttatttttaaacctaaataatatgtcttggaaattggtctacaacagcatgcataggtggttcttcctttcaggatcatttattatttcattgaatggatacatattttatttgaccaatcctatagtgatggacatttaaattgattccagcaatttgctgttattaagaaaacttctattggccataccttttttcttcagtaatgagcattgaacctaggagtcacacatgctaggcaagtactctaccactgagccatatttgcagcctcagtgaatatctcttaagtttttgcatgtgtgacaagtatagatgtagatttaactgtgtaaaagtaaaattgttagatcaaaaaggatatgccttaggaatctgtaaatattgccagttgtttgcataaagcctgtacaacatcacagacattttgtcaaagctctgatgatttttatgattaaattttcaaaatttagtgaaatctttttattttattaccttaattatgtaagaggttgatttttgtatatttatgggtcatatttattgatagctttctcttttctaaagcatttcccatattttttactgagaaaatattttcatgtaacatattctgatcatgtttttccccttcagttcctcccagattgttcctatctacccaactctgcaccctttctttctctgtgtttagaaaacaaacgtacaaagcaaaaaagaaaccaacccacaagaatctctctctctctctctctctctctctctctctctcacacacacacacacacacacacacacacacacaaaacctaacaaagcaatatagaacaaaacgtctacaaaaatacctttgagtttattctgtgatggccatctacttttgggcatagagcctacccttaagtgtggttaataaattgggcagtggtggtacactcctttaatccttgcagcagcagaggatggtggatttctatgagtttaaggccagcctgatctacagatctcattccaggatagccagggttacatggaaaaaccctgtcttgaacaaataacaaaaaagtgtggttaatacttctccaatgagacttcattggagaaaactaacttattatattatatattattatattatcatatattatattatactattatattatgtatattataattatatattataacagctttccttgcagacaattttagcttttaattcagatcaatttatttattatcattttagtaaaaactgggtcttgtctcttacatgtttttcccctagtacctttatgactttcgtttttgcagtttaaattttgggccatccagaattatatagagtgaaacagatacagagcttattatgcttgtttcaatacaactaatttcccttttcttcatagtcttttttttcttttttggttctggaggttccaatcatggactcattgcaagctaagctaatgctctggcactgtgtatacctccatctatctaccactctcttgtctccattatgactaggagtagttgagggggtagagaataatatgatcaaaatatattgtatgaaaaaatttaaaaacaattcccatcttgtaagtacatgcattaagaaagtggttgtaaatactgttttttaaaagctcagtctttgctctcttcgccaagagaagattggatgttgctattttgggttagaacaaatgagtcaaaattgttagttatatctcttcttaggtaagctattgactaatttcctttgttgttcagaaaagaacatcctgttcaccatatcttccctacctctgtcagtgaccttgtctactgctttggaaacatcatgttttttcctggcatatgaagtttatgccattagttgtcaacccatataagactccctcagaagactatatcccttttgtgagaggccattaaggcctttagtgagcagaatctcaaggtcatgttttttttttctctatggcccacacagctcagatgaagtgattctgaagcccactggaagtcagctgactgtggaattcttggaagagaatagcttcagcgtgcctatccttgtcttgaagaaggatgggttggggatgacattaccctctccatcattcactgtgagggatgtggaacactatgttggtaagacaccacagactctcttaactgtgacattaactgttcctatcagaatttaaatcatgcttggcatggtggctcacgatacctttaatctcagcacccagagagcagaggcaatcagatctctgagtttgaggccagcctggtctacatagtgagttccaggatagtcagagccacatagagagaccctgtcttgaaaaacaaaacaaacaaaaagactagagtcatttctctaatccacctttttatatttgctttccagccatcttgagagtatgatgtgaaggccttgcctagctagagtcattctttggcaagacaagagacataatactactcttcttttcctttttagctttatttttttttaattcagctattttatgtacatgcatgctctgtcttcatgcacatcagaatggggaataagatcccattacagatggttgtgagatactatgtggttgctggaaattaaactcaaaacctctggaagagcactcaagtgctcttaaccactgagccacctctccagccctaggaacttgtgtgtgtgcgtgtgtgttgggggctaatgacagtatttatttgattcattttcttcttaataagactacataaaagtaggttgagccaatttttttattaattcgttttatttatttacagtctaaaagttgtcttccttcctggtctattactccctgagttcttcactcccttccccagcctctgacagggtgctctcccactcacctacccatcctctccttaccctcaccagcatccctccccactgaagcatcaagcttccacaggattaagcgcattctctcccactgaagcaggacaagacagtcctccagtacatatatactggtgctacatatatacatgtatgctccttgtttttttggcttagtctctgggaactctgaggagtctgggtcagttgacactgttgttcttcctatggggttgcaatcccctcaccttcttcagtccttcctccaactcctccattggagtccccgacatcagtccaatggttggcagtaagtatatgcatctgtcttagtcaggtgctagtagagcctcccagaggacagccatgccaggctcccatctacaagtacaacatggtctcattgagccattttcttttaacctgggaaattttagggatcatagtctctgatacctgttcttactatattttactggagcatcagtgaaggaggagactagaagagaagacataaagaagcagatccatggcagttagactatgtgagagtttctatcagatagctccatagcccccacccagatcttgagagagtgtgatagatttctactctctgccctgaacacatagtatctgaagatagaattcctgggtatatggccattctaggtgctggtgagggaacaagaagtttttgtccccgagagacataactcagtacagaactcgtgtctttatttcaggttctgacaaagagattgatgtgattgatgtggcccgccaggctgactgcaagatgaaactcggtgattttgtcaaatactattacagtgggaagagggaaaaagtcctcaatgtcattagtttggaattctccgataccaggtaggaggggaggtaacagaaaaagcctgacagggcatctaaaacttgtagatatacttgaatttatattttggtttgattccttcattctagcagttttgtttctcattttggagaagggagttggcttatactttaaagggcactgattcaattttataataactaagtcagtttcttcagtttctagcagagctagattatatagaatctattgtactaatctgtcctttgttctagggcatcttcctttgatcttttcctagtatttatatttttatttatgactgtcctaaatgaagaataagtcctcagtctttggaaatagattttaaaattgcaagtagtttttctaagggtaggttgcctacatttaaaagggaaaaattatatatttttttaaaagatttatttattttatgtatataagtacactgtagctgtcttcagacacaccagaagagggcatcagccaccatgtggttgctgggaattgaactcaggatctctggaagagcagtcagtgctcttaaccactgagccatctctccagtcctataatctttaaaatatcctatcagtacttacatattcaggactgtggtgaatattaagaaattctaacatatctttttcttttaggaaatttactaattgcttattggcattttaagcttcaaataattaataaaaagatttgcaagaagttgcaaaaactggacagcaaggtcctgtgtacttttcattttcccacagtggtgacatgattataatattaaaatccttgctgttgcttttaagattaaagaacctaaaggtatttaaaaaaactgtagtttctttaactatcgcttaatccagaaagcctgtgcgatagcttgcagacatgcagaaaaggggaaaaagaaaacgggaacagaaagaaaataaaaatgaggaaccaggttgcatatagataggtactgtacatatgaatgcgtaattctttgtttaagtagttggtggaagtagttagtggaaatagattgcagttttcattgactttcctgaaggtcaaaacaaagaggagtgcataatattaaaagatttgtggatttatgtgggataaaacagccagatgtatggaactgccctctaggaggttttctgtaattgtaagggcttttcataaagaagatattaaagtagggaaaggacagactgttacaaagtgctgaatgagtcgactggggaagcgaaataaataatgggcatgacaatttagtaataggaatggccacttactattggggaaggatttggggctaggatttaggactggatttggagctgagtggagtggagtgggactactgttaaacttttaggaataaatgttgtatatacctttgggttctgtggagaaaatgattttttaaaatttgttttatcttactgcagtattttattcaggcttaaaccttcaattttcagtcagctcacgcttcttttcaccttctttactaggctttcaaacctcgtggaaacacccaggattgttcgcaagctgtcatgggtggagaacttgtggccagaggaatgtgtctttgagagacccaatgtgcagaagtactgcctcatgagtgtgcgggatagctatacagattttcacattgactttggtgggacctcagtttggtaccatgtgcttaaggtaggaatgagtatgacacctggaggcagccagacccatctgcctcgcatattctatctaggcaatacttgacatgattaactctatcgtgttaattttgaagacagaattcctgggtataaggccattttaggtactggtgaggagacaagaagttttttcccctgagatacagaattcatttctttacttcaggttctgacagagatattaatgtgattgatgcggcacatgtgggtgtgcctctacaattttgatgcttaagcaaaaaagttgttgaaggtaggcatggtggcttttgcttataatttcaacacttgttgggttgtggcaggaggcttgacatgaataagaggtcagcctgagcttcatggtaagtttcagatcagcttcagtttagcttgagctaaagaatgagagactgtctcaaaaaaacccaaattaaaaaaaaaaaaaaaccacggagaggaaggcatgcagcaggccctaggttgcacccctagtactaaaactacttttttgaggtctagggacatagcttactggtgtagtgctttcttaacgtgtgcaaggtcctggcttctatctcaagtaccacagatgtagatttttttggatagcaataaattacttaagatattccctaccttctttaatgaaggaattctatttctcgcaatatatatgaaaatgtctatattaattgtagaaatttcttggtaacatgagttttctctccctcaaactttaatatatgtactgtagaattcatttactttctccaaagtaaccaaagtaaagtggctgtatttgttttttttttttctgagacatttgggagtatttccagacatagtgtctccttgtgtctaataattcattatttagttcttaacaacggtattttcttaagtaattacaggatagttatcaaaataaggtaattgataggatagctactatagtagctactctctataaaggctgccagttttttcaattgtatagtacatacagttgtgtcacgcatcatagttttctgtgtttaaatttttgatatattagctaagctatggagttatccttatgctaaggtgtggttctttttcactaagttgtctatcagatgattatccaagcaaaacataattaggaaataaaatattcttccagcagataatccatcatctaatgaaatataatcttctagaagaagtccttggatagttactgaatttttaaacttattaactttgattgcaggtatgagaaggaacactgtataactggcatttaaaagcagattcaattttcttctcatcagtaatatggccttaaattctagggctagtagtattgatcttacctatagatgccatttttcatttggtattacatctaaaataagagcaattggtatatatttctcctaacttaaatagatttaaatacccctttcaaatattttttgggaaatttggagaaaatctgagcagtttatttaaaaatgtttcttgatgggtttgagaaacagctctggcatgctgatatagatgtgggtggagactgggagagagatttgaccatttggagcacccttcctcgagaaggacttttcttgaaatctttagtatggtatctttttatttcagggtgagaagatcttctacctgatccgcccaacaaatgctaatctgactctctttgagtgctggagtagctcctccaatcagaacgagatgttctttggtgaccaagtggaaaagtgctacaagtgttctgtgaagcaaggacaaacactgtttattcctacaggtcattcctgggtccctctaggggggaggatgggaaaggcagaaagaagggagatagtggtactgtaccaaaccctgtccataatttattaatctcattatgtgacattttttttctcattagctaagaggttaaaactagacctcaagaaaatttgtatgttggccagtaggtagcatggttttgtgtggaggccgcagatgacagaacaagcaggaggaggctgatggagcattatatacggggttaatgttaactgggtataccaatagagaacaggactcagtcctatgattctagggatactaactcagaggctgatgttctagtctataacattgaatggccagaatggaaacattctttgttaatagttcatgcctgggacttacttatagaattcttaggtctcatgtggaatatgaatttgtgtgtattttgctaggcaaccattcttcctctgagctatgtcctgagctgagtatgtacattttgaaaaaaaataaccctgttgtcgcaatttggagagagttgatatctagaagctaattgaatcttttatgaacagtccaatttaaatgtttcttgattatttaatcaaaattaacattaaattttcttgaaatgtatagggtaatactcttattgaatatgggcataataaaacacacttggagtctcagatacttgaaaaactgaggcaggagaattatgttttcaaagctggcctgggcaagttagtgaaactctacttaaaaataaaacaaaataaatattttaaagatcttttgttttttccattacaaggtctcactacatagatcaggctggtgatcttaaactcagagatccacctgcctctgcctcccagctactgggattaaaggtgtgtgccactatgctcagcttaaaaataataaacagataaatggaattctcttgtgaaataacatggacctgaaaatttggggaggagtctatatttagcattaggtttccttaatctttgtaacactatttgcattatctagcccatgtttttaccaacaaagctatcttgccagtccatgtattccatattagatgagttgtggttgtctatgcttttcaaagaagtactatattgattcattcttttattccttatctcccttcctccctctccccacttttgttcattcttgatactagttacctgtgtcttctcttttatttctgtcagtcttctagaggcttatcagttttgtttgatgttttttctctttatgttttcaattttgatttttgattttatctttatttttccttctgttcatcctgggtttattttatactttttttcctagtctcgagatggattttagattattaatttcagactttctcttataatgtgagcatttagtgctataaatttccagcaccagtttagctcctagaaatatttttgttatcatttttattgtgttaagtgtgcctttgtagaaaatgagatagaatttatatgccacaaaatatacaagtttagcagttgttttagtgcacttttgccagggatcatcactttaaaaagaaacactttccccattaacagttactttttattctgctcttctcccagcctggaacaacaatttcttttaaacttcacttgtatgtagattttcctcttgagtattccacataaataatagttttgggatagactctcacatagtctaggctagccttgaactcaactagatgctgaagttggccttcaactattgatcttcctacctccatcttctgggtgggattacaaacgtgtaccatcttacttttctttttttctttagacagatttatgtgatcctggaatctgctatgtagcccaaccttgcctgaagcttgcagtattttgtcagcttcatgagtatatgattacaaatgtggcacctcactttactactttttttaatggcaaaataatttctttaccccctgcaatagggtctcatgtaatcaataatcagtgttgctgtgtagctaagggtaggtaaccttgaacttctcctcctgcctctatcttctaagtactgtggttataggcttgcactaccatgcctagttttttttttttatttttatgtactagagatcaaacataaagctttgttcatgctaagcaatccatctaccagctgagctataacttcagacactgcaaaatagtatttaatgtggttatgccacatattttcctcttttaaaaatgtttccttagcatatattatccataagagtgggtctctgtatgacacttctatacatgtatataatgtattttgtgtttgtcattccctgctgtccctctaccatacatgctaacgcccttgccatttctactttcatgtcttttgtgtgtgtgtgtgtgtgtgtgtgtgtgtgtgtgtgtgtgtgtgtgtgaaacccagtgagtttcactagagttgttaacaggagcatattagaaaccttgccaatggttctttcctttctaccatggaagaaaatctgtttttgtgagttttacatcatgtaccctagtcccattcatctccccgacccctcatatctgtccttcatccttgctaacttcccaccaaaatataatacacagaaacaacaaaaatcatggaaaatatctcatctcatcatggaagctgtagtatgtcacattgtgtcccacagtatatccctctgtctacacttctgtacttggaaatgttgcagtgagttattggtctggttcaagatctacaatattgggtccccatcaggactcctccaggttatcttgttgctcgttgttgtggagatccgtcagctttggatcagcaagactgtccctttcatacatcccaaccttttgaagatgatacagattttggggtggatgaattcagaaccctggatttgggactgagtggtagctgagctggtcagtttgccagagagtccaatcttgtgaatatcttacacaagtaatcacaactgctgtgagttcaagaataggtggaggcgcatcctcgtggacacagggggtggggagaaagtatgggatgtggaacaatcggagggtggactgggcagggggaggataaaatatggagtgtaaaataaataaatatatttttttttaaaaagaatataaaataaagcagccatgccatgccttgaaacactgttccatactctcctccacttcctgtagccacattgtttgatgtttgtttttattcaccaactgatagacattaagtttttcctttttcctccctccctccctccctccctccctccctcccttccttccacctttctctttctttttttaaatactggggattgaatgcaaagccttgtgaatgctaattgctccatcactgagctagttccatagcccctattcagtattttattcaaaaaatcttcttgagacaaggtctcataaagttgctcaggttggcaccgagcccactgtgtagagtaatcaaacctcagcttcctgagtagcagaggttatagtatgtgccagtcaatctagcttggaatcatttttggctattaggaataatgcttctatgagtattcatgtaaaactaattttgccaacataatgagttgaccattcttaattaaaaatcgggaatccagccaggctgtagtggcacacgcccttaatctttgtacttgggagccataggccagcctggtctaaagagctagttctgggatagccagggctacacaaagaaatcatatctcaagaaagaaaatcaaacaaacagcccagaaacaaatatctggaacccagcagtatctttttttttttttaagtattgaaaaaagtctgagccccctccccagaatcatgttttattgaatttattttctgtgcttagtatttgtacatagtcttgtgtgtgtgtgtgtgtgtgtgtgtgtgtgtgtgtatgtgtatacttgtgtatcggtgtatatgcatatcagagttcagaaatttaattcaatgtcttctgtagttattctttatttttttaaatgtatttgtaattttagttttttaatccttttttctttttttaattagatattttcttcatttatatttcaaatgttatccccaagtccccctatacccccctgccctgctccccaaccactcactcctacttcctggccctggcattcccctgtactggggcatatggtcttcacaagaccaagggcctctcctcccattgatgcccgactaggctatcttctgctacatatgcaactagagacacagctctggtgggtactggttagttcatattgttgttcctcctatagggttgcagacccctttcattccttgggtactttctctagctcctccattgggggccctgtgttccatccaatagatgactgtgagcatccacttctgtatttgccaggcactggcatagccgcacaagagagatctatgtcagggttctgtcagcaaaatctttctggcatatgcaatagtgtctgggtttggtggttgtatatgggatggatccccgggtggggcagtctctggatggtccttcctgtttgttttttttttttaatgagtattttacttacatgtaagaatgtgcaagcacttgtttcccctggagggccaaagatggcaattgaattccctggaactggagttacagatagttgtgagttgccaagtgggttctgggaattgaggcctggtcttctggaagagcagccattgctcttaatcttcaagccatctctagccagtcatctttttttttttttgagacataatttctcactaaactagagtgatgtaacaagctctttgagtcctcatttctccaagctctgcagtgcccaagttacaaagatgtgctgccatgcttagatttttacatgggtacttgagatctgaatttaggtccttatgcttgcatggcaaatactttatcgactgagccttctccttagctctgaaatcctttgagagccaaagcaactgtgtaaatagaaaatttcacatcatctaactaatgtgatgagatcatgctcataaatgtaaaagtaacttttattcacccaatgtaaacctcatcttggaggcttacttcctctgtctgctaaccaaggcctactcctggaagattctagcctcaatacaatgttatcagcctctgagatttagtgctaaataagatgtctcctttctagctctttctgaattctggctggctagttcaactcagctgttttggcacagaactcttcaagctgactgattcaatctggcttctcttggcctttcctgaatggatctgcttggtctcttactaactgtggcagtctgtccttaatctcctggatccttctcattctctggctagttctatcttcacctgtgtctaggtagttctttgtctgcatcctatctctgtaaaactgtctccttcctctctgcactgccccttaagcagctctcctgtcctctctactcatgagagttgtgcatattctgttctgtcaaatctttctcactcagacatcagttttaaacatagctgcttccttctacaaactaactttactttcattgtttgggattaaaggtgtggcccaaaagcatgtctgtattccagccagaggaattaaaggtgtgtgctaaggttgagccacaccacaactagccacagttttttttttttaataaataacacaatctcagggtataataatcttgaggttcacagtgtgatcaaataccctgcaacacattaagtgcattaaatatgtaaattttacttcaggctgtttgtataaagtacattcaggtcataaacgagtatttcattcccagaataactgtttttgtcctcaagatatatgtctgtttatagatattacaaaattttaaatatgtctcaagtctgaaacatttctcatttgaggtattttatgcaagggatattcggcttctattttcagttttcttgtgttctgtttggtagaggattgcctctatcatgtggtaactccatagattgcctttttgaggaattgtcaagctattatcaaagtagataatgtgcactattttacattccaggtagcaaagtataagggttccaacttgttcatatcttctcaaatacttatcatttctgtctttatgatcatagcaatcctagtgtgagtaaaatagcaatttgttcatatcttctcaaatacttgccatttctgtctttatgatcatagcaaccctagtgtgagtaaaatataacaccaaggttctactttgtgtttccctaatgactattaatgttgaccatcttgcaaaaataattcttgtaatttatagatctttgctttttattttttgtgaaatcctttacctattcttaaatagtaataatagtataactgtttatagttttaattaaatcttttttaattattaaatcacacagtgcacatcacacaatgaccatacatgaattatatttttgtacctttatcagatatattgttcaaaaacatttttcttattcttgagtttatcttttgacattattcttttctttctatcctttttgaatttttaatttttttcttttttaacaggagttctctatgttgccaggctgtcctgaaactcgctctgtagaccaggctagctttgaactcacagagatctgcctgcctttgcttcctgagtgctgggattaaaggcatatgccaccaccacctggcttgacattatcttttaatacattaaattgattcattgacaatttcacacatacacacatatgcatactttattcatgtcccccattattttttcttatctcactttccctgctgttcaatctcttcttcccaacaaatatccctcctacttgaacatcttttttttttttttttttattcaagggttgcagctttaggaaggttgagaaccactgctctaatgggtttcctgcttctgtttttttttatttattattagatattttctttatatacatttcaaatgctatcctgaaagttccctataccctccctccgccctgctcccctacccacccactcccacttcatggccctggcattcccctgtactggggcatataaagtttgcaatatcaaggggcctctctttccaatgatggccaactaggccatcttctgctacaaatgcagctagagacacgagctctgggggtctttgtgtgctccactgcgtttattttccagtgacagtgacttcctctctcataggagctattaaattaactgcctatagctcccagaaagagttgaatctttttacattctttgatagtctcataaaatatgaatgttattctgtccagtttatctgtttttctttgttggctttctttccttttttcctttgtctcactcagtctgtgctcagtctatttctatatctccaaggcctcaaacttgtgatcttaatgccttaaatcttttttgttgttgttttgtttttttgttgcttgttttttgagacagggtttctctgtatatccctggctgtcctggaactcactctgtagaccaggctggcctccaactcagaaatccacctgcctctgcctcccaagtgctgggattaaaggcatgcgccaccactgctcggctttcagtcttttgattgatatgattatatctacaggtattgggaattcaaggaaataagtatttataagtattttattggtttttttgacacattgcattactcagactgtgctgtcttaccatgtagttcagctagccttaaacctatcatcttcctgccttagctttctgagtgctgagattataggtatgtgtcactgttttcagtttagttttggttattatatttagatattttattaaaattgagttaatttttatatacaggttgaggcaagagtctagttttattctttggcatgtagacatctgcttcttccagagaatcctgaaaactttgctcattgaattttcttgatatttcctctctgtcactgttactggttgatttatagttcaagttgtagtttagtgggggagtattatctagtatgtccaagatcctgggcttgctcctcagtattgcaaaaccaaatatcaaatgtaaaaacaaaccatgaaaagtcagctgagcatatatgggtttatttttggatcttatatcttccattgatttatatgtctctccttatgataatgtgtacttttttgattactatatacttatagtaagttttgaagttgcgatttgtcagttttctaactttgtatatctttttcaaggttggtttgttatgatcccgtgaatttttcatgtgaattattaggttcagaatttgctttgtttttttagtggttctagttgtttatttgctctagttttgttttgatcttagtagttgctacattgtgtgtgtgtgtaacatcacagattattggtgatactattttatcagtttgaaaggttttaggtgtacctagaggtataaaaaacagtttggaatactaaccagtatgagagataaaggagggtcatgaatcttctggatagatgaatggagaagggagatgaatatggaaaggatttaagaaaacaatgttgcaaaattagaggcaaggggagggaataattgtgttttagtagtgtgcattttagagtagttctagcaaaagagtgatgttcttttagagaagagagggtaaagcaacagaaagataattcgagtagggagtgatgcattaacttcataagttgattctgttcatgttactagaatgatagagtaggctatgctggttattgccacagtaaaaaaaatattttaaatcattggtaagctatttttaaggagtgaaggttattcttaccctcttgctcttaccctagccctcctgctcccccctcccccactttcaacgtggccatggccagcctctacttccctactctctccctctttctgcctttctacaataaatgcctttaaaacaatacatacatacatacatacatacatacatacatacatacatacatacgtacgtacatacatacggagtgaaggttaaactgaccaggcagtgaggtgtccaatgaagaaggccttctgctagctgtgatttttgccttctttgtactacaggatggatacatgctgtgttaacacccgtggactgcttagcattcggagggaacttcttacacagtcttaacattgaaatgcaactcaagtgagttctcacattgtctgttcttgtgtgctatagtccttgtgtaagtcccttgagtaaagaatgcaatatagtatgatgaagacaacaagaaaggaaagtatcttgggcattttggttctttgctttttaaagacagggtttctctgtgtagccctggctgtcctagaactcaccctatagactaggctgacctcaaactcagagatctgactgcctctggatcccaagttctgggattaaaagtgtgcaacaccactgctgctggacagtatcttggttcttaatgacaatttgacaaggttaacgctctttcttcacttggttgttatacctttgggcaggtacataatctttgatttcaaagtttctttgtatatagggctttacagggtcactatattaaatacagtggatacatagcactgagaatagcacttggtacatagtaggtgctcagtaaatagattctttttatagtcattatgtttccttacagggcttatgaaattgagaagaggctgagcacagcagaccttttcaagtttcccaacttcgagaccatctgttggtatgtgggaaaacatattctggacatctttcgaggtatggttttccttatcagctatcacttttgctaagagaaaggaggaagaagagggattgtagaaattgggaagaggagaaatgggaggtgaaagcttgctgctactgctgccttgctgtgtatattaaatcattaatatcttaaatatatactataaaatgtcccaataaccaagatataaaactaggctaaaggtccatgaacgctacttagaaagagagacagagacagagacacgcacagagagagacagaagaagactagacatcaaagtagaaggggcctatgagaagcaagagggagatttaacagaagtgtccaaccctgtgggataaaagatgcatacagctgagtgtggccaaggacaacagaaaatgggtccagcatgaaattgtaaaccgacttaaaatgttttgaagtgtttttgcagtttgttttggtaactcagttgcatggttatttagtgtgaactttgaagataaaacattgggttgcaaagtcagaaaattggacatacttggtgagggatgggcagaacaaaagggtaatgcaatatatataatatggaagtagaaggtgagactctggggtaagaaaggggaaagacgagggcagtgagttaagtatgaataaaggacactgatatagttgttcaaactttgtatttttttatattaaataaaaaagtaaagtaatcatagctattataccataatgcttactttctccaccaaaatcatccataatttctggaaaccactaatccctataattttgtcatttgaagaataatatataaatggaattatatcccatgactcatgagtatcccggatatgcctccctcagggataaaacccagtcttgatatcctggcatcactgtggtcccgggtatctaccctggtagaaaccagcttgctggttttcatctttcttagtcttgtctgaaataaagtgagtcccttgcttggacctgataattgattcttcaaggtgactaggccagaaggaatcagtattgcagttacaaaggacctcatagcctagtgagtacagtttcctactcaatacttcaagcccttactctgccactttgacagactgtcatgtaagtgttaaaacatggaataactaatgactcatttacctattgtgaccagcttagtacagtagaaaattctttataaagcataaaattggttgttaataacctcctcatgaagtaaagcagaacatagacaattttgagacctaaaaggctgaataatttaatagaaggaacacaggccttatattcaaatggatacagatatatgttttgacacatcaagattcctcttagacctttagtttcctgaactataaagtgaactttgcttacaatgtagatatcagagttaaatgacagctgcctagtgggtagtaaattattaagttttcagtaagtgaatactattaatataacagatctaagggtgtgcccagaaccctcagcattgtctttggttgtctgacaaaggtaacaagtccttcattcctctgaatagatatattgacactctacctttttattcctgctttaggcttacgagaaaatagaagacaccctgcctcctacctggtccatggtggtaaagctctgaacttggcatttagagcttggacaaagaaagaagtaaatatacttatttatatacctacttagtagttcttccttcgataaaggttacggatagatgtttggggagtcataaaatcaaagaggcaaataggctcctgggttagagtggaaagctaggctaggagcctttatttctgattttaagaaataatacatatgcttattccttagaattaaaaatatatatggttgtaaagaaaatcttcacctgtaattttaactgagaggaattagcattaacatttggatgtatttccttttggtcttttatgtgtgcattatattttttccttttaagttatgtgtgtgggtgttttgctcaaatgtaagtgcacaacatgcatgcagtgcctggagagatcagaagagggtgtcagagtttctggaactggagttgcaggcggttatgagttattatgtgggtgttaggaattaaacctctctcctcttgaagaacagctagtactcttaactgctgagccaactccagccccttgtgtgtacttttgagggcgctccaggtaaaattggagccctgcatatgctttgcaccttgaatctctggaccccacatgtgaatttagaaacataattggtattgcattatttattcaattttgtatctcattagattggcttaattttcttgtgttacttaagttccccataaatactgaattgctacatgctattttttctcaggaatcacctggttatttgtttatagttgctttctatttgtttcttattggagggctgtcgttacagcaaatcatacagtaaatatccgtaagcatatgtctttgtttcttatctcttgtttattccttcaggatagattcctgaaaggtcaattactggagcaaagtatatggaaaaaaaagaaaggttcttgatgcctactgccaaaatgactttttagaaaatttccaatattcaactatctgagtatataacatctataaatgataattcttattatcgttcttaagctctctatgtactgatttggaaagatctccagaatttgtcaaatgaaggtacagaatcatctatagaagcaaccatatgtaaaaagggaagaagtaagaattgtgtttatatatgttcatattcgcctgaagacacaatttgcagggacatagaagctaatgaaaaatagttaccaatggaagaaggtagaatgatagggatttttttaacatatctttttaattatttaatttttgaaccatctaaatatatttatttccaaatgttcatttaaaaaattcaaccttaaatggaaaaataacattgaatttcttttcttttgactgaatactctgggtcatggggcctgccctaaggtgtggttaatataaccggtgagactacattggggaaaagtgatttctcctttgtcagcaggtatcaattgcagataacttatattggctaggggtaggagttcatgttgatttccacccctttgtgtgtttgtatgtgtgtgtgtttctgtgtttcttatttttgtttgttttaaagagagaaatagaacaagttgggtgtgtaggctctgggagggagggagatacatgatcaaaatatactatatgaaaattgttttcgaagacttaaaaaaatcaaagaaatgcaaaagtagaataaatattaagacagtctcaggtttcagattctctctagtttccttccttccgtataatcacctaaagggatagtttcagaccttgtagtggtttaacttatgcatcaatctcttcattttgtgttgccaacattcccctaatattgtaaaacttcatgttttgggatttcctttgttccctaatctcacaaacacctggcctttagcctgtagttctgttttttcatcttcctccatcctcgctaacttcagtgttattgctgatccttactatgaagtatacttcagactgactcttccaggaacaccaaaagaaagtgagtgtgtagttcgtaagcactcatatcctgagtcaatatggagccagaaacccaggaatagcatggccaaagggagctagaggagagcggagcgcctttaaagggggcacaagctcatggaagaagacttctttgaagtatagatgatttgcatgccctcctagcctagaagggcaggaaccatcaaagttacccaactttatttggataactaggggaggaatgggaagactctatcaagggccttccttattcattcatagagtcattcattcaaataattacatgttctgagaccattccacatattgggccagtccatttttatcagtttttcttttgtagtccatgctattagtgacttaagaaatagttgcttagcaaaagtttacaaaaatgttctccttggttatatagggcttatatttttaagttctatatttaagtctgtaatcctctttgttatttcaaaaaatgtattaaaagtttttggttttgtttgacctatggatatctggtatctaattggttccttatcagttattgaaaagattgtccttccttcattgcttgcccttggcatgtttgcaagaattcagttgtcttatgcttcttatttgacaggctttgccagaccacgaggatgagatcccagagacagtgcggactgtacagctcattaaagatctggctagggagatccgtctggttgaagtaagaagcatgggagaagggaaggcatttgggaagggctggagactcaaatggcaggtcagaactttgtagctgccataacgcctaggggaggagtgagaagactctagcaagggccttattcattcatttagtcattcattcaaataattatgtgttctgagtacatgccacacactgggataggaatgatatagtgcctgtccataaactcacagacatacttgacctctgtgaaagtgtttccttatctctaaaatgagattaatgatatctactcaaagttgttaagaggattaattaaggtaatgtgaattgaaaattgagtatagttcttggcatgcagttggcacttaataaattctaatgatagactatagtgatagttgtagttgttacttttaatactttgacttaatctctgaattctacaaaataacaaactcaagttgaagatgattacaaaggcatgtttcaacaggtggcatacaccacaaggcaggaggtatagtagtaagaaactcagagaagcctgggttctggttcctgctctttcacttgaaagcctttcagagtcccagtttcctgatccataagctgaggaataactttaccgagctttcaaatctttggtaaaattgagaggtaatatagagcccctcacacagtgcctggcagagtaagtactcaataaatgtgagtcattgttattaatagactttttagcaaagagaaaactcagtgtgggctggtaaagtagcagaggcaccagagaaaaattggacttgaggatgtttaagctgtcttagaagtctatttcgtgtctaagagatctgtgtatttgtcgttccctcccttccctactcgtctgtgaatgtctgtctttccctccctccctcttactttctctttccctccttcccttcccccctttcttccttcctttgtttctttctttcattgtatatgtatgtatgcatgtatgtgtatccatgttacagggtggtttgcttctagaatttgggcttctgtcttcactgcttacagcatgtttcactgtctacactgtagtctacagagtctacatcctacctcatttttctccatttcactcactaataccttttaggagtcagtcatatgactatatcatttccagttcttacataatccagttttatacaaacagaactttgggctggctaggaaaaaaaactcatgagatagaacatgacttgttcattgactttcaaacattttaaagcaatagaatactttttttttcaaataagatcttatatggaaaccagtttatataacaaatcaaagcatagctgctttgagtaggataaaggttagagacctagagctccccttgttcctctcatctgccttccacataccatccatccccaagatttctcccaggaagcgcaaagaaaccacagaacatcttttaaaaattacctttttagtcttggcttttaattatacagctgaacaaacaagctctagagcttgttccatcagataactttccctaggtcagaaagatagctggtagcaaaattacgactagaaactttcttcaaaacttctatagtccttatagtttcaaccacacagacaagtatttgattatttttttattttgtgtcagctaatcttggagtcttttccctccagttttgacagtaacgctgggctttttctttgctcgtcttctctttacttgtcaatggctgggtaaagaaatgccacccaataaatgtatgatggctcactgtacagaaaccaggggtgtgcatatgtggagcacatatataagccacttccttggcagtaccattagtgctgggaacagacctctgctcttagcatagagagaacacttgagtaagctctaaccccctcgtgtactaatactcttgtaggacatcttccaacagaacgttgggaagacgagcaatatctttgggctgcagaggatcttcccagctggctccatccccttaaccaagccagcccattccacttcagtatccatgtccaagctgtcactgccctccaaaaatggttcaaagaagaaaggcctgaagcccaaggatatcttcaagaaggcagagcgaaagggcaagcagagttcagccttggggcctgctggccagttgagctataatctcatggacccatacagtcatcaggcactgaagacaggcccttcccagaaagcaaaggtgggtgctggcccatgggttcagcccaaccctttcgggacccttgaaagagcagtatttcaaaaaaccaggctatcctgttccatctcttagggcccctggtgtttggctaccagttccactcatttaacaggcatttattgagtcattttctgtgctgggcactgtgataggtgctgtggatggaactcaagaggctgagaggctagaaaagaaggaagatagacataaaaacaaatgagtgaaatgcagtgtggatgccacccatgatcaaggatatatgtggggctatgaggcacagaaggcagttgattctatctagataaggcttaggagctctttgccaggtacatgacacttgagttgaatcttgatatactcaggtgggaatgagatttgagaaagttgtctgtcaggttagaatcttgaacaggtccttgtctccttcctcagggcttcaccttgtctaagtattgtgttgccctatctggatatctaataatggtgccctcttctctatttaggtaccatgtttcacaagctatgctatgttttccccaagccagctatatattctcaacctcccactcctataattgttggaggtggggggttggggacaggcatatcagaaggccttatgtcagagggttgacagatttgtagtaaaaccagagaaaactggccattttgatttatctgggaatctcagactggtgacaactgagcctcattcttctacagttcaacatgagtggtaccagcttgaatgattcagatgatgactcagcagacatggaccttgatggcagtgagaaccctctggccctgttgatggctaatggcaggtaagatgggtaaaagaagcgcagaaataactgagattaccagtgacgattaaaatatggacctgggagttggaacataggtgcggggagggcagtatttagggtaatatcaaaatgttaatagatatttactttgtttagaagtcatggtggatgggggagaggttgggagtctaactagtaattttgaaaatgatgttttataggttttagaattttagcaagttattatggtagaactactagtagaaatgttagtaagtgtacagattaggagcattagggttttgggttgagacatggctcagctgttaaaagcactttctgcttttacagagagccccagttttcagtactcacacatggtagctcacaatcatccataactctagttccagggaatcagatgccctcttctgatctccatgggcactaggctcatgtgtgatgcacatacatacatacatgcaggccaaatattcatctatataaaataaaaataaatctttaacaaaagaacatagggaattttagttaagttttattcactatatgtatagagggatgggggtcaagggcaatacaggggtgccacagcatagacaggatgatcagaggacaacttttggaaatccattctttctttctgataggggttcccagaatcaaactcactttggcaggttttgcatcgctacggcttttacctactgtgccatcttgctagcttaagaacatgcattttaaaatatgcttttataattaaatgcatagtaattcagtttatggattatattatacacagtattgtataaatgtgtgaggaaaaatattcagtgcatactgcatcattgtaatgatatgtgtctggaattaattcagatgtttgccagcacaggttaaataaattatagcatatccttaaaaaagagtccaagtattagagaatttaaaagaatggagcagtttaatatctgttagcacaaaaagttgcccaaagtaatgtctttttttcctattgagatgggtgtctcactatgttgctcaggttggtcttaaattcctgatctcaagtaatgctccaggctcccaaatagttgccacttatagacattccctgtttcaatagaagttgttttttttttaattcatgtcagtgattgaatttagggtttgtatatactattgaactacatacccagtcaaacccccacaccttttttttttttttaagttctacctatgtacctcagggtgacattgaattcacttatgtcggttaaggctatgttcatcttgaaatcatgatcctttatatcctgactgctgggattgtaggcatgttctactgccatttctggctcggtacatttatacgtgtgtgtgtttgtgtgtgtgtgtgtgtgtgttttaatagcataattcattttttttacttgttttgttttttcaagacagtgtttctttttgttttgtttgtttgtttgtttgattttttgagacagggtttctctgtatagctctggctgtcctggaactcactctgtagaccaggctgacctcaaactcagaaatccacctgcctctgcctcccaagtgctgggattaaaggcatgcgccaccaccgcctggccagtgtttctttttgtagctttgtctgtcctggaacttcctctgtagaccagtctggcctcaaactcacaaaaatctacttgcctaccaattgctgggattaaaggcatgcaacaccacacctggccttaagatttatttttattttgtgtatgttttttaccttaatgtatatatgtgcactaggttcatgcagtgcctaaagagaccagaagagggagtcatattccccagaactggagttatagacagctgtgagctgccaccatggtgccaggaattaaatctggaacctctagaagagcagccaattaatctcttaaccattgagccatctccagccgcaagatatgtatttcagtgaaacaaatcagattataaaataacatgcagttgtacctttacttttaaaaaggcatacattttagtgtgtgtgggggggtgaaaaacaatatatgtattttttatttatatttttactttttagaagatgcttaaatttcagtttatatggtttaaaattcaaaaagttcagtctatggtgatggctcagcggttaaaggcacttatcaccaatcctgatgagaccctgttcatctctctgaaagaagaaagccagctcctttgaggcagcctctggcttccatgtgtgtactgtgacataaatatacccttgccgtgaaataaataaatgttaaaaaaaaacccaatatgtggtagagcacgcagtgaaaaatcctgtttatctctttccttttattttctctatggacaaccattttttagtcagcatgtaaatagcagatttcattatgacatttccctttaaaatattttttatttaaattttttgatacaatatattttgatcatgtttttccctccccaaactcctcccagatcaccttcctacccattcaaaatcatgtatgtgtacatgcatactctctcttgcttgcttacatttttatttctaaaaatcaaaagctgaaaatcccgagaaacaaaaccaaggcaaaataacaacaacaataacagtagcagcagcagcaggataaaacaaaacagcttactaaaaaataacatggagtttgtttttgaccaactaataccttgcatgaggcctaccttggagtatggtttacattccattggagagaactgattttcattttgctagcaagtatcccttgggaccccttgaatctgtgcaagtattgtggatgcaaccccagtctctttgaattcatatgtgcatcagttctatgttatctggaaggaactattttcttggaatcatccattatcttaggctcttacattctgccttctttcctgcatagatccctgaggcttgagagtagggggtctgatgaagatactccatttagaaatgagtgttccagagtttcttactgtctttatttggtcagttgtgggtctctgtgttaattcttgtctactgaaagcttagcttctctcatgtgggtttaataaggcactgatctgtgggtatagcagtatgtcattagtcatgttttgctatgttcctttagcataagtaattatgatattttcatacacatataattttatttggtttatatttacttctccactaccatcctctgtcctccttaatccctgccattgatctgcttttcaccaaaaatattgccccttcttttatatatgatgtgtatgtgcatatgtataagtatataaatataaagctaattatagatttctacgtgaaaaatgtaatagtttgtcttttttccttattattctctctcattctacctcttctctagatcccttctttctagatatacatctatgtattcaagcaagtatgtgcatttattacatatattgtgcgtgttattccaaacctttgacaggacagtgcttatttttagaaagtaggataagggaaaagagaacaaacatttacttacataggattttctcagtgttgcatcaaggtgtcactcactctgtagttcacactggcctgctattttctatgtagctcaggctgacctagaacttgaggtaattcccctgacttagcctccatgatgtagaggttacaaatgagtaccaacataacctgatttaacaattattttaaaaaatacctttatattcagtagtgaaagtgtaaaatccaatgtgaagctccaaagcttcagaatggctattcttaactgtacatatgttcactgaaatgaatatggatctggttaatttgagtgtgtagacttttttgttagcaagttatttataattgtaagtaacatttttcaaaagaataaaggaaaggttgttaataaaataataatcttggtaatcagttagtcgtgcagtcctgagattgaatcccagttcgaatatatattgactatgtgacatggaaaattaatatttaatattttaaaaatatctctttatagacaaaatttactttaagatttggaggtgattaaaacagctagtgtgtttatcattcttataaggcatagtacatatagtgttatgtgtttctaataaatggtaacccttataaattcattgataaagatgaaaataaaagataatgtaattatggccagaggctaagtatgtcatggagagattattatgcatttagagaattggagggaaggaaaggcaacacagagttattatctggaattgtagaattcaagaatgaatgcaggtaatgtaggaatacaagaactcctagtctctttgtagaaaagcattctcttcagatcctaagggaaagtgtattaggtccacctgacaaggaactaagggaaaatgatagattccgagagcaccagaactgcccttgggacttgagaaccctgttgctaaagagtaatattgaagagaatgttgagctctgctggttttcagagcttctgagaggtctcctggggagtagacaattgtgagtcctaaatgatcaattataatgactagtaagatgttattagacgcgttctcacgaccggccaggaagaacaccacagaccagaatcttctgcggcaaagctttattcttacatcttcaggagccagggtgcaggaagcaagagagcaagaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacatctccccctatccttttaataagagcaaataggccacccatattaatgagagtggagatagaggtcaaatccccagtgtgtaggtaaaggagccatgtacaggattagctcttaggctcacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccatgcaactctctcgggctgctgaagcacactcactctatcccgtgcaatgagtctagcctcatgggatataagagctgagtggccagcgacctattgcctaagcatagatatatcatatatcagggggagctccatgttctagtcctgcaagcgcctgggcaataaccaccttgtctctcctagtttgggccttaagcttacagaccaatcaaagaagcaacactaatccacagcaaagtgtatctccaaataatattaatcccacccattttttaaagaaagaaaatgctgaggagatccaattgggtaatcctttggtcagcgacaggtccaagcacgtggagttgacctgaagtctcaattcccgaagggatctgttcaaattcagccatccaattctgtaacatatactgaaaaagactttttgacaaattagctgccctagtaaatttaacatactgaatggaagtaacacacaatcccggaaacttttgtttacaccccagctgagttatttgtcataatacatctagttgtatctggacaagatctatgagttgattaaccagcatgagacctctctgtatcttgacattagctgaggcctgttcatctatgactgtagtcactgaggctgacaaagtgttaatggtgtctgtcgtctggacctgtccagacagagccaaggctgtctgaatcaaggctaaacccagttcctagttagtgtaaaaaaaacaggagaatacttgagcattatacatcaccgtcattgggagtggaaatgtcgacattatcccccaacgctgctctctctttattattgacgccctggacatcaccaagacgagggacattagtattcccttggtcagtctggatttttcgggtgagtctttctggtacccaaaatgggttgtctttattctgtgggaaaacacagatagctcccctggatcttatcaaaataggatccgggccataccatttattatcaaggacatttttccatttaaccatctcattgggcctatctggctctgaacaatgacgttcagccgcagtatggccatgaacatcaatatttaaaaaattgagtgtaaagagtgccaaagacaccgacactcttggtgctcggggtacagtctcctcaaaagttcccctcttctgttttataagataggctttgagggtgcgatgcgcacgctcaacaataccctgtccttgagggttgtatggaagtccagtcaggtgggttacgtccatctgacggcagaactgttggaatttttgagacgtataagctggtccattatcagtcttaaggagtctgggtttcccccaagcactccatgcctcaagacaatgttgaatcacatgtgaggctttttctccggttaacggagaggcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagaactcacagcagctttgacattgagtaacaatgtcacgggcttcttttcttgtcaaggagaaacgactgcgtaatgtttcagccgtcacatgaaaattgttatgaaaatttcttgcagcctctaccggggatgatagggcagcagccaccactttagtggccttatctgccaaatcatttcccagagccatggggccaggtaggcctgaatgggctctaacatgagtaatataaacaggagatcttctagataacaaaactaattgtatctgctgaaaaatattggcaactctactggaaggcttaatcactccagccacttctaaaagatttactgcattaaccacataacaggaatctgacacaatattaaggggttctaaaaaggtttttaaaacttctaagaccactaaacattctaccacttgaggtgaattttcattatattgtttggataccactttaccattagccacataggcacctatgccagtttttgatccatcagtatataccacaatcccatttttaagtgggtttcttactgttatttgtggaaacacaacagattgattttgggcaaactgtaagattggatgttttggataatggttatctatttttcctgaaaaggaggtaactaaaactgcccaatcattagatgcggctgccaaggtttgaacctgtgcagcggtataaggtacaattaaaagatatggactttgcccaaagtgggtgattgctgcttttaggcctttaagggcaagctgtgcaattgcatcaggataccaatctattattttagctggggatacgtttggatggatccacaacaatggcccattctgccacaaaactgcagttggcaattgtgctgtcttaaagacacacaaactgaaaggctgcgaatcctcaatacgttgtaattgtgcattctgtaaggccttttccactttttgtaaggcctggttagcagctagagtaagagtcctaggggaggagatatgaggatctccttctaaaatactaaacaaaggccttaactcagcagaaggaatctttaaaaaaggtctgagccaattaatatctcccaacagcttttgaaaatcatttaaggtatggaggtgatctcttcttatctctaccttttggggcacaatcttatctggggacaccacagagcccaagaattgtcctgtatcagaaatttggaccttttctgtggctatctgtaaaccccactgacttaaagttttaagtagaaaaggatatgccttttgtagcatggtaaggtctttatggcacaggaggatgtcatccatgtaaaggagcaaaattaaagaggggaattgttccctcactggcaaaagagcttcttgtacataaagttgacacatagtaggactattggacattccctgtggtaagaccttccattgatacctcttatcaggttccatgtgattaatagaggggatggtaaaggcaaatctgggcctatcccttggacacaaaggtatagaaaagaaacaatctttaatatctataataattaaattccagccacgtggtaaggcggaaagtacagggagacccctctgtactgggccaaataagttcatttgctcattaatggctctgaggtcatggagcagtctccactttcctgactttttcttaattacaaaaattggagtattccaaggtgaggtagagggttcaatatggcctaattttaattgttcctttaccagttgaatcacagcttctagtttttcagaggataggtgccattgaggaacccacactgggtcccctgttttccatggtatgggtcgtgctgccccaatggccgctaaggaaaacccagaccctgtctgtcttggtttccattaggtgagatgggctctatccttccctgttcttgatgtcctaacccttttccttctttataacccatctttgccatgatattttttgctttagctgaataccctcccgatggggcattttcattggacaaaataaggcccaaatgctgcataatatcccttccccagaggttaaccgggagtgggagcacataaggtatgaatttcccttgctgtccttcagaggattcccacgtcaaggcaacggagcttatagtgggacatgattgatatcctaggccctgtaatgaatgagatgactctgtggtgggccatgctttgggccaccaatgtgtagagattatacttttatctgctccggtatcaaggatgccttcaaactcttttccgttgatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttagggcttgagcacaggacctgtatttcaggggaatgttgacaatccataactccagggtggactactaagccctgcaaggtgagtgaaccccggccgagaataaggcccatggttcccgggggcaaggatggtataggctccaccggcaccggctgaatactcatttgaggcattagtaggaagtcggaggcggcacgcaggtccacccttgtgggtcttcctgggtcgcctctctgactgcttcctgggtcctgacaaaccggttcccatatctttgagggccctgggaccgagggcccgatgacccgttttttggcacatcagttgattgactatcaggtgggggaaggactctgccctttatatccctcacagagcgacactggtcagctctatgataacccttgccacacttagagcaaagagtgagagtccctccctgtttatctggagctctgcaatctttcttaaaatgcccaggctttccgcaattaaaacatgtcctctgatcatttctgctcatggagcggttctgagattggaggatggcggccgctaagcctgcattggtgagaggtcccccaagctctcgacagaccctgagccagtcttgtaagcctttgttctttcttggggctatggccgctcggcactcctttgtggcttgctcatagattagctgttctatcagaggcgcagcttgctctgactctccaaaaatacgctctgctgcctctgtcattttggccacaaaatctgagaaggattcctgaggtccctggattatctttgttaactgaccagtggtttcacctgctcgggagagcgccttccaggccctaatagccgtggaagaaacttgggcataagctccccaatggtagtttgtctgatcagcagaataagctccctgacccgttaacaagtcaaaagtccaatctctctgctctggagtcaaagcagctgcgtttgctcgggcctgcgcttgtgcagcttcgtgccaaagcgctctccattccatatatttgcccatactagggagagcggcttttacaaccgtttgccagtcggcaggagttagtgccatgccggcgagcctgtctaactgcaccaaggtaaaattagcattggtttcgtatttacggaccgactcggcaatttctttaatttgtaagtattctaccggagcgtggacacgcccaccctcggctccttcaaagaccggaaatgcctgttgtattttcctttgttcctctctgggaatgaatgagtctgcgcactgcctctctgcgcactgcctctctgcgcattgctgacgcactacgcagggcgggggctccgcatagggcggaccttgaaaccgactgccctgaggccaatcagcaaactggccttcgccagccgcttttggcttttttcttgaccaattagctggctggtaatgggctgcttcttcctcccagtctgtttcctcagaggaggattcttcacctgcttcagagctactaagagctggctccccgagcccatccagcgatgagcacaggctccttttcctagagacctccgctaattgatctttcttcttttccctttttcctctttttcttctaatctctctccaggtattcctacctaaccttaacttttcctcgggttcaagacccttggaaaggcctgtatacttattttgtgtaccatatttcctctttgctcctactctctctccccgctttacttctgatagcttgtcctgaatttcatctagaatccgccctgccttaaccacttgataacatgtgaaaaggaacaaaagggcttctaacactagaaaaaattcaaggccaaacatattccactttacttctgatagactgtcttgaatttccttagaaagttcaaggccaggcttacctcgtaaagctatactcactggtactctcgttccccagctgaaaagttctgaattcatgcagttgaatccttcttaacagtctgctttacgggaacctttattaccgcgacccgcagttctggttctggaatgagggatcttccttgcgccagtcccgagttttttctcgtcccggaattcggcaccaattgttattagacgcgttctcacgaccggccaggaagaacaccacagaccagaatcttctgcggcaaagctttattcttacatcttcaggagccagggtgcaggaagcaagagagcaagaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacagtaagatacaatgtaaagagatctctgtaccccttctccctgtcttcttcttgtgctacttctgttgatttgttgcagctgccagaggtatttttaactaaactgagaaggtatagaaatatatatggatgaagtatatttgggctttttccagtatgaatatattgcaagagtgaagtgtagatggaacaagattggctctgtgtcatatatctggaaatttaactagatgatagatatgtggccatttattatacatttacatttttgtatgtgtttaaatttttcataactaaaaattaaaagatgagggtataggcacatgacattaaatagctgctgtgtgtcaaactatcttagctgtcaacatacattactgtacttaatcctcacagctctcaaggttaatatagttattcccatgttatacatgtgaaaaatgtgacccagacagtttaattatactctctgtcatcaatgggcctttgctgtgtaacagactctgtattaacattaactccatgagctagaaaactaattcactgaaagacattttagcaaaataggtatttgctaaatatatgaattttctgattttactagaaacattcctttttaactatctaaaattgtttactatgtattaacagcataatctaacatgatctgttttccatcccctttatatacgttttatatatattatatatgcatatacatatgtgcatatactatagagagaaacacacacaaagttttggctggcctaggactacctatggaaacagggctaaatatgaactcagagatctgtccacctctgcctcaagttgatgggattaaaggcatgtgcttccatgcctggcatgtattatttctttgattaacaaagatattcttatatatttatgaggtgtaatgtaatgttgggtagtgactggctcagtattttttttaaaagttcaaactacattgagatatatataaggtatcattgttaattatattcatcctgttatactatagaatagcagaacttactccattaataaaatgataacatcatgcctattgattggcctcttctctgaattaatattaaaataactcttaaagataatacttattagtaagatttcttgagttataatttgcacactataaattaaccttcgcaagtgattttttttaagtttatagagtagtccagttatcattatagttcaattttagaatattttaaccttatcccaggctaaatctaccaataattactaatatacttattgtctctatagattttctttttctggatattttatattaatagaattagagataagaaaaaaaagatgataccatgaggaataaattattaaatattcaaaaaaaagaattagagataaggtccttttttctttattctctcatcaatatatctcaaccacagtttcccctccttctcctcccattcatactccctcctccagatccattccttccctcctcctttttttatatcaagttgcaaaaagactagggacctcccctcatattaaggcttgatgaagcaacccagtagaaggaaaagagtcccaaaaggaggcaagagtcagagacagcctcttctcccctgcttccactgttataagttccataagaacactaagctacacaactgtaacatatacacagaggacctagttcaggacccccccccccacaggctccctgattgttggttcagtctctttgagcccctatggtccccgattagttgattctgtgatccattttcttgtggtgtccctaacccctctggttccctgaattcttccactgcctcttctgcaggattccctgagttccacctaatgtttaactgcatctgctgccaaaacttgctggatgaagcctctctgatgattgtgctaggcttcagtctacaactataactaaaaagagtatcattcagaatcatttcattgacttttttttgctgctagtgtttaggtgttttttttaaaatagtatttattattctgaattaaatactgtttacatattttaataatgtcataataactccataaatatttattctacatttattaaaagtgaagttgatattatttttttcattaagtacttaaaacccaatagcagcttccccttcctcctttcctccaagccccacctctctcctcctcccctaccatcccttttcctttctcttcagagaagaggaggccacccttggatatcagcctgccttggcatacaaattgcagtacgacaggtgcatcttttcctattggagctagagtaggcagtccagttagggaaaatgaatccagtggtagacaatgtagttagagatagcccctgctcctgctcttatgggactcatatgaagaccaagctgcttgtctgttacatttgtgtaggggacctaggtctgtcacatacatgctgtctggttggtggttcagtctgtgtgagcacctatgggcctaggttatttgattctttaggttttcttgtgatgtccttgacctctctggctcattcaatccttcctccccatcttccacaagattccctgagctttactcatgtttgaatgatgggtgaagcttctcagatgaaatctgattccctcagctgatggatgaagcctctcagatgacagttatgataggctcctgtctgcaagtatagcagaataccactaagagtttaaggagtagactctcattgttatgggtctcaagttggtacagtcattggttggccattccttcagtttctactccaacttcatccatgcacatcttgtaggcaggacacattatgggtctaaagttttgtggctaggttggtgtctccctccctacactggaagtcttgcttgcttataggaggtgacagttttatgttccatatcccctattgctaggagtcttacctagggtcaccctcatagattcctgggagtttccattgtcctagctttctagcttgttcaacccaacaagcagatgaaaaagtcagatgcagatatttgcacccaaccaatggacagaagcagctgactcctgttgttgaattaaggaaggctaaaagaagctgaggagaagggtgatcctgtagaaggaccagcagtctcaattaatctggacccctgagatctctcaaacactggaccaccaacaggcagcatatatcagctgatatgaggccatggacacacatacagtagaagacttccgggtctgtgttcattcagagatgatgcacctaaccctcaagagactggaggccttggggagtttagaggtcaggttgtggggggcatccacgtggagactggatggagtggggagcaggtgtgggatgtggagcagacagagggtggagggaggcagggaatggaatatggagtgtaaaaataaattaaaattaaatttaaattaaaaaaaaagaagaaaaagttaatgttggctcttgccttatatattgcctttaatatgttcaaatatgtgctttgcatccgtgatctctccaagacttttatggtgaaggggtgttagaatttgtcaaagatttttcaggatctaatgaaatgatcatgtgatatttttctttcagtttgtttatatggttgattacattgatggatttttgcatattgaaccattcctgcatccctgggatgaagcctacttgatcatggaggatgatgtttttgatttgttcttggctttggtttgcgagtattttattgagtatttttacatcattgttgataagggaaattggtctgaaattacttctttgttgtgtcttcttagtattgtttaggtaacagggtaactatggcctcatagaatgactttggcaatgttctttctgtttgtattttgtgaaataatttgaaaagtattggcattaaattaaatttgaaagtctggtctaattctgcactaaaccatctaaccctggacttttttgcttgggaaacttttaatgactacttctgtttccttaggggctataggtctgtttaaattgtttacctgatcttgatttaactttggaaagtgatacctatcaagaaaattgtccatttttgtagagtgcaggttttgaaataagatctatcgatgctttggatttcctccgtctgttatgtccccctttcatttctgattttgttaatttggatattctccttctcccttagagttagcttggctaagggtttgtgtgtcttgttgatttcctcaaagaacaaactcttggtttctttattctttgtattgttctcttagtttctaattgactgatttcagctctcagtttgattatttcctgccatctatttgtcttgtgtatgtttgcttctatttgttctagagctttcaggtgtactgttaagttgctagtatgaggaatctctaatttcttttttttaagaaagataaatatttattcataacaaatctttttttatataattttttattacgtattttcctcaattacatttccaatgctatcccaaaagtcccccctcccgccccactcccctacccacccattcccattttttggccctggagttcccctgtactgggacatataaagtttgcctgtccaatgggcctctctttccagtgatggccaactaggccatcttttgatacatatgcagctagagacaagagctctggggtactggttagttcataatgttgcacctacagggttgcagatctctttagctccttggatactttctctagctcctccattgggggccctgtgatccatccaatagctgactgtgagcatccacttctgtgtttgctaggccccggcctagtctcacaagagacagctatatcacagtccttgcaacaaatgcttgctagtgtatgcaatggtgtcatcgtttggaggctaattatgggatggatccctgaatatggcagtctctagatggtccatccttttgtctcagctccaaactttgtctctgtaactccttccatgggtgattgtttccaattctaagaaggggcaaagtgtccacactttggttttcgttcttcttcagtttcatgtgttttgcaaattgtaccttatatctcgctatactaagtttctgggctaatatccacttatcagtgagtacatatcatttgagttcttttatgattgtgttacctcactcaggatgatgccctccaggtccatccatttgcctaggaatttcataaattcattctttttaatagctgagtagtacttcattgtgtaaatgtaccacattttttgtatccattcctctgttgaggggcatctgggttctttccagcttctggctattataaataaggctgctatgaacatagtggagcatgtgtccttcttactggttgggacatcttctggatatatgcccaggagaggtattgcgggatcctccggtagtactatgtccaattttctgaggaaccgccagactgatttccagagtggttgtataagcttgcaatcccaccaacaatggaggagtgttcctctttctccacatcctcaccagcatctgctgtcacctgaatttttgatcttagccattctgactggtgtgagatggaatctcagggttgttttgatttgcatttctctgatgattaaggatgttgaacattttttcagttgcttctcagccattcggtattcctcaggtgagaattctttgtttagctcggagccccatcttttaatggggttatttgattttctggagtccaccctcttgagttctttatatatattggatattagtcccctatctgatttaggataggtaaagatcctttcccaatctgttggtggcctttttgtcttattgacggtgtcctttgccttgcagaagctttgcagtttcatgaggtcccatttgtcaatcctcgatcttacagcacaagccattgctgttctattcaggaatttttcccctgtgcccatatcttcaaggcttttccccactttctcctctataagtttcagtgtctctggttttatgtgaagttccttgatccacttagatttgaccttagtacaaggagataggaatggatcgatttgtattcttctacataataacaaccagttgtgccagcaccatttgttgaaaatgctgtcttccttccactggatggttttagctcccttgtcgaagatcaagtgaccataggtgtgtgggttcatttctgggtcttcaattctattccattggtctacttgtctgtcagtataccagtacaatgcagtttttatcacaattgctctttagtaaagcttgaggtcaggcatggtgattcctccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcatctttaatttctttcttcagagacttgaagtttttatcataacaaatcttaacaattgattttacattctaagctacaaggaaatagcaaaacagcaaagagaaaacaagagctgaagaaaagcagtttaccatctttcactctaacttggtgacacttcattggcccaggccctgttctggcctgttttccccaagaacactttctggtttacagctcactcgtgattctgggttaaaaccacctttctcctgagggttctaatttctttatgaaggcacttagtgctatgaatttttttcttagttctgctttctttgtttcccataagtttgggtatgttgtgccttcatttttgctgggttctagaaagtctgtaatttcttttttttctactctgacctagtggtcattgagtagaaagttgttcagtttccctgaacgcataagctttctgttctttcttttgttgtgtaaatccaactttaatccttggtggtcggataagatatgggtggttattttaattttctttttcctgttgagacttactttgtgactgactatgtggtcattttggagaatgttctgtgaggggctgagaagaaggtatattcttttgtgttttggtgaaatgtgctgtagatatgttaggttcatttaattcataacgtctgtaaatttcattatttctctccttagtttctatctaggtgacctgtccttttgtgagattggggtgttgaaatctcccactattgatgtgtgaggttctatgtgtgatttaagctttgctaatgtttcttttaccaatgtggatgcatttgggacatagatgttctgaattgagaagttatcttgatgactttttcctttggtgagtatgaagtgtctttccctatttcttttaattaattttgattgaaagtctatttcattagatattagaagggttactccagcttgcttctttggtctgtttcttagaaaacctttttccagccctttattctgaggtactgtctatctttgttattgaggtatgtttcttctatgcttcagaagactagatcctgttttcatgtacattctactagcctgtgtctttttattggggaaattgagtccattgatattttgagatattaatgtttaatattaattgcttattcctgttattttgatgttggtggtagtgtgtgtgtttccctttattacttactagtcatgtgtagctttagcattgtttctctcattttaaaatatttttttttagatagagtctcttggcgttcaagcagaccacagtgttgcactatagctaaaattgaccttgaactcttgattcttctacctccacctcccaagtactaggcatacagaagtgtaccaccatgctaggctcattgtatgtttatttttaaatggtgtgcacctgctggtattagtggaggccagaagagggcatctggtcccttggaactagagttacaggttgttgtgagttacctggcatgggtgctggatccaaacttaagtcctccacaagagcagcagttgttctttattgctgaaccatccatccagccctgtatgttgttgtttttaaataaataatggtgggttttttttgttttggttatgtttggtttgggctgttggggatgggacccagaacctcatgcatactagacaaagtgctgtatcactgagctacgttcccagtctgaaaatattttatagttaacagatatggtgtaatgttttatatgtctacagtgtaaaatgattaccatattcaaaataattaaaatatctatagagttagaacttttcaagtttgcagggcaatattgttgactaaataatcaataagacctctagaacttactcatactacataactataactctatcttttaaccaatatctgtcgcatctcatcttatcctttataactaccactgtaccctttacttaaacaaatttctatcttttaatagatctgagataaaatcagctcatgcatcttctttttctgtatggtttgtttcacttagcatgttattaaaactaatcagcttttttttttttttttttttttttttttttggacatagactctttctctgttaccctaggctaacttcaaattcaccatcttcttgccttagtctctagtgtactgggatgataggtatgccccaccatatcttactatcatttgggtttggatttttctattgactaatggtatggaatatattttttgtgtgtttgattgtgtttatttagagaaatttatatttggaccttttgttgatttcaagttatcttagttactgacatcttattgactctgccttttgccttacagaaggagcttttcagattcatgaggtctaatttatcaattcttgatcttaaagcctgagccattggagttctgtttgggaaatttcccctagtgccaatgagtgtgaggctcttccttactttctcttctaatagattcagtgtatctggttttatgtgaaggtccttgatccacttggactagagctttgtacaaggagataaaaatggaaaggccatccagagactgtcccacttggagattcatcccagatacagacacttaactgttgtacgtgacactattgtggatgctaagaaatgattgctgaaaggagcctgatatagctgtctcctgagagaccctgctagagccttacaaatacagtcggatgctcacagccaaccattgcactgaggacagggtccccaatctagaagttagataaaggactgaaggaactgaaggggtttgcaactccatagttagaacaacaataccaaccaacaaacaccccccccccaagcttccagggactaagccactaaccaaggagtacacatggctccagctgcatatgtagtagaggatggccttgtcaggcatcaatgggaagagaggtccttggtcctatgaaagcttgatagatgccccccagtgtaggggaattgaagacggggggggggggcaggcgtgggtgggtgggtagaggaacaccctcatagaagtagagatgggggtgggatagggggtttctggaaggatgggaaaccgggtaagaggataacacttgattatgtaaataaattaagataaataaatttttaagaaacagaaaaaaatggatcaatttgcaatttttctacatgctggctgacagttaagccagcaccatttgttgaaaatgctatcttttttccactggttgattttggcttctttgccaaagatcaagtgaccatagttgtgtggattcatttctgggtcttcaattctattccactgatctacctgtctatcgctgtaccagtaccatgcagtttttatcactgttgctctgtagtacagcttgaggtcaggcatggtgattccaccagaagttcttagtttgctcaatcctaggtcacaaagatattttcctgtgcttccttctagtagttttataggttttacatttacgttttcatctgtgatacattttatattagttttatatataaagtgggggtaatagttcattttatttgtttatatattaatagataaccagttaactcagcatcctttgttaaaagaaatatccttttctcctaacaattgccttggtacctttgtgaaaagtaaattgaccatatttaattgtgtattctggattatttatttatttattttaattaggtattttcttcatttacatttccaatgctatcccaaaagtcccccataccctcccccctactcccctacccaaccacttccacttcttggccctggcgttcccctgtactgaggcatataaagtttgcaagaccaatgggcctctctttccaatgatggccgactaggccatcttctgctacatatgcagctagagacaggaactctggggggtactggttagttcatattgttgttccacctatagggttgcagaccgctttagctccttggttactttctctagctcctccattgggggccctgtgatccatccaatagctgactgtgagcatccacttctgtgtttgccaggccctgacatagcctcacaagagacagctatatctgggtcttttcagcaaaatcttgctagtgtatgcaatggtgtcagcatttggaggctgattatggaatgaatccccgggtatggcagtctctagatggtccatcctttcgtcacagctccaaactttgtctctgtaactccttccatgggtgttttgttttgttccatttatctgtctacatccattcttttatttatttaatttttaagagacattgcctttttgttttgttttaagacagtttctgtgtagccctggttgtcttggaactttctgtgtggaccaggctaacctcaaactcagatgtctgcctgcttctccctcttgagtgctgggattaaaggtgtaagcctccacccaggggacactgtcttagaacaatgtcttaccatataatgctgactgccctggattttgctacatagaccaggcaggcctcaaactcacagagatctgtctgcctctgcttccaaagcattgggatatacctgcatgcccagcatatatgtctattcttatgccagtctcatagtacctcaattactttaccagttttgaaactatgtcatttaagtgctttagtgctgttttttttaaagaagtattacctattttaggtccttcctttgcatgtcaagttttattttttaacagtaccatacacatacataatgcatttgttggttctaagaacagttgatcatttatttttgtagtaatttttgagaatttaattttaatatggtcacctaaataagacctgtgtgatggctacaacagttgtcatcccaacttgagtaagggcagtcacacaagatcttaagcctagattaagggctacaggcaagagataatcattcttctccaggaagggggcccctaataggttatccaatcccatgagaccagtcttaaagacctaaacatacaagcagcactatagccctaaacacataaacatacagtctgtactatatggatcagtaggctgtatttatgtgtgtaagttattattgtaacataagcgacaataagacgttatgaatttgagatggagtaggggaacatgaaagagtgacttagtggaaatgatttaaatgcggtattcgtgtacatgccaaattttacaaaaataaaacagtgcattttgatgaggattacattgtgtaataacttagggagaattacctttgggggaaagtaatgagtgtcgattgagggatttgcacatgttaagcatgcattctaccattgtttcattagccctacaatgactcatttcgtggtcttgttctcatttttctagtacgaagaggatgaagagtgtatccaaatctcggagagccaaaattgcaaagaaggtagacagtgcaagactggtagcagaacaggtcatgggagatgaatttgacttggattcagatgatgagctgcagattgacgagagattgggaaaggaaaaggcgaacctgttaataagatcaagtatgtttctgttttattttttatttgtcctgccatttcacacttgttttaggtttaaattttatggcttttagatttaccaagctctaaatacctacaagattagaggttatttggtttgggttttttttttcagttaattccttggtggccattacttcagagaaaaaaaatgcatttttgtttgtttatttgttttcaagacagggtttctgtgtagccctggctgtcctgtaactcactctagaccaggctggcttcaaactcagatatacacctacttctaactcccaatgttgggattaaaagtgtgcacactgccacccattggaaattatattcttattttgcttcctttgagtgtttggctcagatgcatcataaccttgcctcatactaatatattgcattgtattttagaatttccccggaagttgccccgtgcaaaaccttgctctgaccccaaccgaattcgtgaacctggagaagttgagtttgacattgaggtaggagtgtgtcctagatctggcaaagggacaagcatagtatgtatttaatttctgaaatagaagataaatactgaatgctagggtagggatattcttcactgtagagcatttgcttagcctgtgcaaagccctggattcaatttctgtccttgtgaaaaaaattaaattggacactaagttttgaccagcatataaatggaagattataattgagttaaaatattttaaaatattaaataaaaggcagtatcacttagggaagagagtatatgatttgtagtttatgatgtgtcccttcacacattcttttaattcattgtttcctaaattgcttgtctatcaagtagaaatcatagtgctttacaaagattttaaagattgaaatggaatgataaatgtactgcataatagatggtctacatataggatgttaggactcacactgtcaaacttgtactagaaacttaccagacctgccctgtacaattgaggcagtatattttttctttaacaggaggactataccacagatgaggacatggtggaaggggttgaaagcaagcttgggaatgggagtggagccggtggaattcttgatctacttaaggccagcaggcaggtggggggacctgactatgctgccctcacgtgagtaatcttcattttctaggctatcaaaagagtaccacccaaagggctaggccagctaattatttgttgagcatttttatatgttttgggtttttgagacatcgtctctttatttatcccaggctggtctggaactcctagtacttttttgccttgcctccaagtgagtgctgataatacagacccaacatgtaccaccatgcccattactgaaccaattagataattaacaaggatatttatgctgggagaataatgtgaatgtgaaaactgtccttaaaatcttcagagatggcagtaacaggatatgtagacttgaggaagaagcaattttaagtactttggaaatgggccagggagagtcatagaaagagaattgttaataaaaggaaataatgcagcatagatggtgaaaagaggattctgtctctccacattgcttgtctttagagagacctgaggcaaaattcgcttttcataaaaacagattttagtattatcttcattcttaaccatgaatggttctttcctttgtaataccttgattgacatagctattctttctgagtgttctgacatttggtttcttctggctacaataacttccccagtgtttctcctttgtcctttgcagtgaggccccagcctcccccagcactcaagaggccatccagggcatgttgtgtatggccaacctgcagtcctcatcatcctcaccagctacctccagtctgcaggcttggtggactggagggcaagaaagaagcagcgggagctccagcagtggcctgggcactgtgtctagtagtcctgcttcccagcgcaccccagggaagcggcccatcaagaggccagcatactggaaaaacgagagtgaagaggaggagaatgccagtcttgatgagcaagacagcttgggagcatgcttcaaggatgctgagtatagtaagaacatgttagaatattaggctagatcaaagagttccctttagcccaatttcaatcctaactctaagagaaaatagcctatagtgaacacaggtctcaaccttaagctagatacttattttttttccctgagccatgttttcttgctctgtaaaatggcagttatctgtatccccataagttgttgtaagaattaagagataatgtttagactcagcattaggcctttagtgcctttctcatggcaagtcctccattgtggtatagttagttctcttataattagctgtcatctggttttggtactgttatgtttcacttcaacaaactcatttcctctcttgcttatttgactgttatcatctgtatttttaatgttctatgttaatcaattcatttcttgcaaaggtatataccatcaggtctccatagctgagcattccatatccattgtttcatccatagataaaagtatgtggaaaaaaattacatatgtattgaacatgtatagactcttctttccattttcttctaacttgtatagtacaactatttacattcaaagtaaattattgaagagcatggagtgtatacaaatataataatattttatataaggaacttaagtacacatgagttttggttgatgaaggaggacattctgaagtcaattcccttcaagtatcaatggaaaactgaaatgaccttcatggatctttacatatataagaaacaaatcctaaaatatgatgattttggaataatataatgaataaagcactggtttatataatgtaggtaacaataatgctgatttttttaatgttttcaaaattatataaatgtaattttaattgagactaaaacctagagaaagccaaaactccttagacctgatacttttctttctgagcatattttctttttgttgtgttcatacaacttatgtgtaaacatatatatacagtgtatagttttgtttaatgtgtgtagctctgcagttttcttggatttctttcaacatcagtacatggagatctgcttcaacacatacagttttgcttgctgcaaactattctgtagcatcacaatgtttatttctttctctatttgacatttaggttgttcttaagggttttttattgcattgaaaatcctttcaataatctttttgtgtctattttgccaggaaatatctctctagaataggaaaacttgttgagttaaagattatatacaagatacatactgatagtgtcaaactatgtttcaaaaggatcagtttatgaatagtgtatgagaaatacctttttccttacattttttattaggtattttcctcatttacattttcaatgctatcccaaaggtcccccatacccacccccccaatcccctgcccacccactccccctttttggccctggcgttcccctgtactggggcatataaagtttgcaagtccaatgggcctctctttgcagtgatggccgactaggccatcttttgatacatatgcagctaaagacaagagctcccgggtactggttagttcatattgttgttccacctatagggttgcagttccctttagctccttgggtaatttctctagctttatagtgggtggatattataaatcatttatgttctctaactaaaggttgtgctttctttgttttatatattttttgatcctttgttcattttctttgagctatctgttcattctttcaattatttctcttttcaaaaaaatttcttacggatttgtagttcttttcgtattgtttaattattgtttctttatcattatcatctcctcctccttcttctcttccttttttttttcaagacagggattcactgtgtaccccttgctgtcctagaactcatgttgtagaccaggctggccttgaactcgaggagccacctgcctcttcctccttagtgctgagattaaaggcatatgctaccactacccggcttccttttagtactttttattctgtgtttgttaggttattttttatgtattcccttttttgctagagaggaacattgtgtatttcttctcatgtctgtacaagcctcatatagttgaaagctactggggaaaagacagaagagtagatgcaggaagtggatagagtatttttctagtctttgctattgtagttccagactcctatctccttgcctcatttttttctggtttgctcttttctgtacatcatagtatcatcgtcaagtaacctccttacaggaagattgcaatattgttctttttgaggcaggttttattaagtaacccaaggtagccacaaacttatgatcctcctgatacacagcccacatctaaactgcaagcaggagacagagagtacactgggcatggcgcaaatctattgaaacctcaaagcccacccccagtgacacaccccctaacaaggtgacacctcctattccttcctaacagttccaccaaatggggacaaaatattcaaatgggtatatacagggcattatcatctaaactaccacagaaatctgataaaaaaaatttccattctgtaggttgcctcattactcaattactcattcaagcaaacaatgtttgctgtacaaacactgtttagtttcatgaggtcccaattattaattgttggtcttaatgcctatactatcatggtcttgttcagaaactcctttcctataccagtgagttcaaacatactccatcatatctactctattagggtcagggtaacaagccttatattaagttcctaaatccatttggagttgacgttttgtgcaacataaacggtgatgatccagtctcattcttccacaggtagctatctagtttgaccagctgtcttttctctgagtattagtggattctttatcaagactcaggtgtgtttttttttgtgaatctgcaatttaatctgttgatcaatgagtctatattatgatatgaaatcctggattttaatagctctaaaacttttgttgttattcagcactttttgactctcctgggacttctgtgtttcacttatgatatttaagattgttttttcaatttctttgaagaattgtattagaattttgatggtgattttattgaatctgtagcttgctttttggcaagaaggctgttttcacaatattcattctgccagtccatgaacatgggaagtttttgcatcttctgttgtctctttcagtttttcttttcagtgtcttcaagttttgattgtacaaaatttcacttcttttgagtattccaagatattttgaggtagttgtgaaaggtattgtttctctgaattctttctcagtatgcttgtcatttatatataggaagactactgatttttatgttaattttgtatcttgctattttgctgagtatacttatcagctgtaggaggtttctggtgacatctttaaggtcttttacatatagaaacatatcatcctttcttatttatatcccccttatctccttcactggtctcattgttgtagctaagacttcaagtgctctgttcaaccggagtcaggagagtggcagccttgtcttattcccgactttagtggaaatgctttgagtttctctccatttaggttgatgttggctgtcatcttcttgtacattgcctttattatttttgagataaatctcctgtatctttagattctccaggacttttatcattgtggaatgttaaattttgtcacaggactttcctgcacttagtgagacgattcagtggtttatgtcctttatagtctatgttgtggattatgtttattgaattttatatgttgaaccatctctatatctctggagtaaaaacaattttgattacagaggataatctttttgatatgttcttgaattctgtttccaattgttttgagtattaagggtccattgctttccattcaaattttagaaccaacgtttccacttctatgaacttgctttgaaagggattgcattaaatatgtagatcactttagggactattaatgtcttaacagtattaagacatccaaccttagatgtcttaatactaagattggatgtttttacatttatttatgcctttgtagttttttttttacctcttatatttcatctgttagatttatttctcctcatttttgatattactagaaatacaattttcttaatttcctttatatattagttattactaatgtatagaaacaagactaattcttatatgttgatcatacctttttccaactttgtagagttctgttattacctataatgtcactcccaaactcccaacccccaacccccaacccaactatggtaggttctttagaattttgtatacatagggatgattttatttttgccttttcaatgtgattttttttcctttttaagttttacacagatatctataaagttttgtttataagcaggaatttggcaatttctagtagtccttatattattaggtaaggatgttagtttaagagaaatttatacagaattctaattctaaaaagtaataaatgttagtactctgtaaaatgaagcaagcttgattattagcaacactctgtgcctattactcagaagtacttctgttttggtctccgtatcctatgatttttttttccattttttattaggtatttagctcatttacatttccaatgctataccaaaagtcccccatacccgcccacccccactcccctacccacccactccccctttttggccctggcgttcccctgtactggggcatacaaagtttcctatgatttctaaaacagacctttattacttcattcctatcacagccttaacacaaaggttttctttcttgtgtgtgtgtgtgtgtgtgtgtgtgtgtgtgtgtttgtatgtgtgggtattctggcatagaaatttgggatgtgtcataggcatgtacccaaagccaaggtatttcttatattttgggtttactgatttggtactactgtatcctgtggatcatcattttctgccactgccagcagagcttgaagtaaccataatactgtaaaaaaaaggcattgccacttgaactttcagctcttaaccacagagccatccctccagccctgcagttcatgggcctctagaactggtttgtaggaggaatgtagaagatttttggagatatagaatagaaaaccccttaaatactctaagaaaagcaaaatgagacattttaatgggatttaaaaaaaaacgaatgccaaaagaaatatggaccttggaggaccagttcttgaggcttcagaaggaaacaaagtctctatcgggacctagcctaggggccattcatattctatcaattgatctggctgtattctggcagcatcctgagaaaaggtgaatatttttttttagtgaaagaaatcccaagacaggatagcattcaggttaggatgtgtcttggttacttcttgctcttctcaaccaggtagtgcataaagatatgaaaagtgtgcagtgtgatgcaaaaagtagcctgactgagttttaaaatgtggccacagaagaaataaaagtagatatggttttgttaaagagactaacactaataaaagagtactgagatgatagataggaagttatcctaagggtgaactcatccaccaaggctgcaactagtgaatatacaaattcattttgagacagggataggactgacaatagcactgaatggggttcctggtttaaaaaaagcttcataaaaatgcttccaagattcagttactaaaacatacaaaagctactatatctttgttctaagagggactatatatatcttgagctggcagctgaacaaggcagtgtcacccacatgatactagttttgggtgcatgaaaaattcaggattgaggaagtgatcaagttttgcaccatggttccacatgtggctgaatccaggcaatgtgtggcagggctggagtccctgcaaggaaatacaataggccactgtgtgaagctattaggtgaaaaggtccaagttacaatacaaaccctaagggttctggagaagcaagaactataagatctgtctgccaaggaaagctttaagcaaggagtatagcaaccacatggtggctcaagaatcaaataacataaaaattgctcaacttttatattcatatcctttcataccctaagatatcattaataaatatttaatactgtccaaaactgaggatcctatatctaatgttgaatactaaattgtttcaaaacatacaaaatattcattgggagttaagcatagtaaaagagcataaaatgttaaagatgaatcattaaaacacaagaaaatcaagaaggaagaccaatgcgtggatacttcattcctccctagaatagggaataaaatacccatggaaggagttgcagagacaaagtttggagctgagacgaaaggatggaccatccagagactgccccacccggaggtccatcccataatcagccaccaaactcagacactattgcatacaccagcaagattttgctgaaaggaccctgatatagctgtctcctgtgaggctttgccagtgcctggcaaattcagaagtggatgttcacagtcatctataggatggaacacaggacccccagtgtaggagctagagaaagtacccaagagctggtctgcaaccctataggtagaacaacaatatgaactaatcagtacccccagagctcatgtctctagctgcgtatgtagcagaagatggcctacttggccatcattgggaagagaggcccttggtctagcaaactttgaatgccccagtacagggaaatgccagggccaagaagtgagagtgagtgggtagggaagtagggcagggggagggtataggggacttttgggatagcatttgaaatgtaagtgaagaaaatatctaataaaaaattttaaaaaagaaatatattcgaaagcccttacatgataccacctgacatagtgagagagtatttaaaatgcattatatatctgtgtaccttgtgtaacaatcagtttacttaaaaaagattatcagtgcttctaggagagaaattcttttatcagtaagtatattataaatatttcaaaatagcaaaaactctttgaaggtaaacattaagaaaatgctaacttcaagcactgtgagaaaaattgtcaataatattttcatgatgtttgtagaacattattttaatattttcaacttaatattcaacaaacaaaataattattttaagatacatttcattgttatgtttcccttttcatttctgattttattaatttggatactgtctctgtgccctctggttagtctggctaagggtttatctaccttgttgattttctcaaagaaccagctcctggttttgttgattctttgtatagttctttttgtttctacttggttgatttcagccctgagtttatttcctcccttctactcctcttgggtgtatttgcttctttttgttctagagctttcaggtgtgctgtcaagctgctagtgtaaggtctcttcagttttgttttggaggcacttagagctatgagttttcctcttagcactgatttcattgtgtcccataagttttggtatgatgtgtcctgattttcattaaattctatgaagtctttaatttctttctttatttcttgcttgaccaagttatcattgaatagagcgttgttcagcttccatgtatatgtgtgctttctgttgtttttgttggtatttaagagcagccttagtccgtggtgatctgatagggtgcgtgggattatttcaatcttcttgtacctgttaagacctgttttgtggccagttatatggttaattttggagaaggtaccataagggtctgagaataaggtatattcttttactttaggatgaaaaatgttctataaatatcttagatcaatttgtttcataacttctgttagattcactgtgtctctgtttagtttctgttcctatgatctgtccattgctgagagtagggtgttgaggtctcccactattattgtgtcgggtgcaatgtgtcctttgagctttagtaaaatttcttttttgaatgtgggtgcccttgcatttggagcatagatgttcagaactaagaattcatcttggtagatttttcctttgaccagtatgaagtgtccttccttatctttttggataacttttggttgaaagttaattttatttgatattagaatggctactccagcttgtttcttgggaccatttgcttgggaaattgttttccaaccttttactctgaggtagtgtctgtctttgtcagtgaggtgcatttcctgtatgcagcagaatgctgggtcctgtttatgtatccagtctgttagtttatgtctttttattggggaattgagtccattgatgttaagagctattaatgaaaagtgaaattttaaaaattagaagaaaagtgattattactttctgttatttttgttgttagaggtggaattatgtttgtgtggctatctttttttgggtttgtagaaagattactttcttgctttttctagggtatagtttccctccttgtgttggtgttttctagggctggatttatggaaagatactgtgtaaatttggttttgtcatgggatatcttggtttctctttctatggtaattgagagtgttgctgagtatagtagcctgggctggcatttgtgttctcttagggtctgtatggcatctgcccaggatcttttagctttcatagtctctggtgagaagtctggtgtaattctgataggtctgcctttatatgttacttgtcttttttcccttattacttttaatattctttctttgtttagtgcatttggtgttttgattataatgtgacgaggagaatttcttttctggtccagtctattgggagttttgtaggcttcttgtatgttcatggcatttctttctttatgttagggaagtttcttctataattttgttgaagatattcactagccctttaagttgggaatcttcgctctcttctatacctattatccttaggtttggtcttctccttgtgtcttggatttcctacatgttttgggttaggagcattttgcgtcttgcattttctttgactgttgtgtcaatggtatcttctgcccctgagattctctcttctatctcttgtattctgttggtgatgcttgcacctatagctcctgatctctttcctgggtttttctaactccagggttgtctccctttgtgatttttttttaattgtttctagttccatttttagatcttggatggttttgttcatttccttctcctgtatgattgtgttttcctgttattctttaagggatttttgtgtttactctttaagggcttctagctgtttacctgttgtctcctgtatttctttaagggagttatctaaagttctctatcatcctcatgagaagtgattttagatctgaatcttgcttgtttcgtgtgatggtgtatccaggacttgccatgttgggagaatttggttctggtgatgccaggtatccttggtttctgttgcttatgttcttacgcttgcctcccaccatctgattatccctagtgctccctgccttcaccatatctgactgaggcctgtcctttctgtgatcctggttgtgtcagaactcctcagagttcagctgtctctgggatcctgtgattctgggatcctgtgatcctgagatcctgggtgtgtcacagctccagggagtcaagctgcctctgaaaccctgagatcttggtgtgaccaaactcctgggatcctgtggtcctggacatgttagagcacctgggagtggagcttcctctgggtgttgtgggactggttgcagagtttgagtccaaggtctgctcagagcactggcccagaccagaaggaacctgtgccactggtcgagcagagttcctgggtgcctgggtcccgctggtcccacttacttctggcgttggggcagatgttgtatcctcctcacctctaatcctatccccatttcatttcttatatgatgtatttgtcttttctttgtccgtctaaatcaaatacttaccaattatattgaacttttcaagagataatcttattatttttaaaatcatattacatatattgattgattgattttgtgtgtgtgtgtgtgtgtgtgtgtgtgtgtgtgtgtacgcgagagagagagagagagagagagagagagagagagagagagagagagagagcatgtgcatgcacctatactgctatggaagttagaaggaattgttcttcttgttctacatatacatttctgtggttgtacttatattatcaggcttagtggcaacatccttgttcactgagccatctttctggcctaattttaagggatcttttaaaatctgttttttaattaaaatataaatatatcttttccccttcagttttctaattctaataccttccatgttcctccccacctcttctcaaattcatggcctcttttccttttattgcataagtatataaatgcaacttgcttggtccatttagtccatttagtgttacttttaagatgtgatttcatagttgacttgtgttgacttggtgttattagatatagtagtgggtgggggtttatccctccaaaagattgattctacctctctcagcagtactttagttgcctgtagttctttatttagggatggggaccagtgagattcaccccttccatattagcatgtctgttggtactgttcttcaggtcttgtttaggcagtcatattattaagatattctgggtccccgccatttctaggaaatgcagtctcagactagatttcctggtcctgacttttatcatctttctactccctcttttgtggtttctcctgagctttgggtgcaggagttatgctgtagatgtatccattgtgttttgacacttcacagtcagttctctacattttgaccaattgttgtttttaaataatggtctccatgttacaatgagaagcttcttggatgagaagtgaaagctatacttatttgtgggtttaagattaagtatttagaatgcagatatatgacctcactagccatgggtagttggctgggtttccaatattaggtataatttccctcctgttgcttgccaccaagataggagagccattattgtacccttggagatatcttgctgtgctgtttggttcctatgactcacagcagggtagggttattagttgcttcccttccttggcagtttgcataccaacttctggaaccatgaaagctactccttaaggaggagactttcaggtcagatccagctcagattctctgagtcctgggtataaagtgtataatgccatccatagtaggaacttcaacctctgggaggcaaccaaggacaacagtaatgtgctgtaatgttttaggagtctcttgaactcctgacaaacaacttgaaaggtggtttttcagtcatgtactggagtttttgttaatagtctgtcactctttgggggagtattattcccccaaaatgtataactatatttaggttatgtatctatttatgcatattcatttaaatgtattacttgtaattttaggtaagtgaaaaaggatatgattccttatgtcttttttaatgaatgctatttttccctttctgttttgacattcccctctcatgtaaacctcaccccaccctcgctctcccttaatatcacctatatcctgctattctcctctctagtactccttctgtcacccccatggtccctttttactttattgctccaagatacttaaaattcagagctttgagctgcaaatagaagagaacatgtggtatttgtcttttggatcttgggttactttgatcagtataattttttctagttatatatgtttattgcaaatttcattcttttgtttttctttacagataaaccgtatttcaaagtatatatgtaccacatattcactatccttccatcaattgaaggacaattaggttgtttctgatgtcttggcaattgtgattagaataacaatgaacatagctaaggaagtatttgtagaaaaggtattaagtcctttgggcatatgcaaagactagtttttgaaaggtcagctggtatatttattttatagatttttgtttgttgtgagacagctttatctgtcctggaactagctctgtagaccaggctggcctagaactctcagagatctgcctgtctctgcctcttggccaccaccactcaaccctatttcttagctttttaagagttccttccacacattaatatctagagtagatatgtgaatttgcagctgtaccaataaacagtgaaagaggttcccttcccctgagttctctccatttgttgtcttgatcttaggcattctgactaggttaagctgaaatcgcaaggtagttttgacttgcatttctctggtgattgattttatttaattagtttcatatttttattggttgggaatttcacatcatgaaccccaatcacattcacttcccacgcttcccaggtctgccctgatgaacatttttaaagatacttcttagctacttttatttctccctttgagaattctctattcacattattagcccattttttaatgcatcactgtttttactcctattttctgaatattttataaagccatagatattaatcatttgtcaggtatgtagctgccaaagcttctctctgttctgtgggcttcttctctcaattgtttgtttttatcttatatgcattaatgttttgccagcatgtatagctgtgtgagagtgtcagatttccttaaaactggagttacagacagttgtgagctgccatgtgattgctgggaattgaaccctggtcctctagagagcagtagtgctcttaacaactgagccatctctccagcccacttatttctttagctgtccagaagctttggctttaattcctaggcaaataatcctattcagaaagtcttcccgtgcctttatcttgtaaaaccttgcctatcttttcttctagcactttcagtggttcaggttttacattttggtatttgagttactttttgttttgttttgttttgtttttgttgttgttgtttttcgagacagggtttctctgtgtagccctggctgtcctggaactcactctgtagaccaggcttgcctcaaactcagaaatccacctgcctctgcatcccaaatgctgggattaaaggcttgcgccaccactgcctggcttcagttactttttatgcaaagtgataaatacaggtttatttaattcttctacctgtagacattgaattttcccagcatcatttgtcataattgctatctttatccaatttatgtttttggcatctttattaactattaaatggctgtatttacatgtacccatttttcttccttctattatattttactggtccacatgtctggatgttctttttggttttaccagtaccattctgttttcgttaccatggctctgtaacagttttgaaatcgggaatggtaatccttccagctttgttctttttactgaagtttgttttaactatctggggtcttttgtggtgaatgttaaaatagtgttttctattttgtgaggaatgagaagggttttgattatgattacattaagtctataaataggttttggtagagtattcattaactctaccaatccatgaatatgagtgttttccccattttctagtattattctcagtctctttttttcagtgacttaaagttttcattgtagaaatctttcaccttcttggttaggttttagttcttgattttttttttatggctattgtgaatgagaatgtacccatatctttcttggtgtgttgttggtatatagatactgatatttttcttttttttaattatttttttacattctgacctcagtttccctttctcttctcctcacagttgctccctcctacctccccttctccccatatcccttcctcatccaagtctcttcagaaaaaggacaggcatcttttggatatcaaccaaatatggcatatcaagtttcaataacattaggtgcctcccctcctattaaggctggaccagacatcccagtaggagtaaaagggtcccaaaagcaggcaagtgaatcagagacagcccctgtttccactattaggagtctcacaagaaaaccaagctacaccaactgtaacatatctatgtcagtcccatataggctccctggctgttgattcagtctctatgggctcctatgagcacaggttagttgattctatgggccattttgttgtagtaccttgacccctctagctcctacaatgccctacccaccacctacccccaacacacacacacacacacacacacacacacactgcttccatagaattccccaagcttcataataatggttggctgggtgtctctggaactgtttctatcagttgatggatgaaagccttctgataataattaggctaggcaccaatctatgagcatagcagaatattattaggaatcatttcattgactttttgccaatcatgtttgggtctatcctagatttctgggcttatccagcctctggatcctggtcctctcgggagtgtcaaggtgggctccctctcaaggcatgagtctcaggatggaccagtcattggttgattactcccacaatttctgtgccacttttatatcatcatttcttataggcagaacaaattgtaggttgaagttttgtggctgggttggtgtccaagttcctccactggaagccttgcttggttacagaagatggcaagctcagtcttgtatctcaccccagctaggaatcttagctaatgttaccctgaagataactgggagtttccattgaattaggtttctaccttacccagaagatacccctcccaattctagccatctctcccagtactctctccctccctcctcccccctccccaattccagccttctctcccaatactctctatctccatcctccccctccaacctgaaccctctttttgtcatgcccccccattcacccacaatatctattctacttcccctttctgcagagattcatgtatccccctcctcaagacctctttgttacttagctcctctggttctgtgaattgtagcatggtttcctttaacgttataggtaatatacacttatgattacataccatgtttgtctttctagagacagttgtgagctgccatgtgggtaccacgaattgatccctggtcctgaagagcagccagagccatttctctagcctaaagtgtgtttcttgtatgaaacagaaagatagatcctcttttcacatccattctgttagccctttgcctttggggggttggggattgagtctattgatagtaaagaccaatgattgttaattcctattgtttgttgtttggtgatgatggtgtgggtgggaatggcatggacacacaaatgtggttcccttcttgtgcaagtgtgaaattatttcctgtgttttcttgggtgtagttaacctacttgggttggagttttccttgtagtaccttctaagggtaaatttgtggatagattttgtttaaatttgagtttgtcatggaatatcttgtttgttccatctatggtgattgaaagtttttctgggtattgtactctgggtctgtagtctctggcatctggacagtctacagcacatctgtgcaggcccttgtagctttgagaagtcaggtgtaattctgatagatctgcctttgtgttacttgacattttcccttgcagcttttaatattctttctttgttctgtatgtttagtgtttccactcctattattcttaggtttagtgttttcatcatgtctcaggtttcctggatattttggttcaagagtttttgagaattaacattttctttagactgatgttaacaagtctctcaagttcttttctcctatcttgcacgcctaagattctcccttccatatcttgtattctgtttgtgatgcttgcatctgaagttcctgttggcttacctagattttacatctcccaagattcccttggtttgtgttttctttattggttctatttccattttcaggtcttgaacagttttattcatttttgtatcctgtttattatttttctagaatttctttaagggatatattcatttcctctttaagggcttgtatcaacttcataagattggatttaaggtcatttaaatatccaaggcttgttacagtaggatagctggtggtgccatgttgtcctggcagttgttacattcttatactggcctccagtcatttggatttgaggttattataatttagctgcctatttctgtgtttatctttgatgaatggatgtttttttttccttggtttctctcaggtcttctggcatgagcagcctgtggttctgatgatcagtgagtcttcaggtttaatagggtgtctccatttggtgttttcttagcctgtatgacctctagggttttgggtgcctgtgttgcctattggaatctgggaactggtatgacttctgggattttagatactagtgtggcctctggagtttctagtaccatcttggcctcctgaagagcagggatcttctgcaggaggtgtgagcctggcgttcctagtaacattgtggccttcaatagagcagggtcttctgccagaattgtggactgagatataaagcccaggggagggggtgctgttggggactgctggaccagctttaagaagtattagaaagtgatagatgggtgttttacctggggttcctagtacttctggtcccagcatagcctctggtagagtaggagtcttctgctggagttgtgaaccaggatatggagccctagatacagatttttgtgattttgtatcctaccatgtgttgatcatttctagaagttttatagttgttttttagaatatgtgatgtgcaaatagggacagtttaatggatccttgtctactttttgaataatttaataagaattgactgtaattctttgcagatctgttaaaatttttctgtgaatacatttggacctgcactttttttttccaagacagggtttctctgtatagccctggctgtcctggaactcactctgtagaccattctggcctcaaactcaaaaatccacctgcctctggacctgcacttttgtagttagaattatttttattactgtttcctatgttgcagttctgtttaggttgttgatctcttcttggtttaactttggtggtttggatgaatctagaaatttgttcatttcttttagtttttttaagttaatgagctataagtttttaaaatattccattataatattcttaatttccttatgtctgttacaaatggttccctgttcattttttattctgttagtttagatcacctgtttctttggtttagttgtgtcaaaagtgtcaattttgttcatctttctatagagttcttagatttgtttattcattatattgttttctgtgtttctatcttactaggttctgctgtgatttttatttttatttatttcttgccacatactggatttgaatttgctttgttcttgttttccaaaatcttgagtggcatctttaagtaaaatatttgtgctgtttctgacttgtctgttttttgagacaaggtctttctgtgtagctttggcaaatctagaacctgcaatggagacagggctggcttggaatttagaaaggtctgcactgattaaagacatgagtcaccatacctgggtctttctgatttttaagtgtaggcacttagagccataaatctctccagagattttgttgtgctttgttttcatttttattaagtactaagatttttttcttttatttccttctcaatttcttctttaacccattcatcattcaacaatgaggggtttttatctcttattgccatgcatttgtgtacttattagacatttgtttgcttttgattttgtgttttattaatctttttttttttttttttttggtttttcaagacagggtttctctgtatagccctggctgtcctggaactcactttgtagaccaggctggcctcgaactcagaaatccgcctgcctctgcctcccaagtgctgggattaaaggcgtgcgccaccactgcccgtgtgttttattaatcttacagtaagataggatacatggagtctttctgaatttgtaaagatttgttttgcattccaagatgtagtctattttagagaagtagtctaatcatggtttcccctccaccaactcctagatcctctccacctccccacccacccaatttcattccctttctctctagaaagcaagcaagcaaaaaaatatccccacataaacagaatagaaaaaaataacacaaatacacaggagcaggtacatgggcttgcagggatggacttaccaggttatatcagagtcacaggtctggaactaggcctgtgggtgtggagatgggaagaagtggatgggagtgggggtatgaaactgttcttaggccactactttgccacccaaaatttcaaagtatagttttctgaccctaaggcaccaagtctttcttctgtgtcacacttaacttctttaaagtagaaatcctttcagacccaacaaagtaatattggtggcttctcctgaaacagctgtgttagtattcattcctttctaagaataattaaatgctttttttgaaataaaaaatcaggaggtaaagttttcacctctttgctgaaggaagaaggtctgaaaaatatagagttctcttctaggcttgggagtggcctcagaattttacgtcatcaattggatctttctagaccatattcccattaaaaatcctaagtgtcttgcctatggattatgaagaattgcctatggtttttatgataatctgcatacttctatttgtttctctaaggtaggatagttaaatatagatattttattagattgtgcagttccaataattttggtcctagtttaatttagtcgattttttcctattatgtttattaaatatgtactatttacttttcccattctttcacaaacaataaatacctacttttcattgtatgggttgctttagtataaaatcaaacacacatccctggcctcatttgtaaattagaggcagcagatgtaataatcagttcctaagtacagtactacatctccacggcaggcataaaacacaggttgcgatggagagctgagaaggaggaatctgaaccagattatgagagcatgattatactcttttaaaaattatttacattccagctcctctcccagtaccccctcctatagttcttcaacccgctcctccttccacttgaatctgagaggttgcccccactcctagaccttccccttccctgggtcctcaagtctgtcaaagattaggcacaacttcttccactcaggccataccaggcagtgctggggggggagggctcagaccagctggaatatgctacttggttggtggctcagtctctgggagttcctggagtctgggttagttgagactgctggtcttcctatggggtcactctccctttcagcttcttccagcttttccctaattcaactaggggtccgtgactttagtccaatggttgggtatctgtatctatctcagtcaactgctagtagggcctctcagaggacagccatgctaggttcctatctgtaagcatatcatagcatcagtaatagtgtcaggccttggtatcccctacccccatgatatggatccaaaattggaccagtcacaggattgcctttccctcagtctcttttccattttatgtcactgcagttcttttagacaattctaggtcagaattctttttatggtagattagtaatttgatgccttgtctttctactggggtagactcttcaagttccctctccccattgttgggcattttggcaaaggtcaccccattaagtcctgagagtctctcacttctcgagtctctagtactttctaaagcctccctcccctgcaaggctgctggtgctggtcttctgtgcttctcttctggccctgccgccatacctgatcctgttcgcctttcccctaccccatccctctcccatcctggttcctcccaccctctgcctcaggtgattattttcttcttccttctaagtaggattgaagcaccctcacttgagcctttctgcttgataaacttcttatggtctgtgggttgtatcctaggaattctgtacttttttgctaatatccacttatcagtgagtacttaccatgcatgtccttttgggtctgggttatgtcacccaggatgatattttctagatccatccatttgcctgcgaatttcatgaagtcattgttttcaatagctgagtagtattccattgtgtaaatgaaccacattttctgtatctgttctttggttgagagacatctaggttgtttccagttctggctattataaataaggctgctatgaacataatagagcacatgttttggtggagcatcttttgggtatatgtccaagagtatagctgggtcttcaggtagaactgttttcaattttctgaggaaccgccagattgattcccagagtggttgtaccagtttgcagtggaggagtgtttctctctctccacatcctcaccagcatgtgctatcacttgagtttttgatcttagccattttgattggtgtgaggtggaatctcggggttgttttgatttgcatttccctgatgagtatagaactaaatctagagttaaattttaaaaggtgagccaagtagctcacatgagtgactaagaatttggtgaatgtagaaggactttcataacaagggtacaactatagaaaaggtacaaaatgtaagatatttaggaaccttctgcagttgaatgtggattatgtaaatgaatatacttgaagaggaggaggaaggactgaaatatgtatcattctgtctttgttcttatggatgaggtttaatttatttaatttatcctgccttcacctctccccacagtctatccatctctggagtctgatgatgatgaccctgctttgaaatctcgacccaagaaaaagaagaattcagatgatgctccatggagtcctaaaggtgatctagcattccgtatcttatactctgtaggactaatcaggtgaaaaatagagatcaatgtaagacatctgtaatccaagatcttattcagctactcatttgcaagcatctgttacttttagtaccatgttaggtgccagggctaaattgattgtgtgacatagtttgtgtaatctagctaggaaaatcatagctattgtttttgaaatcttatgacttgagatgaaggaaaccagaagagttcactaagccatctaaagcttctaagaacattctggtaactgtcatcgcagccccactatgataattttgttttcaaggaggaaaactatgcggactcttgggctctgcaagagtcccaagactgtcaactactaagaagttatccctaaggaagggaaggaagagagggaaagtaggtacctgaagtaaacatgaagttttaagagagaaagtaattttctttatctcattggttgggctatttgcactgaagagcattcaagggcttattaatttttgaatatgtatgatatatgtttctatgtatagtgtttgtgagtgtttatatatgtatgttcactcctgtgtggttatttatatatgtttgcagttgtgtgtatgtggagttgagagaataacctcaggtgtgggcccttgtcctcccactttgtgacagaatcttttcttgttcagtgctaattacctctattttcagggattctcctatctctgcctcccatccattataggcattctgggattatagatgtgccttaccacatccagtttggtgttccaaactccagttctcatgtttatgtggcaagtgctttgccattgaattatcttccgcagtctatgatactttcacttcttaataaactacacaaatgttaatggcctaaaataatatttaccatttctcatgattcttttcttttaaatcactcttaatctagaacagttcgtcttggttttgttagttttcttatagaaactgatataatggtactgtagccagtatcatcttctagatttatttgctttcatgtaacattggcttttttttggggggggggcttcaaggcagggtttctccgtatagccctggctgtcctggaactcactttgtagaccaagctggcctcgaactcagaaatccacctgcctctgcctcccaagtgctgggatcaaaggcgtgcgccaccacacccagctacattggctttttttaagagattggttttttttctcatagtatcatttaagtttttctatacttgtactttctaaattctcaaaatactgtaaatagcttgcttttaatttcttaacaactcaaatattgctgcaattcacctgttactacatgattgcatgctgttccactatagttatcactaatgacatgaaaatgttcatactctgagctgggtgtggtcgattttgcctttaatatctgcacagagagacatgtggctctttgtgagttcaaggctagcctggtctacatagcaaattttagggctacagagagagactctttctcaagaaaacaaccaactaaagttcatacttggaatcctatatgtgttggtgctatctcaatttcaccagctttctttcttgggactagcttattatgccctgtaaaggaatacttagacactatgtgaatatccagttctctagaatcagtgtttcataaagacttgcaatctggtgatatattttttaaagatttattttattattatatcgaagtacactgtagctgtcttcagacacaccagaagggggcatcagatctcattacagatagttgtgagccaccatgtggttgtgggatttgaactcaggacctttggaagagcagacagtgctcttaaccactgagccatctctccagcccgatatttttagttttataactaattccacatttgtaagctggcattcttgcgtgtatatgtgtgtatttgtctgtctgcctgagtatattcgtgtatatttggatgcacatgttttgtttaatggtttatcttctgtctgactattcaaaacatgcttaccttttaaaaagtacattatagagccatttgagatgactcaacaggtagaggtacgtaccatgcctaacagcttgagtttgatctccaggacccacttattagaagtaaagaactgactcctacaagttttcttgtaaccttcatagttatgtcatggtgacatgcacagtgtgagtgtggatgtcagaggatttcagtataaatgaggagatagctcagtaaagtgcttatttgtgcaaatatgagaaccagagttcaacaaccagcacccacttaaattataaaacaaaaacaaaaccaactagcattgatgatggatacttgttatcctagtgctggggaggcacttgcccattcataatggcctatgtctgtcattgctctatcatgtgggaggcaagatctcttgttctttgctgctgcatacccctagactacttggcccattgtcttctagtgctactcttgtctctgcctcctagcttactctaggagtaccagaatcacagacaaaagctactgcatctggctttatatgggttctgagaatttgagtttggatcttcatacttgcaaagcagatgctttacacactgagccatttcccaagcacccttgttttttaaatgttattctatgattatcactgaggtgggtatatgtgtggaggtcaaaggataactttatggaattggttctctcctttcacctttatgtggattctagagaatgaactcaaatcatcaaactttgtttggtttttaatgtatatggggctggtgattgagccctggtcctcatgcttgcacagaaagcactttaccaagctgtcttctcagccctagctgagattcgtttgtaaagaaaagctttcttttttcacttgaatatttgttgctcctaaaagatgcttattgaaaaaaataaacagatagtaatatttttaattcagtactgttaaggtgctattaaaagttatgccaagaacttcaagaattcattgtttggtatctatagaataataatcttcaataggtagtatgtgttacatatcaagtcatttacaccaattataaaatctgagaaagaagagataggtgggatcagggaggacccagatattttatatatgttattatatagcatacttttgagggataggcatgttttaaatatgtaaaagtaaaatatatctgtcagatgatgagtctgagtatggagggcagggtaatgcaatatcatactctggaggtgcaataaggaagtcaattgtctgaagaagcagaaagtaagggtgtttagcctgttttctgcagctgtaatggaatattacaactgactaaattctaaataaaagactatttttcttatggttctagaagctggaagtctaagagcatgatgctggcatggtatagtccttcgtgttaaattgtcccataagtacaagacgtcatatagtaaaagagtaagggggctggtgagatggctcagtgggtaagagcacccgactgctcttctgaaggtcaggagttcaaatcccagcaaccacatggtggctcacaaccatccgtaacgagttctgactccctcttctggagtgtctgaggacagctacagtgtacttacatataataaataaataaatcttaaaaaaaaaaagaaaggaagtcttccagtgtcaccatcagtaagtaaaaaaaaaaaaaaaaagtaaaagagtaggaggaaaaaagagagttgaaatacaccccttttaatacctaacctacacctacaataatagctttatactattcaggaaaacagcgctatcatgacctaattgtgcctcttaaaggtctcccatctaatactgttgaaaagatcatttaagtttccacaagaattttggagggagtgtttataccatagcagtaggtgaggaaacaagtttggaaaagtaggtaagtcaggaacaacaaggacataaaagcacataaacaacattaaatgccagttcaaggaggttaatttgtattcatgtaagccttggtcattaaataggactctgtgaaaagctagaagcaggaagaacaatataactacctttggaatagtcagaagttgaagaatataattggcaaatagattagcatcctgtttcccttgcagcccgtgtgactccaaccctacccaagcaggaccgtcctgttcgtgaggggaccagagttgcctccattgagacaggcttggctgcagcagctgcaaagcttgcccagcaggtaagagttgacacccagctggtggccctgctactgatgacttagagcctcaaaattcagacctgtagggtggtaggatcctgctattatggataatctttggtctttgtctttggcagtattccagcccctcctatatcctttacatcctagctttgtggcaagctacttccatgggttacctagttgacatgaattaggatgaaaaaagagatcagagaagtgtccttgttgatgtcacttgccccccctaactatatgtaattcccacagatgggagtgggtggggggagagtcagttttctttccaggcgtggtccctagtaggtcacccatgccgcaatggaggccccatgcccatgtataatagacaacagtaatttgacttggtgagttactttaaaaacaaagaatatatgaaattgggagggaaacatgattggggagaatctttaaggtgttgcaggtaggggaggtaggcatgaatatgatcaatatatatttcatgtatgtataaaattctcaaatatgtagaaaaaaaaatggaaaaaatcttcagatagaaaaaactagatctgttatttgccttcagatttagtcctgaggaagtgactcagttgagtacacttaagttttgagtcactcaccagttttggaatttggccttttacaaagagctttttcttaaaccctttatcaaatattattaccttgatctctaacccctgcttctcaagagaacaaaattcaccatttttcatcctaaaaggtcaccttcactaaatcaattttacctcttagtattagtttacaatgtgctttaacatgtagtttgctcagaaaccctaggaatgtttggaggtaaagtgtttggttctttaacaatatcacatagctcctcatgccacatcctatagcttagagtactattgagcatctgccttatgtaggtgcccctatgtacagtgtctaatataatatttccaataatcttgttcaatagatgatattttcatcactttacaggtaaagaaaatgaggctcacttaaatgactagtccaggataagacagccagtaaaatggaggagacaagattcaaactcatatcctctaacttcaaatttcatgctacttgaggtttttttctttttctttttctctttctttttcttttctttttcttttcttttcttttttttttccgagatagggtttctctgtatagtcctggctctcctggaactcactctgtagaccaggctggcctcgaactcagaaatccacctgcctctgcctctcaagtgctaagattaaaggcggctactgccgggcactacttgagttttaaagtgaaataaatagttaaatgtttatatctttgagtaattatatcctatttaagtgaaatttaagaactgtttttcatatgatgttctgtagagctgtaacgtttctgaaaaatgtcttagaaacaattatttggagctaacagagatcaagcagaccaatcaagagatcaagtgacttttctttgactaaaacttcccctgccattcatcagtgccacataagatgtaacttttaaataaaggttttctgttgctgtaaacaaacagatgaaagtgtaaaaactactcttagtgctttctaaggagtaagtactatttgggttgatagaaatacttctaagaagaggctttaaagttgggggaggtattagatgctattttgtgtgtgcacgcgtgtggtaactaggaaggatttcaggaaaatattattccttgctagaggtcataaagccctctttgtttggtctcgagggactcctctctaatctgactaccctccaatgtctatcgtttatgccagccatacccactacggtgtttacgatttaccccaaattccaaatttattccaaattgccttatgcctttatttgcataaagccattccttttgcccattcacttcacctacaatcaccttatttctttgctcttcatctgtacttctctatagcattatcacatggtacttatgatcataaggatatgttacactctttagatgtattttaacttagtatcctcattttaataatgacacatgataaatcagtgttgaagtaaattgaatgagtgaatgaatgagatttttctggattggaaacttcatattagaagatgagtatagcagggacacgtggtgcacgtctttaatcccagcacttgggaggcagaggcaggtggatttctgagttcaaggccagcctggtctacagagtgagccaggacaaccagggctacacagagaaaccctgtcttgaaaaaccaaaaaaaaaaaaaaaacaaaagaaagaaaagaaaaggaagataatgagtataagtaaagttataaagtggattcttgccagtcactggtagctcaggcctttaatcccagcaaacaggaggcagaggtgaaggcaggcagtttatgccagcacccaccccccacactaaacaaacaaatgtataaaagtaacagattctgggacagctgcaactgcctttatataatttctctttttctcagttattttatgagctttgattaagattaagtaaagagtgtgtatatatgtcctcctaggaataacacgatataaagtaaggcttaatgacattttcaccttcaatctttatcaatatgggttgtctagccacaaagtagaatactattaaagtatgaatttggttgggagcttcctaacagctttttcaatagagaacttggcaaggtataagtgttctatcataaattaatccactcaccacttacatgcaaaagagattagcagcaaaggtagggaattttaatctagatatgaagacacaatttatggagttagactagagaacaggagaacagaattcattcttctgggttttatttgttgtttgtttgtttttgtttttgttttaagacaagggctctctgtgtagccctggctgtcctggaattctcccagtagatcagactggccttgaactcagagatccatctgcctctttctcccaagttctgtgactaaaggcatgcaacaccactgcctagccagaattcattaatattcatgagaaaagattcctgctaagactttggctgaacagagcagattctgaaaccagagtttgcatctcaacttgaaaatgtcattatatctgtaaccttaggaaaataacttaaggctggagagatggctcagcagttaagagcactagctgcgtttccagaggacccaggtataattctcagcacccacatgacatatcataactgtctgtaactctagttctaggggatctggcaccctcacatacacatacatacagggaaaatatcaatgctcatttttttaaaaaatggaaaataacaggtaagtataaagttttttatttttagaatgggaatataattattttttactatttatttatttatttatttatttatttatttatttatttatttattatgtatgcagcaggccagaagagggcaccagatgtgattataggtggttgtcagccacaccatgtggttgctgggaattgaaatcaggacctctgaaagagcagccagtgctcttaacctctgagctatctctccagcctgggaatataactattaattttcattcttaaaattattaaatgaataattcaggagcaatgcttgcatgtattactaataattctcattcctctgaaatttctctgatagccatagcctaacagatcttctgaaggcgagtctaggcttttgttcccaagagaaggctaaggaatatagtcatggagttggtgtgtgtgacatttcagaaagttgcatgctgtcagcacgtgctcagggctccaaatgcccattgtcaggtacctacaagatgctgggagaagtggcacaacttcatatttattctatacaaattgagatattaaattaaatgacttaaaaaattgtcgagtcttctgttcaaagaaaaaatttgcaaaatgattaaaaagctatcataagaaatggagaataataattagatactttattttataaccacattctttgatattttaaataaattttcagagaaatcttaaattaaaaaaaattagatactttgagttccttttacatgctatatattttaatgtcatttaagctttctaacaattctgaaaagcaggtattactttaccatttgcagacaagacagctgatattcagaaaggttagtaactttaactaaaatcatctaatttaggaaatagaagcctgggtttgaactcacatttaccatattccaaagcttacacgttactctcagttcattttgagaagatttgtaaggtgtctagatactagatctgactacttttctataaggatttgtgtttaaattacttattatccttgcacttttgttttgttatttataaaatgaagaggttccccccaacacacataggacttttataagaatatagtaaataatgtacttaagctgctggtgtacattagttattaggaatgcccatagttcaccagaaacaaagtcttcaaaatcatttacacttggcactttactattaagtggtaggtgatgaactatgggtgaatgatgtcaaagaaatcactgtagactttggaaggcctgtattgtgtgtccatacaaggtggacttagagagaatgggggaaaggggcaggatgcagaaacatgttgaccattgtcttcttactttctgggaaattttctttttctttttttactctttaatatctccaccgatttggcttatatttcaggagctacaaaaggcccaaaagaagaaatatatcaagaagaagcctttgctgaaggaggtagaacagccgcgccctcaagattccaatcccatcatgacaatgcctgcaccaactgtggctacaacaccccagcctgacacctcctcctcaccccagccacctcctgagcctaaacaagaggctctgtcaggaagtcttgctgaccatgagtacactgctcgtcccaatgcctttggcatggctcaggcaaatcgcagcaccacacccatggcccctggagtcttcctcacccagcggcgcccttcagttggttcccagagcagtcaggcaggacaaggtacatgacccaaatggagattaaaatgagagctcttaaaagctccctggtctaaatcttaagtgttctagtagttgagaataccaagaagccaaacttcaggtgcttggatattggccttccaatacctacagctcaatagtccatgaagaggcaattaactgaatttaaatagaagtaatactagatttaggtttgaaagattcctctggtggtcatagtggaatctggactagaagtaagtagtctatacatttcattcagaaaggactgagtaatgaagagatgataaatgtgaagagtagtaggatgtgagaagtgatttgatgtcgcaagacagaaagatgcatgagagagaaaattcaagcccttcttttcctcccattggccagagcccaatccatagtatatggatggatgtacttcaaggatactgagcttggtgtgatgtttagggtcgactagaataagggtttttaatgaaagaaggccctgagcatgacatcctcagggatatggaactatagtcactaacctactgatcaggataacatgaatggcatagaaatatattgacctccttaaaaaattttctaaggaaagtgattgaacccaaagtaagtaatggaaaacaaccagaaaactagaactatagtgactatgactgctgcagcaatcagagaaggagtagccaagcacatggcactgaatagaagtggttaaggagggttccttgcctgatatggtgtaaggatgaagagctttgttgagagagaaaaacaaagcatggaggtgtggtatggtgctaaagttgctcataaagcctctgtttattttgacccttccttacaggaaagcgtcctaaaaagggcctggccacagcaaagcagagactcggccgcatcctgaaaatccacagaaatggcaagttacttctgtgagacgagccccatcatgtcctactccttcatcccttcacccccattgccttcttcgttgtcaactcggggcactcctggatcctatgagccccggacaaggtgcattgtcctgctttcttgggactgaccaaaggcacggactatctccaactccctttcccacttcccctatgagtatcctaccttctttttccatatccataaatagcaggtaaatgggagacatttccaactgacaagaaccttttcctgctccacccacatatttcacttacaccttgtctttattcttttccactgctcctctatatggaaggaatgaggaggagcaacataaagggagtctgggcctgtcagtttcctcagccatggagtgagaagcccagtgctcaacattttctgcacctccagccctgtctctaagcctgcccacctccacccattcctaccccttcctcacaaccgatggatataccctaccttcattcttgttcctgatagaaggttgtggtctttatcttcttttacctctttttcatgacaaaatgaagagggtctttatgaccctattatgggacaactccagagctggcctagaaaagctgactttatctgtctttgggggagggggaggagattccttttacttttcgaggtgggaaaaaggacagatacccaagcctttgaccatgattgttgcttagcccaccagaggaaactacttttgtctgactgcaaatgaaacccctatgatgatcttcaggaatttgcctgtatttttgaggccctgtagaacattatccccatagctataactgggttcaagcaggtacaaactcacctcctagaaatctgaagtacctggcacattgagaactatggcccctgccaccccacaaagcacagcctggaccttctgaagagggtgtggtgagataaccctgaagggtcattatcaggaacttccatgtttctttccccatctaagcttagtctaaagaagatttcagtactaagatcttcacccctgggactttccacttccagaccacaggccaactattcaagcatagtacagataggctattgaagtctgaagttagaaacaatgcccatatgtgaagtagcagatattctgatccgcttttctctgctttcctttgtgattgtcactattttccagacaatgtccccacctccctcttgtcttgccttactggcaatctgggcttgatggagactgccccttctgaacaacccattttggcactgcccaagtgggagtgtcctctaccttccactcgtcctcatcccagcttgcctagtgcttctggggaatttaacagctatgatgcagaccacagggaatttgtgaggcctctgtgttatcttttatgtttgtggcttatctttcttttttctatagatgtatcacctccatccttgttgggatggggggatactttagcatatttgctttttctaccttggggacccccaggggccaagcagtcctcctttagtcacaccaaaggcaaaaggcctggctacctcccctttagcacgtgaggtccctattcccctcctttctactcagctttgcttatcttggagatttcaaggcagcagtagggaagtaaggggaaagcaggagaagctcctaaccctgtatgggcaacttcctgactaaagactgactgttgtcaccaaaaacaggtccctagccctttcacccactaaaactccctcttgatctttcaatggcagctaattgctagcaccctcaccccacccattccaggcctcttttccctctgtttctttgttagaaggttctgtggagc

SEQ ID NO: 322 - DNA, 112607 bp, mus musculus
acctcccgtgcccgagcctcgtaagatggcggcgggctcgtctctttcccagaacgccgccactctcaatatggtagctgtttaccatatctctccacccctctccgcctcaactgcctcgcgattttgaataaactttattgattgctttgaatctcctacaaccccccgagagtggcttctcccggcgacctctccggcggtctttctccagccgccgcaagcctgtctcgcgaagggggcagcgacaaagccacttgccagtgcgcccggcggccccgaccccgacccccagccccggctgagacctcggtctctagaaggctctgagggccagacggtgggagggctgaggtggacactgcccgaaagccccgtcagagcccgggcactgcgtgacgcggcatgtggtttctaggagaaggcaagtcagcttcacagtttggcagcggcaatcccagcattcagcgcgcgccgcctcgggccggaactgcccggccagcctgtgcttagcgcagagctgggttgccccggagcgagcccagcggcaggcgagtctctggggctgagctctgttccctgaggacttgccccctgcagcctcgggcatgaagagagctctgtagcgtttgggaccgtggacattttttatcaggtttggggcataaaaaaggttcctgtcagtgtgtgtgtggggaggcgtagagagctcctcgtaagttttgggggctgcaagcaagctgcgttctaatttaagacgagacgtctgtcaggtgaggggtccagccgaaccctcggcggtcggaggggattgcaaggcaatgcctgccatttggagctgtggaggggaaaacaaattcttcgcttagtttcgcggcggcgaggagattctagtgggtttcctggggcttcgaagagatccttttcagtgtcagggggggagatgagctccctgtcagctttggagtggaggacgaaattgcggtttatttcattttggagcagaatgagactccttactgctcgggagggaatgatactgagaatgacgaaaaggatcatttaaactctcccaacgcgatcccaggactgtgatttgagttgggtgcctagtcttgtttgtcttgttcccgaaggctttggggggtggggtgggggggcgtaattcggaataacctgcggagaccttcagggatttccgcatctctgcttcttcctattttggggggctagacagggtctctggtctctccctcagcttccctcttcccagcctcatcctttatgccgcggtttgcgtcataataaagggagctgagagtcctgggaagcaagagggcagtgaagagagggggttcagtgagggattaaataagcttcccgaaagctttcagatatttacatgaaacccggaaagaagttgtcactgacttcagggccaaagaaggtaggggtctgggggaggcgtttggaaggcagggcagagcagatagcagaacgttcttgctgttctttccaagtgaaagaaatcctgaagggtgggtggactttctccacttaactcctgcactctcaccagctgtgttgagtcctggctcggttactccctttttcagaactggaggttggtacccagggggtggggtgggggcggagacacggaacgatttggaaacccggggccggaggagtcacttggtaaagaagtgttgtttgtgtctagccatcgtctagagaaggcgcttgttgctgccttcagacccagtaaagcttcaaaactggcacggcgcaaaacgatccaaccccctgtgaagatggcctcggtgcctgtgtattgcctctgtcgactgccttatgatgtgacccgcttcatgatcgagtgtgacatgtgccaggactggtttcacggcaggtaagaagggcaggccaggctggtcagggagcattggccaggtgtgttgttttcacttgctctctcctcctctcagccctgttttctacctactgctcagaaactagcccctccgtcaatttactagacctaggtttttctatcgctccttgcccaacaactaggtcctagctgacagtggtctgtggtttctctctgtttccctatgtatatttattgtactttgtgtatgtacatgaatatacatatatatgtatatatatgcatacgtatttgattttctagctgcgttctagctacaaagaaattatcagttgtatggttgtgttttccctcgtatcctggctttgggggaggcagcactgcatttttgagatatctgagtttaagaacatggatttctttgtaacttactatcagtggccttggccaaagttgcttttgcttctgtgagcctcacttacaaatcaatacctctttcatagctgtaaagcagtttgcttgcattctataaatggatgcagaaccagaaaaatattttatttctgtgccgtctgcaggactgtctaactacattaaaattaaaagacgtagggtaaaacaacaggacaaatgcacctgtctgtcacccaggtttccagtgagattagtgtatataataaaaatcaaaatattatcctattactgagggaatttgtatactggagtttaataaaaaacagtattcgggaccattctcttactatataagttctagaatgttaagttgtcaatttttaaaggagctgttcctgttatactcaaaaacaaagtaagggtggggtcagtgggtctcatgttcaaggcctgcctgagccagttcaaggccagcatggcaacttagcacgattctgtctcaataataataataataataataataataataataataatgtaaagagcttgggatataattcagtggaaagctcttgcctcaaaatatcaaaaaaattaaaaaaaaattatttaatcttatagttgcacatatgtctgttacttcctagaggtagagataccttttctgtttctttttagtatttctagtgctaaatatgcagtagatatttagtacagttttgaataaataagcaagtcataatgaaaaaaacttatttcactatggcccttagtttggaagtgtgtatgatatctctttaaaagggcttttgctcacagtgtagaaatctgaaaacacaacaggaatgaatgtttcctaacttcttaccctgtgtcagactccataactgacattccataaattattttgtctgtacccaagtctgaaagttcaaatttttcttctacttgtgcgggtttctgtatccgggtgtgtacacatgtatggaagccagaggtcagcctcaggcttccaggcctcagtcctcaggaaccagccatcttgttggttttttttttttttttagctagggtctccccgtggcctggtactttataagtagcctaggcaggtgggccagatagccgcagggattttcccatttctctccctaccactgggattatatggacttgaatctttcttacatatgttctggagattgaactaaagtcctcatgtttgcctagtaaacactttactcactgagccttctccccagcctaaaagttacacttgtgggagagcacactcctgtgagtatgtatgtgtatatgcatccatgtgtgcacatacgcttgaggagctatcaggtagctttctttactgctctccaccttatctttcatgccaaacctggagcttggcttaggctagctggctagcaagctccagagatacatttgtctgtttgccctcattgctagtgttgcaagcatttatggccatgctcagttttatggtagttttggggatttgaactcaggccctcttactttcatagcaagctgagccatctccctagttcctgaaagttagattttaaagtgtgagtgtgggtgcgtggggggtggcacttgtgtgtacatagcatgttatgaatgtggagatcacaagacaacttggaggagtcaattttctccttgcaccatgtaagaccaggaataaactcaggttgtcaggcttggtgacaagtaccacctagtgaggtatttcatcggcccaacccagattttttttttttttttggttttttgaaacagggtttctctgtacaaccctggctgtcctggaactcactctgtagaccaggctaccaggctggcctcgaactcagaaatttccctgcctccgcctcccaagtgctgggaccaacccagatttttaaaagaattaattttttttaaatgggctttagggcataggcctgtaattacagttactttggagactgaggaaggggattgcaaagtcaaggctggcctatgcaaaaaaaaaaaaaagattttttttcttattatataggtgagacatgtccactatagaaaatacaaaaaaaaaagaataatagaaggaaataaaaaagtcatctatgggtctgttggatacaattcactgttaatttttttgctgctgctgtattaattcttgttctttgacttaaaacatatgtttttataggttgcgattatattataaatactattttgtgatctccctcagtccacacccagcattttaatgtgggtatttgccaggttgttagaaaaaatctacaagatttcttttctttttttttattagatattttcttaatatacacttcaaatgctatctcaaaagtcccccataccctcccccctgccctgttcccctacccacccactcccacttcttggccctggcattcccctgtactgaggcatataaagtttgcaataccaagggcctctcttccctgtgatgtccaactaggccatcttctgctacatatgcagctagagacacaagctctggggatactggttagttcataagttcatattgttattctacctatagagttgcagaccccttcagctccttgggtgctttctctagcttctccattgggggccctgtgttccatctagatgactgtgagcattcacttctatatttgccaggcactggcatagcctcacaagagacagctataacagggtcccttcagcaaaatcttgctggcatatgcaatagtgtctgggtttggtggctgattatgggatggatcaccgggtgggtagtctctggattgtccatccttttgtcttagctccaaactttgtaactcctttcatgggtattttgttccctattctaaggaggaatgaagtatccatccattagtcttccctcttcttgattttcttgtgttttgcaaattgtatcttgggtgttctatgtttctgggctaatatccactcatcagtgagtgcatatctaatgacttcttttgtgattgggttacctcactaaggatgatatcctccagatccatccatttgtccaagaatttcataaatccattgtttttaatagctgagtagtattccattgtgtaaatgtaccatattttctgtatccattcttctgttgaggggcatctgggctctttccagcttctggctaatataaataaggatgctatgaacatagtggagcatgtgtccttaccggttggggcatcttctggatatatgctcaggagaggtattgctggatcttccggtagtattatgtccagttttctgaggaacctccagactatcttccagagtggttgtacaagcttgcaatcccaccaggagtgttcctctttctccatatactcgccagcatctgctgtcacctgagtttttgatcttagccattctgactggtgtgaggtagaatctcagggttgttttgatttgcatttccctgatgattaaggacgttgaacattttttcaagtgcttctcagccattcggtattcctcaggtaaaaattctttgtttagctctgagcaccatttttttaatggggttatttgattttctggagtccaccttcttgagttctttatatatattggatattagtcccctatctgatttaggataggtaaagatcctttcccaatctgttggtggcctttttgtcttattgacagtgtcttttgccttgcagaaggtttgcaattttatgaggtcccatttgtcaattcttgatcttacagcacaagccattgctgttctgtttaggaatttttcccctgtgcccatatcttcgaggcttttccccactttctcctctattaatttcagtgtctctggtcttatgtggaggtctttgatccacttagacttgagctttgtacaaggagataagaatagatcaattcgcattcttctacatgataacaaccagttgtgccagcaccatttgttgaaaatgctgtcctttttccactggatggttttagctcccttgtcaaaggtcaactgaccataggtgtgtggattcatttctgggtcttgaattctattccattgatctacctgtctgtcattgtaccagtaccatgcagtttttatcacgattgctttgcagtacagcttaatgtcaggcatggtgattctaccagaggttcttttattgttgagaatagtctttgctatcctaggtattttatttttctagatgaatttgcaaattgccctttctatctcagtgaagaattgggttgaaattttgatggggattgcattgaatctgtagattgcttttggcaagatagccatttttacgaatgttgatcctgccaatccatgagcatgggagatctttccatcttctgagatcttcttcaatttctttcttcagagacttgaagcccttatcatacagatctttcactttcttagttaatcacaccaaggtgttttatattatttgtgactattgtaaagggtgttgtttccctagtttctttctcagtccattcatcctttgtgtagagaaaggccattgatttatttgagttaattttatatccagctattgcactgaagctgtttatcaggtttagtagttctctggtggaattttgggggtcacttatatataatatcatatcatctgcaaatagtgatattctgacttcttcctttccaacttgtatccccttgatatccttttgttatggaattgctcttgctagaacttgaagtaccatattgaatacttagggagaaagtgggcagccttgtctagtccctgattttagtgggattgcttcgagtttctctccatttactttgatgatggctactggtttgctgtagattgcttttattatgtttaggtatgggccttgaattcgtgatcttccaaaacttttatcatgaaggggtgttggattttgtcaaatgctttctccgaatctaatgagatgatcatgtgttttttgattttgagtttgtttatatagtggattacgttgatggatttccgtatattaaaccatccctgcatccctgggatgaagcctacttggtcaggatggatgattgttttgatgtgttcttggattcggttagcaagaattttattgagtatttttgcatcgatattcataagggaaattggtctgaagttctctttgttggatctttgtgtggtttaggtatcagagtaattgtggcttcatataatgaattggatagagtaccttctgtttctattttgtggaatagtttcagaagagttggaattaggtcttctttgcaggtctggtagaactctgcactaaacccatctggtcctgggttttttttggttgggagactattaatgactgcttctatttctttaggggaaatgggactgtttatatcgttaatctgatcctgatttagctttggtacctggtatctgtctaagaagttgtccatttcatccaggttttccactcttcttgagtatagccttttgtactaggatctgacaatttttggatttccttaggttctattgtaatgtctccttttttgtttttgattttgttagttaggatactgtcccttggccctctagttagtctggctaagggtttatctatcttgttgattttctcaaagaaccagctcctggtttggttgattctttgaatagttctttttgtttccacttggttgatttcagccctgaatttgattatttcctgttgtctactcatcttgggtgagtttgcttcctttagttctagagcttttaggtgtgctgtcaggctgctagtgtatgtgctctctagtttctttttggaggcactcagggctatgaatttttctcttaggactgccttcattgtgtcccataagtttgggtattttgtggcttcattttcattaaaaactaaaaagtctttgatttctttctttatttcttccttgaccaaggaatcattgagtagaatgttgttcaatttccacgtgaatgttggctttctattatttatgttgttattgaagatcagccttagtccctggtgatcagataggatgcataggataatttcaatatttttgtatctgttgagacctgttttgtgaccaattatatgttcaattttggaggaggtaccatgatgtgctgagaagaaggtatatcctttagttttaggataaaatgttctgtagatatcaattaaatccatttgtttcataacttctggtagtgtccatgtgtctctgtttagtttctgtttccagggtctgtccattggtgagagtggggtgttgaagtctcccactattattgtgtgaggtgcaatgtgtgctttgagatttactaaagtttctttaatgattgtggctgcccttgtaattggagcgtattcagaattgagagttcatcttggtagattttacctttgatgagtatgaagtgccctccttgtcttttttgataactttgtgttggaagtcaattttattcgatattagaatgactactccagcttgtttcttcggaccatttgctaggaaaatggttttccagcctttcactctgaggtagtgtctgtccttttctctgaagtgggtttcctgtaagcaaccaaatgttggatcctgtttgtgtagccagtccatgtttttttattggggaattgagtccattgattttaagagaaattaaagaaaagtaattgttgctgcctattatttttgttcttaaagttgggattctgttcttgcagctgtcttcttttagatttgttcaaggatcaatttcttgctttttctagggtgtagtttccatccttatgttggtggtttccctttattatcctttgaagggctggatttgtgcaaagatattgtgtgaatttgcttttatcatgaaatactttggtttccccatctatggtaattgagagttctgttgggtatagtagcctgggctggcatttgtgttctcttagggtctgcataacatctgtccaggatcttctggctttcatagtctctggtgagaagtctggtgtaattctaatagacctgcctttatatgtcacttgacctttttcccttactgcttttaatattctatctttatttagtgcatttgttgttctgattattacatgtcaggaggaatttcttttctggtccagtctatttggagttttataggcttcttgtatgttcatgggcatctctttctttaggtttgggaagtcttcttctataattttgttgaagatatttgttagccctttaagttgaaaatcttcattctcatctactccttttatctgtaggtttggtcttctcattgtgtcctggatttcctggatgttttgagttagaatctttttgcattttcactgtctttgattgttgtgcccatgttctctgtggaatcttctgcacctgagattctttcttcaatctcttgtattctgttgctgatgctcgaatctatggttccagatttctttcctagggtttctatctccagtgttgcctcactttggattttctttattgtgtctacttccctttttaggtctagtatggttttgttcatttccttcacctgtttggatgtgttttcctgtttttctataaggacttgcaactctttagcagtgttctcctgtatttctttaagtgagttattaaagtacttcttgatgtcctctaccagcatcatgagatatgattttaaatccgagtcttgcttttcgggtgtgttggggtatctaggactggctgaggtgggagtgctgggttctgatgatggtgagtggtcttggtttctgttagtaagattcttacgtttgcctttcgccatctgttaatctctggagttagttgttatagttgtctctggttagagattgttcctctcgtgattcttttagcctctatcagcagacctgggagactagctctcttctgagtctcagtggtcagagtattctctgcaggcaagccctcctcttgcagggaaggtacactgatatctggcatttggacctgcctccttgctgaagatgatggcctgaaacagggcctgtctcagaagctgtgttgcttctgtagtgtgcactctcacctttgcagactagtctctgagggttccgggacccaggatggctccctcacctgctccgcatagccctctcgggcagatacctctcctctggcagggaaggtgcccggatgtctggagcctgaaatgtggtctgtcccagaaactgtgttgcttctgcctttcccagaagctgtgttgcttctgtagtgtgcactctcacctgcacagactagtctctgagggacccgagacccaagatggctcccccatctgctctggtagagccctccttggccgacctacagcatgtttttgatatcttcttgtctatatgtttatcaccacttacttggtccttccctttatggttgtatacttacattatttgtactttcttacaatcaatgtgaggcggtaaaacctggggattctgggaaggtttttgtattctgatgtgattattggttaaaacaaaaagaaaaccacgactggtggacatgtttttgtacagtagatatttgacatttagaatgataaaactactgaaactttaagaattattaaacttacaaatgttttatgagtttatggatccgatatgtctttaataacatttctaaggtatattctgcttttgtttttacattctagcacaagtttcatgaaagcattcagttttaaattttcttctgcttctttctgtgggctgccagagaacaaggcacctagctgaaaaccagatccttagttagtggctggctgttcttgcttactcagtacacccctagcccaacatactcactgtactcttaagtttttactttaggtcaattggaaattacaaaatattgtggagttttcatgattgcttccaatagttaaccacgtagacccagtgtgtatatgttgtatgagtatgtatatgcttgtatgtatatgagtatgagcatatgtttgtgagcccaccaaggccagaggaggacattaattgttttgttgtatcactctgttttattctcttgagatgatttatcactgaaccctgagttaaactggtggctagcaagtcccagtgatcttcttgcctttgcccctcccaggactgggattactgctacactgactttttacccaggtgctaggatctgtgtactaaagtcctcgaacatgcaaagcactctttcaccaccgagtcatctctgcagcccaaatcctacagatttcatatccacaaatgcccaaagatgatagacttttgaatttcagttagggattatggtacataataagttgctacctggagtggttatagtaaggaaggccactatgatatttttgatgataagaatctggaactgtggaggttaagtgattttctgagtatgaatttgaatttcaaattaattgtttctagagtagtgttctcaaatttagaaaaaaaatgaataatttcattcctcttgtaaggcagtagtgttgtgctaaacactatgttttgtagaacagtgcactttaaactttagtgtgtatcaattatttgaaagacccatttaaaaaaaaacaagatagatcccaacctcagtttctgactcagtgtgtgtgtgtgtgtatacacatatacatatatgtatatctatgtatatgtggcgggggggggggactgcacatgaactacatagcaaacgtgcaggtcagagggtaacttttcaggagttagttctctgattctgccttcttgaagcaactcccttgtttctgctgcactattactccaggctagctaatctgtgaacttgtgggcagctctcttgttttcacctcccatctattttcacctcccctctcccttaggagtactggggtttacagatgtacaccactgcatctgacttttttatgcatgttccagggattaagtttgggttttaaatggtaagtgcttttacctgttgagccatatcagcagccagacctatatgtattttaataatactcaccccccattaccctctttcaccctctcaccccctcctgattcccttcctattcccaactcttttcttctacttttatgtcttttttttttttttgataactcattggatttaaggaggcctccttatcaggattacttactagcaacttagcagtggctgaaccactaaagatttgcttttatatctccagggaaggttggagctttgtgagcccctcccttttccaggacagaatgttagaagaacaatcttgtgcaaatctacaggtaatcaagagtttaacagccatgtcatgcccagaactctgtgttccaaactgctctcccaccgtcctcgggtttttacatttttctgtttcttccaagatgtttcatgagccttgaagggagtgctgtgttctatttatacacaggaaatcatttattctttgtcctgtggttatgagtttgcatttacaaccatttatactactagaaagagaagggcttctttcctgtttttgtttgtttgttttttattgttattgttggtttttggtgtttggtgtttttttgtttttcttttttgagacatttgagacagggtctcactatatagccttggctggcctggaactcattctgtagaccaggctgaccccagagacccgcctttgtttgcctcccaagcactgagattaaaggaatataccaacatgattagcaagagaaacttcttttactaagctgagagcagtaatattctataggcatgaacatggttatttagatggtaatttgatggtacattatgttcactgagcagaacaactgtagtagcttaatcacccgggcctgtgatctctttaactacaagcttttgacctgttttatggtaccagtttttctttgcatggaattccttgtttgttttgtttagaggaaaatatttctgtttaaattaagtttgttagtacgacacccccccccccccccgtttggctgaagaaaaccgacttttcttcctctgtagccactgactgccaatagtttctcagctaggggtagaacctcacctctatgctggagggttttttttaaagatttatttattttatatatgtgagtatactgtcactgtcttcagacactccagaagagggcattggatcccattacagatggttgtgaaccaccattctgggaatggaactcaagacctctggaagagcaatcagtgctcttaactgctgaggtgtctctctagcccatctgtactggagttttaaccggtttgatcttatgcaagttttgtgctgtgctaagaactctatttgttatgggtttttgagtgcaatgactccaacctgtccagaagacattatttcacagcagtctactcttaaagtttttctgccccttcttccacaatgcttcctgatccttaaggaaaagagtgtgatataaacttgtaattttttttccaagacggggtttctttgtagcctaggctgtcctggaactcactctacagaccaggctgtcctagaactcactctacagtccaacctggcctggcctcaagagattccccctacttctgcttctcaagtgtgccaccaaaggtgtgagccaccattgcccggctaatccctatcttacaatctcctaaccccccccgcccccttctcttaggttctctgagcctttcagggagagaggtgtgatatagatgtctcatttagagctgagcactccacagtgacttactctctgcattttgaccagttgtgagaaattgtattaaacatcatccactacataaagaaacttctctgatgaaggggcctatagatatttagaaatatttagaaggtagtataatgaagggaagatgaataatggaggtaaaggtttaagtggggagtagatatgagggtgaagcgggggaggtaaagggataaccagcactaaagatgtttgaaaaagccatataaataatagtttataagcttcctgttatatgtacatacatacacacagacaagcttaatttaatttacctcacataccaggataatgcctatctcagaagctgtagattatcaaaaagcccagtgccaggggtaaaatactccatatgggaaggtggtcatagaggtcactcccctccaaaaaaccaatacagagtattgttattgttcttagttattcactagaacttgttggtaagatcctgttgctgaagacaccatatactttgatcacaggatatggaaaactcaagcaggttctgacctggaagcattcttcctactaggtaactttcatagtatcagaaggtgtttttgtaggctgctgggaaagaaaaaccatcaacactcttacccagctgtgaatcctgtgagctacaggactggcctggcatgctcattggctcaatagtagcatgaatactatggaggtaaccagcagctttctaattggacttaaggcctgatccacaatgggaaactcatctatgttctgtaaacctgcccaagaacttgttgttaagcaagttataggctctgctaatataattttgctaaagggatataatatcaaaacgccttctgaattctttttttaaaaatctagttctgttccttctttcctcccacctccctctgcttcctcctctttctttattcttccctcctttctgtgtgtgagcttttgtgtatgtatgtgccatggtgttcatgtgggggtcaaaggtcaacttgttggcatcaattctctctacaatgtgggtccttggcatcaaactcattaggcttacagaacaagcacctttaatctgcttaatggctttaccaaccctcttttttttgtttctccctctttcaaaattaacttttatttatgactatttatggacaggcatgcatgcctgtttgtgtgtacctgtgtgtgtgtactgactgagtccttgtgcttgcctgtgtgtgtgaattcatacctatgtgtgtgtgtgtgtgtgtgtgcatgccagcatgggcataagtccctgtgtgtacattcgtgcctgcgtgtatgtgtgtgcatgtttgcatgtgtgcttgcatgtgtctccctgcatgtttgtgtgtatatagttttgtatatagtttttttctcccctgcagctcaatcccagacaataccaggcaagcattctgtcattgaattatccccagtctttatccctttccttttagtctacatttaaacatgaaatgagattttatttttaaattaagtatgtgtatgtgttgtatgtgtgtgttgctcgatttgtgggcagggggagggcttgcatgtggaagttagagaacacatttgtagagttgattctccttttacctttctacataaattccaggaactgaactcagggcttcaggctttgagggaatcatcttgccagcctctgttttagtttttgaaaggggtcttacatagctcaactgacttcaaacttggctatgtagctaaaagtgaccttgaactcctgatccacctgctaccaccccctaaacttggattatagacctgagataacatttttggttttattcagtactggggattgaacccaggactttgtgtatgctatgtaagcatggtaccaaaatgaacgatccttaatctttcctctgttctatatgcctctgtttatattttccctcctttctgagggttacttaaacctgttttataattccatattgcttttttctttagtatatttgagtgtggctctgtatacattttcactttttactacagtcacctggtatttgtatttttccagttcaagtgaggagtaaaaatttctctttaagttcttttaatgtgttctacatacattgagaactacatcagaatgtttggttctgtattttaacaggttctctagatgttcttgatatttagaaaatgagaaactttcaggccagtggtggctcacgcctttaatcccagcactcaggaagcagaggaaggtgaatttctgagttcaaggccagcttggtctgcagagcaagttctagaacactcaaggttacactgtctccaaaaaccaaaaaaagaaaaaaattcgaggaacatgagtcagttggtagattgcttggttagcattgatgaagctaaggttggatcctagcatcacataaacctgccatggttgtacagtctgtaattctaatactgaagactatggaagccaggaggattagaaattcatggtaatctttgctatatagtgagatgaggccagcctgggatacatgagaccctgtctctgaaaacaccctgagaaattcttgtcttgttagaaaatggtgacttaccagagtctgcgttgatgagaaacggttttattttgaacatatatcaatatgggacttgctgatagattggattgggattgtgaaagaaagaggtaaggagtgacttcattttgaggagttttagtataaatgggaatagagtaatgggacagtgactgagaagcttacaagatatgtagagaatggactgttttgtctgtaacatcaggtcattttggaatttagttcttttaaatggcaaactcatatgccaggtactgagcagagagcagaaacttctcgggtacatggagcttgtttagtttctttagcactactccaagtcctttgcctggaggcaatggagccagtgatgagaactatgggtacctttgcttctgtttttgtagattgtgttctatctgataaaggttgttgcaagaatcccaaaccaaaaatggatttggattttttctgagatttttttttaaatgaaggaaggtaaaatatactctttctttctttatttatgaatgaagatattggctttccaagttataggttggtgacaaggcctagctccctgagtattctcagagagcagaggctgagcatattggaagacagatagaatcttgagcaaaatttgtctggctgttctggctcctctgatctttgggtcccacttagttccacagccctggacgaagcaatcaagtgcctgattttacattcttgtagcatttggttctacttacggttacattttagctgcatacttggttagatattacgggctcatgaagaccaacatttttgtattatgcggctacttaaacttagttttgtaattgctagcaatttgcctaactattcagactcattttcttattgttatagatagcatttatcatgtattaagcacttgaatactttaagttcattgaatcctagcaacatctctaaaaggtggttactagtaatttttctgtttcacaacttatagaaactgggacacaaagaatttatataaacttcctatgctcacacagttatatatggaagaagtaaaattcaaaccagatagtttggctcctatatctttttattttttatttttttcgagacagggtttctctgtgtagccctggctgtcctggaactcactctgtagaccaggctggcctcgaactcagaaatccacctgcctctgcctcccaagtgctgggactaaaggcgtgcgccaccacacccggcctctttttatcttttttttttttaaagatttatttatttattatatgtaagtacactgtagctgtcttcagacactccagaagagggtgtcagatcttgttacagatggttgtgaaccaccatgtggttgctggcatttgaactccggacctttggaagagcagtcaggtgctcttacccactgagccatctcaccagccctctttttatcttttaacctctgtgttttagtgtctcaatgctgtacagagtgtctctggtttgttataaagattaaatattataatatatttaaagtccatagcttagttttcttttatgtaggcttttcttctcagttacttatatgtaggctttaaatttactcattcatttggcaattattgttctgttttacttactttgtagcacttaatgaaactgttctgccattgcctgtctctttccctctagaatgctcattctataggaatctacatacaattaatatttatttgtatactcatttacttagtaaatatttgttgagtgcctacactgagcccagcttaatttcagtgctccatgttatactaattctcttcaccaaggaagctaccctgagtaagacagcatttactactcttggtacttggtgataattgttgagacagtgcattaactttggcttatctgcctccctagtttaaggaattatctagcccattgcatgtttgctgaattagtatggatagtaaatgaaaaaagactgggagatggaagatctgaggacttttggtgaataccagaatttttgtgtgctggatgtagtcagcacaaatggcaagtgaataaacatttattgttggtcagcataggtagaggtgaaataggtagtatgcagcaggagtgtctgcagtacagaagaggagcaatagcaccatgggctagcaatatgaatccagctggttttactcctccccacctgcaaccaatgtaggccacaatataataatgaaccatacaaagtggtatagcccactgtggagtgtggtcttactcattctatcaaatagcctgatggttttacttttgtccatttttttgtggtgttagagatcaaacacttatggcctcattcatattagacaagtatttaatctctaaaccacatccccaggccttttttagattaagggtggcttcatgagcatgtgaatcctgttgtcacatggagccctacagttgaggtttaatgcaatgcttgttgttccaaaagtcttaatatattttaactttggatttttgtatgtggcatcagtggattgtgtgctgagaacttagatcctagagttctctggtcctacatcttctttcttgccttcctgaaaaggatcatggctaattgcctgagactctgtccttaagtggagatgtggaaaaattcagggtccagagcatgcatactgtactgagtgatttgcctttacccccaagagagcgtgacaggaaaaataaaaaactcatattgccaaggttaggtctataattataattactcaggaagctgaggcagaagaatcacaaggcagtttagtgagaccctatctcaagtaggatgtttgttttgaatcagggtctcattatgtagttacagctgttttggaactcatagaccaggctggccttgcactcacagaggtctacttgcctctgcctctcaagtgctagaattaaaggcatacactgctatacttgtattgagaccctatctcaaaaaaggagaaatagagctagagttttaactatgtgacagagccttgcatgtatggccctgggttcagtccctagccacaaaaacaaaacaaacaaaacccagaaaaaaaccagtagtaacaactgaacttcatgtgtattagttacttttgtattgctatgataagcaatacaaaatgcatgcctgaagcaacttgtagaaggattggtttattttgtgtttatagttccacagggataagagtccattacaatcatcataatgacagtggtggaggtggaggtggtgcatgtgcatggaagaaagcaccaggaatggcagtaggaacagcaacaagcagagaaacctcgtggcttttgaaaccttagagcccaccaccagtggcatactttctctagcatactttctctaagtctagccaagcagtgtaaccaagtgtgaaccaagtgttcagacacacaagaacatggatgatatctcattcaaattccacatcatggtgacctgaaagaccacagaaagtaaaaagctcctttttatgtttctgaagaaggggctcttgctttttatttatagtaagcatattcatttatataattgatgctgtgtgtgagggataaaagatgacaccagagatgcaaggcctttttaggccatgggcaattcattcttaaagaaaaattgggagtacatacataccatgcatgtccttttgggtctgaattacctcactcaggatgatattttctagttccatccatttgcctgcaaaactcaggatgtccttgttcttaatagctgtgtagtattccattgtgtaaatgaaccacattttctgtatccattcttctgtcgtggggcatctgggttatttccagcttctggctatcacaaataaggccactatgaacatgtgcccctgtggcatggttttgtggcattttttgggtatattcccaagagtggtattgggtgagggaaaaggactgaagctctgagggccagcagtaagaatggaaacaggcagccttgggagataggaggttggggggtacccttcagaatgcaccagagacttgggaagtaagaaactctcagaactcaaagagagggaccttagatgaaatgcccgacagtagagaaagggaacttatagagcccaccttcagcaggaagacaggacatcaaatgagggatggggttgcaatcccaaagtcacaactctgctccataatagttcctgtctgaatgaattacagggatggaaatggagaggagcctgaggaaaagaaggtccagtgacaggcccaaagtgggatccagctcagggggaggccccaaggcctgacactgttactgaggctatagagcactctcaaaaagggacctaacataactgtactctggaagacccaacaagcagctcaaagaatcagatgcagatatttgtacccaaccaatggacagaagcagctgacccctgttgttgaattagggaaggctgaaagaagctgaggagaagggtgatcctgtaggaagaccagcagtcttaattaatctggacccccaagatctctcaaacactggatcaccaaccaggcagcacacaccagctgatatgaggccatgaacacgcatacagtagaggactgctgtgtctgtgctcattcagagctgacgcacctaaccctcaagaggaagccccggggagtttagaggtcaggtgggctagggtggggtggggggtggggacatccacgtggaggcagggtggggaggaggtatgggatgtgaaacagtcgaagggtggacgggtgtgtgtgtggggggggggagttaaaatatggagtgtaaaaatgtaaataataaattaaaaaaagaaaaagaaaaaatagggagggactggagagatggttcagcaattaagagcacttgctgcttattttttcagaggagctgagttcaaatcccagcacccatgtcaggtattccaaaactacttgtaacttcagctccaataccctctttctgcttctaaggacaccctctaatacatgtacacacacaaaaaaatgaaaataagagcctttgaggggttttgggtatgagataatgagagattacatttttaaaaatgtaattaattgatgttatgtgtttttgtatgcctgagtatgtatctacaccatgtgtgtgctgcagcccaaggaggtcagaagaaggtgttggatctcctagaactggagtttctggatcctctgcttaattactgagccatttctctagcccacacttcaatttttagtgatcattttggtatggagaatcatttttcgtggagacaaagttgaggtttggagtctatttgagtgagtaggacaatacttctagttagagatcataatctatgttatggatgcagcagtaaggatgacagaggcacacaagtgagagctaaagaattaagatatagaactgataattttgagtttttttaccatgtttaaattgctacccattccaaaagggggccattttgagctatataaatgtagatagagatgtttggctgtgaactctcagaaaggggcagacaagaaggaatgaaaggaaaagaagagtgggtttttaaggtcagtatacatgtttacatagtattgtaaagaaagagaaagaaacagggtgagagattgaagataccatagaaagaagggacagataattgataaaataaaaaaatgtgatctgggtgccagcactggctttaggaggaaggaaagatagcatttccacttttaacaggaggaaagggtgggtgaaagaagaagagctgttattagaagtcaaattttttcttgtctgattatttcctttctgttttatttttcaagaaaggaagtaaatcatttgcatggagagaggggagagagaatgggatcaagtttactgtggattatggaaaggaaagagctgagtaggaaattatgggagaattatcagtcagtataatctccccccccccacctcttccacccaagtacctctctccctctgcctcctgtgattattttgttcccctttctaagtgggattgaagcatccatacttgggccttccttcttgtgtttgtttgttttgttttgttttttgaagtttttttttttggggggggggggagagtttccagactgggtttctctgtatagccctggctgtcctggaactcactctgtagattaggctggcctcaaactcagaaatccgcctgcctctgcctgccttccttcttgttaagaccatgtgaagctgatagaacacttaacacagtgctccttagactgtatgatgaagaacaaggacatatttttctttatttttggtctctaatggattaattattttataaaataaaaagaggatgactagtaaaacaatgtaatcaaaaagcaatataacaaacctcaatttttcattattagattcaatggctattaaaacatcctgccagttttttgagaagtaatactgtcgttttctgtacttactatagacctgtagacagatcagtagtagtctatggattagactagtggttttcagccttcctaataaatttcatacagttcttaatatgtggtggccctcaaccataaaattattttagttgctacttcataactgtaattttactactgttatgaattgtcatgtaaattaataaatgtcttatatgcaggatatctgatatggtcatgacccacaggttgagaataactggattacactttgagtagcactagtatggagaaaataatttccttgtacaccaactgtatttgtttaaacttgcaaagtaaggttctgttttatattgttttgtttttagactgggtttcatctagccaaagctgaccttaaactactgattcctctgctcctatctctgaaattttgagattacgggtttattagttacttttctgtcactgtaataaacaccatgaccaaagcaactaaaaacagaaagtattaaattgggcttatatatgtttcagagggttaggacccatgatgaaaaagagaaggcatgacaacagaaacaactgaaagctcacatcttgaaccttaagcaggagtagagaccacactagggttggtaggagtctgttgaaatctcaaagactgcgcccccacaccctgacacaaatcctccaaggtcatacctcatcctttccaaatagttccactaactggggactatgtatccaaatgtatgagcctatgagggccattctgattcaaaccaccacagcacacatgtaccaccatgcccggcaagtatttcttgaaggggaagctagagcagtttatgtatcatggtataggattgctgagggtgtgacacggaagttgagagaggagacaggcagtggctgtttttggtagaaaaggcatatctgtaagagttcaggagtgatgacagcacagtttcctttttgagcagtgtccaaatataggagggacatcagacataaaacacgtatgtcatggaaatgagtgcctcgggtccaaacaaaagatttatagattaggccaggtgacgcaggccagtaactttgggaccaggaagttaaggtaagtttgaagtgagattgtgctatatagtgagaccctatctcaacaagcaagcaagcaaacaaaaaacaaactttagggtagtgagaatgataatgtgaatatggcaaaaagtaatgttaactgtcatttgtcatttatgttgtgccagtctctgtgttcattgtgttaatgaactttatgcacattatctgctgacctctacaaagttgatgctaatgtcccaatttcttgatatgctacaggtttatagacatagagttattgttgcagagatgaaggtaagggagggactggatttcaggattgatgatcataatcttggctgaaactatttgagctctaccatatttttatataccttgttatatgtggttgataaaaggcttaaagcatttaaaccatagccagaaattattttaagggttcttgtcatctttcttggtgagggaagggcttaatatgtgaaattactttgtatatatacatacaaaattaaatctaaatgaagcttcaaaatgattacctatatttcttcattcataaatgttgttggctctaaatatttctggtggttttatttaataaaatatctcagcaaagttctaagtttgggttctagtattttgagtatgttaggcaaaataaaatattaaaataagacttatttttaaaaaatctttttgtattttgagattttttcgtatatatcccaggctggtctaatacttgagggtagcctgaaacacatgataatcctctttcctctacctctagaatgctggaattagaagtgtggattagaggactagaacatctggttctttttaccttttttgcttttttgagacagggtttctctgtgtaacagccctagctgacctggaacttgctctgtagaccaggctgccattgaactcacagagatctgcctgcctctgtctcccaagtgctgggattaaaggtttgcaccaccactgctcagtccctctttttaccttttaaatgtaactatttggaacattttaaatgaattatttggggggggggattggtgagatggcttagcaagtaagagcactgactgttcttccaaaggtcctgagttcaaatcccagcaaccacatggtggcttacaataatccataatgagatctgatgccctcttctggtgtgtctaaagacagctacagtgtacttacatatactaataaataaatctttgggccagagcaagtggggctagagtgagcagaggtcctgagttaaatttccagcaaccacatgatggctcacagccatctgtacagctacactgtactcatatacataaaataaataaatctttaaaaattactgggtttatatatttctgtttattcacatactgatgctctagtctctttcagctttgagtattctgactcctaatgaatttttgccttcattgttttataccagtagaattttgcattgatgaaaatgttttataatatgtacaataaccagcatgtggctggtgaaatgtaactggtgtgatagaggaactgcatttaaattttacttaactttattttttaatttatttttatgtgtatgagtgttttgtccacatgtctgtctgtctgtacaccaagtgcctggtgctagtagaggccagaagaaggaaccagatcccttggaattagagttagagaggattgtgggccactatttagtaatcaaactcaggtcctttgaaagagcaagcagccactgttcttaaacaccaagctatctatccagccttcagatgtacttaactttaattgatataaatgtaaatcgccatatactgtactcactgatatagaacttttttttttaaggtttgggctcatgtgatgatattttcttttttttaattgaatttcattttattttattagatattttctttatttacatttcaaatgctatccccaaagtcccccatactctcccctgccctgctctcccacccactcactcccacttcttggccctggcattcccctgtactgaggcagataaagtttgcacgaccaatgggcctctcttccctgtgatggccaactaggccatgttctgctacatatgcagctagagacacgagctctggggggtactggttagttcatattgttgttccacctatagggttgccgaccccttcagctccttgggtgctttctctatatagaacttttaaaaaataaaaatcttataaaccttggctatgtttttttctttttcagttgtgttggtgttgaggaggagaaggctgctgatattgatctttaccactgccctaactgtgaggtcttacatggaccttccattagtaagtagatcttataatttgtatcaggaagtaataaggcaagaaacaaagcaaaggtagctttggatagcctctgcctcatatgtgtcttccgtaggaaacagcagaagcccatgcacgtccaacagggcctggagctgttgccctaagagagcaaaaatgcatagccttatctctttcccattttagcacctacctagaggaagtacactcttctttaccaggagctttcctgagtataaaagagcatctttaactgtagatgcccctggggttttagattcttagctcctggccgttctaactcattaccacttgtctttttctggtttagtgaaaaaacgtcgtggatcttccaaaggacatgataatcacaaggggaagccactgaagactggaagctctatgtttatccgagaacttcggggcagaacttttgacaggtgaggaaatgttaagcattagagctatgggacgctggacatacttcctttcagctgttccactggctgtgccattatgtgcctccctcatgtctggatatcttctaggccctgcaaaatctccggggtgggaacttctgttttggtcagttcctaagtaacagtgaccagagtttcacttgatgtttagagtacattatgacctatttacagaaatctgcagtagctgggaagcagcttttgtcttagtcaacttataagcatctgaacaatgctagaatttggaggctttttttggtttctcctagtacaaagtaatggatttcattatgacatttccacgtatattattaaatatactttgattataattactcattctatgaccctttatttccttcccctttcctattccatattcatagcagctccccattaaatgtctgcaagagtttttaatggtcagcaaatttaattctctcattatagaggagaggaaactttaaaactaaaaatagagagctgtagtgtgttttttcaatcaaaaagatacttttttttttctttcaacttacctggatttagtaaaaatgaattgaacaaaaataatgagttagaaattaatgaataaagaagtatcatatggttttaaatccattggactgttttcaggtttcttgtacttcaagtattatttagattgattttctaggttattagtttaaaaaaattaaaggctgtcagtcccctctgtacctcagacccctcagattccttcttctacttacatcagctaattttttatattttttcaaaaatagtacttgtatccacatatatgtggttgtatatccctttttatttttgacacaaatggaagcattatgttttgtatattacctttatttttaaacctaaataatatgtcttggaaattggtctacaacagcatgcataggtggttcttcctttcaggatcatttattatttcattgaatggatacatattttatttgaccaatcctatagtgatggacatttaaattgattccagcaatttgctgttattaagaaaacttctattggccataccttttttcttcagtaatgagcattgaacctaggagtcacacatgctaggcaagtactctaccactgagccatatttgcagcctcagtgaatatctcttaagtttttgcatgtgtgacaagtatagatgtagatttaactgtgtaaaagtaaaattgttagatcaaaaaggatatgccttaggaatctgtaaatattgccagttgtttgcataaagcctgtacaacatcacagacattttgtcaaagctctgatgatttttatgattaaattttcaaaatttagtgaaatctttttattttattaccttaattatgtaagaggttgatttttgtatatttatgggtcatatttattgatagctttctcttttctaaagcatttcccatattttttactgagaaaatattttcatgtaacatattctgatcatgtttttccccttcagttcctcccagattgttcctatctacccaactctgcaccctttctttctctgtgtttagaaaacaaacgtacaaagcaaaaaagaaaccaacccacaagaatctctctctctctctctctctctctctctctctctcacacacacacacacacacacacacacacacacaaaacctaacaaagcaatatagaacaaaacgtctacaaaaatacctttgagtttattctgtgatggccatctacttttgggcatagagcctacccttaagtgtggttaataaattgggcagtggtggtacactcctttaatccttgcagcagcagaggatggtggatttctatgagtttaaggccagcctgatctacagatctcattccaggatagccagggttacatggaaaaaccctgtcttgaacaaataacaaaaaagtgtggttaatacttctccaatgagacttcattggagaaaactaacttattatattatatattattatattatcatatattatattatactattatattatgtatattataattatatattataacagctttccttgcagacaattttagcttttaattcagatcaatttatttattatcattttagtaaaaactgggtcttgtctcttacatgtttttcccctagtacctttatgactttcgtttttgcagtttaaattttgggccatccagaattatatagagtgaaacagatacagagcttattatgcttgtttcaatacaactaatttcccttttcttcatagtcttttttttcttttttggttctggaggttccaatcatggactcattgcaagctaagctaatgctctggcactgtgtatacctccatctatctaccactctcttgtctccattatgactaggagtagttgagggggtagagaataatatgatcaaaatatattgtatgaaaaaatttaaaaacaattcccatcttgtaagtacatgcattaagaaagtggttgtaaatactgttttttaaaagctcagtctttgctctcttcgccaagagaagattggatgttgctattttgggttagaacaaatgagtcaaaattgttagttatatctcttcttaggtaagctattgactaatttcctttgttgttcagaaaagaacatcctgttcaccatatcttccctacctctgtcagtgaccttgtctactgctttggaaacatcatgttttttcctggcatatgaagtttatgccattagttgtcaacccatataagactccctcagaagactatatcccttttgtgagaggccattaaggcctttagtgagcagaatctcaaggtcatgttttttttttctctatggcccacacagctcagatgaagtgattctgaagcccactggaagtcagctgactgtggaattcttggaagagaatagcttcagcgtgcctatccttgtcttgaagaaggatgggttggggatgacattaccctctccatcattcactgtgagggatgtggaacactatgttggtaagacaccacagactctcttaactgtgacattaactgttcctatcagaatttaaatcatgcttggcatggtggctcacgatacctttaatctcagcacccagagagcagaggcaatcagatctctgagtttgaggccagcctggtctacatagtgagttccaggatagtcagagccacatagagagaccctgtcttgaaaaacaaaacaaacaaaaagactagagtcatttctctaatccacctttttatatttgctttccagccatcttgagagtatgatgtgaaggccttgcctagctagagtcattctttggcaagacaagagacataatactactcttcttttcctttttagctttatttttttttaattcagctattttatgtacatgcatgctctgtcttcatgcacatcagaatggggaataagatcccattacagatggttgtgagatactatgtggttgctggaaattaaactcaaaacctctggaagagcactcaagtgctcttaaccactgagccacctctccagccctaggaacttgtgtgtgtgcgtgtgtgttgggggctaatgacagtatttatttgattcattttcttcttaataagactacataaaagtaggttgagccaatttttttattaattcgttttatttatttacagtctaaaagttgtcttccttcctggtctattactccctgagttcttcactcccttccccagcctctgacagggtgctctcccactcacctacccatcctctccttaccctcaccagcatccctccccactgaagcatcaagcttccacaggattaagcgcattctctcccactgaagcaggacaagacagtcctccagtacatatatactggtgctacatatatacatgtatgctccttgtttttttggcttagtctctgggaactctgaggagtctgggtcagttgacactgttgttcttcctatggggttgcaatcccctcaccttcttcagtccttcctccaactcctccattggagtccccgacatcagtccaatggttggcagtaagtatatgcatctgtcttagtcaggtgctagtagagcctcccagaggacagccatgccaggctcccatctacaagtacaacatggtctcattgagccattttcttttaacctgggaaattttagggatcatagtctctgatacctgttcttactatattttactggagcatcagtgaaggaggagactagaagagaagacataaagaagcagatccatggcagttagactatgtgagagtttctatcagatagctccatagcccccacccagatcttgagagagtgtgatagatttctactctctgccctgaacacatagtatctgaagatagaattcctgggtatatggccattctaggtgctggtgagggaacaagaagtttttgtccccgagagacataactcagtacagaactcgtgtctttatttcaggttctgacaaagagattgatgtgattgatgtggcccgccaggctgactgcaagatgaaactcggtgattttgtcaaatactattacagtgggaagagggaaaaagtcctcaatgtcattagtttggaattctccgataccaggtaggaggggaggtaacagaaaaagcctgacagggcatctaaaacttgtagatatacttgaatttatattttggtttgattccttcattctagcagttttgtttctcattttggagaagggagttggcttatactttaaagggcactgattcaattttataataactaagtcagtttcttcagtttctagcagagctagattatatagaatctattgtactaatctgtcctttgttctagggcatcttcctttgatcttttcctagtatttatatttttatttatgactgtcctaaatgaagaataagtcctcagtctttggaaatagattttaaaattgcaagtagtttttctaagggtaggttgcctacatttaaaagggaaaaattatatatttttttaaaagatttatttattttatgtatataagtacactgtagctgtcttcagacacaccagaagagggcatcagccaccatgtggttgctgggaattgaactcaggatctctggaagagcagtcagtgctcttaaccactgagccatctctccagtcctataatctttaaaatatcctatcagtacttacatattcaggactgtggtgaatattaagaaattctaacatatctttttcttttaggaaatttactaattgcttattggcattttaagcttcaaataattaataaaaagatttgcaagaagttgcaaaaactggacagcaaggtcctgtgtacttttcattttcccacagtggtgacatgattataatattaaaatccttgctgttgcttttaagattaaagaacctaaaggtatttaaaaaaactgtagtttctttaactatcgcttaatccagaaagcctgtgcgatagcttgcagacatgcagaaaaggggaaaaagaaaacgggaacagaaagaaaataaaaatgaggaaccaggttgcatatagataggtactgtacatatgaatgcgtaattctttgtttaagtagttggtggaagtagttagtggaaatagattgcagttttcattgactttcctgaaggtcaaaacaaagaggagtgcataatattaaaagatttgtggatttatgtgggataaaacagccagatgtatggaactgccctctaggaggttttctgtaattgtaagggcttttcataaagaagatattaaagtagggaaaggacagactgttacaaagtgctgaatgagtcgactggggaagcgaaataaataatgggcatgacaatttagtaataggaatggccacttactattggggaaggatttggggctaggatttaggactggatttggagctgagtggagtggagtgggactactgttaaacttttaggaataaatgttgtatatacctttgggttctgtggagaaaatgattttttaaaatttgttttatcttactgcagtattttattcaggcttaaaccttcaattttcagtcagctcacgcttcttttcaccttctttactaggctttcaaacctcgtggaaacacccaggattgttcgcaagctgtcatgggtggagaacttgtggccagaggaatgtgtctttgagagacccaatgtgcagaagtactgcctcatgagtgtgcgggatagctatacagattttcacattgactttggtgggacctcagtttggtaccatgtgcttaaggtaggaatgagtatgacacctggaggcagccagacccatctgcctcgcatattctatctaggcaatacttgacatgattaactctatcgtgttaattttgaagacagaattcctgggtataaggccattttaggtactggtgaggagacaagaagttttttcccctgagatacagaattcatttctttacttcaggttctgacagagatattaatgtgattgatgcggcacatgtgggtgtgcctctacaattttgatgcttaagcaaaaaagttgttgaaggtaggcatggtggcttttgcttataatttcaacacttgttgggttgtggcaggaggcttgacatgaataagaggtcagcctgagcttcatggtaagtttcagatcagcttcagtttagcttgagctaaagaatgagagactgtctcaaaaaaacccaaattaaaaaaaaaaaaaaaccacggagaggaaggcatgcagcaggccctaggttgcacccctagtactaaaactacttttttgaggtctagggacatagcttactggtgtagtgctttcttaacgtgtgcaaggtcctggcttctatctcaagtaccacagatgtagatttttttggatagcaataaattacttaagatattccctaccttctttaatgaaggaattctatttctcgcaatatatatgaaaatgtctatattaattgtagaaatttcttggtaacatgagttttctctccctcaaactttaatatatgtactgtagaattcatttactttctccaaagtaaccaaagtaaagtggctgtatttgttttttttttttctgagacatttgggagtatttccagacatagtgtctccttgtgtctaataattcattatttagttcttaacaacggtattttcttaagtaattacaggatagttatcaaaataaggtaattgataggatagctactatagtagctactctctataaaggctgccagttttttcaattgtatagtacatacagttgtgtcacgcatcatagttttctgtgtttaaatttttgatatattagctaagctatggagttatccttatgctaaggtgtggttctttttcactaagttgtctatcagatgattatccaagcaaaacataattaggaaataaaatattcttccagcagataatccatcatctaatgaaatataatcttctagaagaagtccttggatagttactgaatttttaaacttattaactttgattgcaggtatgagaaggaacactgtataactggcatttaaaagcagattcaattttcttctcatcagtaatatggccttaaattctagggctagtagtattgatcttacctatagatgccatttttcatttggtattacatctaaaataagagcaattggtatatatttctcctaacttaaatagatttaaatacccctttcaaatattttttgggaaatttggagaaaatctgagcagtttatttaaaaatgtttcttgatgggtttgagaaacagctctggcatgctgatatagatgtgggtggagactgggagagagatttgaccatttggagcacccttcctcgagaaggacttttcttgaaatctttagtatggtatctttttatttcagggtgagaagatcttctacctgatccgcccaacaaatgctaatctgactctctttgagtgctggagtagctcctccaatcagaacgagatgttctttggtgaccaagtggaaaagtgctacaagtgttctgtgaagcaaggacaaacactgtttattcctacaggtcattcctgggtccctctaggggggaggatgggaaaggcagaaagaagggagatagtggtactgtaccaaaccctgtccataatttattaatctcattatgtgacattttttttctcattagctaagaggttaaaactagacctcaagaaaatttgtatgttggccagtaggtagcatggttttgtgtggaggccgcagatgacagaacaagcaggaggaggctgatggagcattatatacggggttaatgttaactgggtataccaatagagaacaggactcagtcctatgattctagggatactaactcagaggctgatgttctagtctataacattgaatggccagaatggaaacattctttgttaatagttcatgcctgggacttacttatagaattcttaggtctcatgtggaatatgaatttgtgtgtattttgctaggcaaccattcttcctctgagctatgtcctgagctgagtatgtacattttgaaaaaaaataaccctgttgtcgcaatttggagagagttgatatctagaagctaattgaatcttttatgaacagtccaatttaaatgtttcttgattatttaatcaaaattaacattaaattttcttgaaatgtatagggtaatactcttattgaatatgggcataataaaacacacttggagtctcagatacttgaaaaactgaggcaggagaattatgttttcaaagctggcctgggcaagttagtgaaactctacttaaaaataaaacaaaataaatattttaaagatcttttgttttttccattacaaggtctcactacatagatcaggctggtgatcttaaactcagagatccacctgcctctgcctcccagctactgggattaaaggtgtgtgccactatgctcagcttaaaaataataaacagataaatggaattctcttgtgaaataacatggacctgaaaatttggggaggagtctatatttagcattaggtttccttaatctttgtaacactatttgcattatctagcccatgtttttaccaacaaagctatcttgccagtccatgtattccatattagatgagttgtggttgtctatgcttttcaaagaagtactatattgattcattcttttattccttatctcccttcctccctctccccacttttgttcattcttgatactagttacctgtgtcttctcttttatttctgtcagtcttctagaggcttatcagttttgtttgatgttttttctctttatgttttcaattttgatttttgattttatctttatttttccttctgttcatcctgggtttattttatactttttttcctagtctcgagatggattttagattattaatttcagactttctcttataatgtgagcatttagtgctataaatttccagcaccagtttagctcctagaaatatttttgttatcatttttattgtgttaagtgtgcctttgtagaaaatgagatagaatttatatgccacaaaatatacaagtttagcagttgttttagtgcacttttgccagggatcatcactttaaaaagaaacactttccccattaacagttactttttattctgctcttctcccagcctggaacaacaatttcttttaaacttcacttgtatgtagattttcctcttgagtattccacataaataatagttttgggatagactctcacatagtctaggctagccttgaactcaactagatgctgaagttggccttcaactattgatcttcctacctccatcttctgggtgggattacaaacgtgtaccatcttacttttctttttttctttagacagatttatgtgatcctggaatctgctatgtagcccaaccttgcctgaagcttgcagtattttgtcagcttcatgagtatatgattacaaatgtggcacctcactttactactttttttaatggcaaaataatttctttaccccctgcaatagggtctcatgtaatcaataatcagtgttgctgtgtagctaagggtaggtaaccttgaacttctcctcctgcctctatcttctaagtactgtggttataggcttgcactaccatgcctagttttttttttttatttttatgtactagagatcaaacataaagctttgttcatgctaagcaatccatctaccagctgagctataacttcagacactgcaaaatagtatttaatgtggttatgccacatattttcctcttttaaaaatgtttccttagcatatattatccataagagtgggtctctgtatgacacttctatacatgtatataatgtattttgtgtttgtcattccctgctgtccctctaccatacatgctaacgcccttgccatttctactttcatgtcttttgtgtgtgtgtgtgtgtgtgtgtgtgtgtgtgtgtgtgtgtgtgtgtgaaacccagtgagtttcactagagttgttaacaggagcatattagaaaccttgccaatggttctttcctttctaccatggaagaaaatctgtttttgtgagttttacatcatgtaccctagtcccattcatctccccgacccctcatatctgtccttcatccttgctaacttcccaccaaaatataatacacagaaacaacaaaaatcatggaaaatatctcatctcatcatggaagctgtagtatgtcacattgtgtcccacagtatatccctctgtctacacttctgtacttggaaatgttgcagtgagttattggtctggttcaagatctacaatattgggtccccatcaggactcctccaggttatcttgttgctcgttgttgtggagatccgtcagctttggatcagcaagactgtccctttcatacatcccaaccttttgaagatgatacagattttggggtggatgaattcagaaccctggatttgggactgagtggtagctgagctggtcagtttgccagagagtccaatcttgtgaatatcttacacaagtaatcacaactgctgtgagttcaagaataggtggaggcgcatcctcgtggacacagggggtggggagaaagtatgggatgtggaacaatcggagggtggactgggcagggggaggataaaatatggagtgtaaaataaataaatatatttttttttaaaaagaatataaaataaagcagccatgccatgccttgaaacactgttccatactctcctccacttcctgtagccacattgtttgatgtttgtttttattcaccaactgatagacattaagtttttcctttttcctccctccctccctccctccctccctccctcccttccttccacctttctctttctttttttaaatactggggattgaatgcaaagccttgtgaatgctaattgctccatcactgagctagttccatagcccctattcagtattttattcaaaaaatcttcttgagacaaggtctcataaagttgctcaggttggcaccgagcccactgtgtagagtaatcaaacctcagcttcctgagtagcagaggttatagtatgtgccagtcaatctagcttggaatcatttttggctattaggaataatgcttctatgagtattcatgtaaaactaattttgccaacataatgagttgaccattcttaattaaaaatcgggaatccagccaggctgtagtggcacacgcccttaatctttgtacttgggagccataggccagcctggtctaaagagctagttctgggatagccagggctacacaaagaaatcatatctcaagaaagaaaatcaaacaaacagcccagaaacaaatatctggaacccagcagtatctttttttttttttaagtattgaaaaaagtctgagccccctccccagaatcatgttttattgaatttattttctgtgcttagtatttgtacatagtcttgtgtgtgtgtgtgtgtgtgtgtgtgtgtgtgtgtatgtgtatacttgtgtatcggtgtatatgcatatcagagttcagaaatttaattcaatgtcttctgtagttattctttatttttttaaatgtatttgtaattttagttttttaatccttttttctttttttaattagatattttcttcatttatatttcaaatgttatccccaagtccccctatacccccctgccctgctccccaaccactcactcctacttcctggccctggcattcccctgtactggggcatatggtcttcacaagaccaagggcctctcctcccattgatgcccgactaggctatcttctgctacatatgcaactagagacacagctctggtgggtactggttagttcatattgttgttcctcctatagggttgcagacccctttcattccttgggtactttctctagctcctccattgggggccctgtgttccatccaatagatgactgtgagcatccacttctgtatttgccaggcactggcatagccgcacaagagagatctatgtcagggttctgtcagcaaaatctttctggcatatgcaatagtgtctgggtttggtggttgtatatgggatggatccccgggtggggcagtctctggatggtccttcctgtttgttttttttttttaatgagtattttacttacatgtaagaatgtgcaagcacttgtttcccctggagggccaaagatggcaattgaattccctggaactggagttacagatagttgtgagttgccaagtgggttctgggaattgaggcctggtcttctggaagagcagccattgctcttaatcttcaagccatctctagccagtcatctttttttttttttgagacataatttctcactaaactagagtgatgtaacaagctctttgagtcctcatttctccaagctctgcagtgcccaagttacaaagatgtgctgccatgcttagatttttacatgggtacttgagatctgaatttaggtccttatgcttgcatggcaaatactttatcgactgagccttctccttagctctgaaatcctttgagagccaaagcaactgtgtaaatagaaaatttcacatcatctaactaatgtgatgagatcatgctcataaatgtaaaagtaacttttattcacccaatgtaaacctcatcttggaggcttacttcctctgtctgctaaccaaggcctactcctggaagattctagcctcaatacaatgttatcagcctctgagatttagtgctaaataagatgtctcctttctagctctttctgaattctggctggctagttcaactcagctgttttggcacagaactcttcaagctgactgattcaatctggcttctcttggcctttcctgaatggatctgcttggtctcttactaactgtggcagtctgtccttaatctcctggatccttctcattctctggctagttctatcttcacctgtgtctaggtagttctttgtctgcatcctatctctgtaaaactgtctccttcctctctgcactgccccttaagcagctctcctgtcctctctactcatgagagttgtgcatattctgttctgtcaaatctttctcactcagacatcagttttaaacatagctgcttccttctacaaactaactttactttcattgtttgggattaaaggtgtggcccaaaagcatgtctgtattccagccagaggaattaaaggtgtgtgctaaggttgagccacaccacaactagccacagttttttttttttaataaataacacaatctcagggtataataatcttgaggttcacagtgtgatcaaataccctgcaacacattaagtgcattaaatatgtaaattttacttcaggctgtttgtataaagtacattcaggtcataaacgagtatttcattcccagaataactgtttttgtcctcaagatatatgtctgtttatagatattacaaaattttaaatatgtctcaagtctgaaacatttctcatttgaggtattttatgcaagggatattcggcttctattttcagttttcttgtgttctgtttggtagaggattgcctctatcatgtggtaactccatagattgcctttttgaggaattgtcaagctattatcaaagtagataatgtgcactattttacattccaggtagcaaagtataagggttccaacttgttcatatcttctcaaatacttatcatttctgtctttatgatcatagcaatcctagtgtgagtaaaatagcaatttgttcatatcttctcaaatacttgccatttctgtctttatgatcatagcaaccctagtgtgagtaaaatataacaccaaggttctactttgtgtttccctaatgactattaatgttgaccatcttgcaaaaataattcttgtaatttatagatctttgctttttattttttgtgaaatcctttacctattcttaaatagtaataatagtataactgtttatagttttaattaaatcttttttaattattaaatcacacagtgcacatcacacaatgaccatacatgaattatatttttgtacctttatcagatatattgttcaaaaacatttttcttattcttgagtttatcttttgacattattcttttctttctatcctttttgaatttttaatttttttcttttttaacaggagttctctatgttgccaggctgtcctgaaactcgctctgtagaccaggctagctttgaactcacagagatctgcctgcctttgcttcctgagtgctgggattaaaggcatatgccaccaccacctggcttgacattatcttttaatacattaaattgattcattgacaatttcacacatacacacatatgcatactttattcatgtcccccattattttttcttatctcactttccctgctgttcaatctcttcttcccaacaaatatccctcctacttgaacatcttttttttttttttttttattcaagggttgcagctttaggaaggttgagaaccactgctctaatgggtttcctgcttctgtttttttttatttattattagatattttctttatatacatttcaaatgctatcctgaaagttccctataccctccctccgccctgctcccctacccacccactcccacttcatggccctggcattcccctgtactggggcatataaagtttgcaatatcaaggggcctctctttccaatgatggccaactaggccatcttctgctacaaatgcagctagagacacgagctctgggggtctttgtgtgctccactgcgtttattttccagtgacagtgacttcctctctcataggagctattaaattaactgcctatagctcccagaaagagttgaatctttttacattctttgatagtctcataaaatatgaatgttattctgtccagtttatctgtttttctttgttggctttctttccttttttcctttgtctcactcagtctgtgctcagtctatttctatatctccaaggcctcaaacttgtgatcttaatgccttaaatcttttttgttgttgttttgtttttttgttgcttgttttttgagacagggtttctctgtatatccctggctgtcctggaactcactctgtagaccaggctggcctccaactcagaaatccacctgcctctgcctcccaagtgctgggattaaaggcatgcgccaccactgctcggctttcagtcttttgattgatatgattatatctacaggtattgggaattcaaggaaataagtatttataagtattttattggtttttttgacacattgcattactcagactgtgctgtcttaccatgtagttcagctagccttaaacctatcatcttcctgccttagctttctgagtgctgagattataggtatgtgtcactgttttcagtttagttttggttattatatttagatattttattaaaattgagttaatttttatatacaggttgaggcaagagtctagttttattctttggcatgtagacatctgcttcttccagagaatcctgaaaactttgctcattgaattttcttgatatttcctctctgtcactgttactggttgatttatagttcaagttgtagtttagtgggggagtattatctagtatgtccaagatcctgggcttgctcctcagtattgcaaaaccaaatatcaaatgtaaaaacaaaccatgaaaagtcagctgagcatatatgggtttatttttggatcttatatcttccattgatttatatgtctctccttatgataatgtgtacttttttgattactatatacttatagtaagttttgaagttgcgatttgtcagttttctaactttgtatatctttttcaaggttggtttgttatgatcccgtgaatttttcatgtgaattattaggttcagaatttgctttgtttttttagtggttctagttgtttatttgctctagttttgttttgatcttagtagttgctacattgtgtgtgtgtgtaacatcacagattattggtgatactattttatcagtttgaaaggttttaggtgtacctagaggtataaaaaacagtttggaatactaaccagtatgagagataaaggagggtcatgaatcttctggatagatgaatggagaagggagatgaatatggaaaggatttaagaaaacaatgttgcaaaattagaggcaaggggagggaataattgtgttttagtagtgtgcattttagagtagttctagcaaaagagtgatgttcttttagagaagagagggtaaagcaacagaaagataattcgagtagggagtgatgcattaacttcataagttgattctgttcatgttactagaatgatagagtaggctatgctggttattgccacagtaaaaaaaatattttaaatcattggtaagctatttttaaggagtgaaggttattcttaccctcttgctcttaccctagccctcctgctcccccctcccccactttcaacgtggccatggccagcctctacttccctactctctccctctttctgcctttctacaataaatgcctttaaaacaatacatacatacatacatacatacatacatacatacatacatacatacgtacgtacatacatacggagtgaaggttaaactgaccaggcagtgaggtgtccaatgaagaaggccttctgctagctgtgatttttgccttctttgtactacaggatggatacatgctgtgttaacacccgtggactgcttagcattcggagggaacttcttacacagtcttaacattgaaatgcaactcaagtgagttctcacattgtctgttcttgtgtgctatagtccttgtgtaagtcccttgagtaaagaatgcaatatagtatgatgaagacaacaagaaaggaaagtatcttgggcattttggttctttgctttttaaagacagggtttctctgtgtagccctggctgtcctagaactcaccctatagactaggctgacctcaaactcagagatctgactgcctctggatcccaagttctgggattaaaagtgtgcaacaccactgctgctggacagtatcttggttcttaatgacaatttgacaaggttaacgctctttcttcacttggttgttatacctttgggcaggtacataatctttgatttcaaagtttctttgtatatagggctttacagggtcactatattaaatacagtggatacatagcactgagaatagcacttggtacatagtaggtgctcagtaaatagattctttttatagtcattatgtttccttacagggcttatgaaattgagaagaggctgagcacagcagaccttttcaagtttcccaacttcgagaccatctgttggtatgtgggaaaacatattctggacatctttcgaggtatggttttccttatcagctatcacttttgctaagagaaaggaggaagaagagggattgtagaaattgggaagaggagaaatgggaggtgaaagcttgctgctactgctgccttgctgtgtatattaaatcattaatatcttaaatatatactataaaatgtcccaataaccaagatataaaactaggctaaaggtccatgaacgctacttagaaagagagacagagacagagacacgcacagagagagacagaagaagactagacatcaaagtagaaggggcctatgagaagcaagagggagatttaacagaagtgtccaaccctgtgggataaaagatgcatacagctgagtgtggccaaggacaacagaaaatgggtccagcatgaaattgtaaaccgacttaaaatgttttgaagtgtttttgcagtttgttttggtaactcagttgcatggttatttagtgtgaactttgaagataaaacattgggttgcaaagtcagaaaattggacatacttggtgagggatgggcagaacaaaagggtaatgcaatatatataatatggaagtagaaggtgagactctggggtaagaaaggggaaagacgagggcagtgagttaagtatgaataaaggacactgatatagttgttcaaactttgtatttttttatattaaataaaaaagtaaagtaatcatagctattataccataatgcttactttctccaccaaaatcatccataatttctggaaaccactaatccctataattttgtcatttgaagaataatatataaatggaattatatcccatgactcatgagtatcccggatatgcctccctcagggataaaacccagtcttgatatcctggcatcactgtggtcccgggtatctaccctggtagaaaccagcttgctggttttcatctttcttagtcttgtctgaaataaagtgagtcccttgcttggacctgataattgattcttcaaggtgactaggccagaaggaatcagtattgcagttacaaaggacctcatagcctagtgagtacagtttcctactcaatacttcaagcccttactctgccactttgacagactgtcatgtaagtgttaaaacatggaataactaatgactcatttacctattgtgaccagcttagtacagtagaaaattctttataaagcataaaattggttgttaataacctcctcatgaagtaaagcagaacatagacaattttgagacctaaaaggctgaataatttaatagaaggaacacaggccttatattcaaatggatacagatatatgttttgacacatcaagattcctcttagacctttagtttcctgaactataaagtgaactttgcttacaatgtagatatcagagttaaatgacagctgcctagtgggtagtaaattattaagttttcagtaagtgaatactattaatataacagatctaagggtgtgcccagaaccctcagcattgtctttggttgtctgacaaaggtaacaagtccttcattcctctgaatagatatattgacactctacctttttattcctgctttaggcttacgagaaaatagaagacaccctgcctcctacctggtccatggtggtaaagctctgaacttggcatttagagcttggacaaagaaagaagtaaatatacttatttatatacctacttagtagttcttccttcgataaaggttacggatagatgtttggggagtcataaaatcaaagaggcaaataggctcctgggttagagtggaaagctaggctaggagcctttatttctgattttaagaaataatacatatgcttattccttagaattaaaaatatatatggttgtaaagaaaatcttcacctgtaattttaactgagaggaattagcattaacatttggatgtatttccttttggtcttttatgtgtgcattatattttttccttttaagttatgtgtgtgggtgttttgctcaaatgtaagtgcacaacatgcatgcagtgcctggagagatcagaagagggtgtcagagtttctggaactggagttgcaggcggttatgagttattatgtgggtgttaggaattaaacctctctcctcttgaagaacagctagtactcttaactgctgagccaactccagccccttgtgtgtacttttgagggcgctccaggtaaaattggagccctgcatatgctttgcaccttgaatctctggaccccacatgtgaatttagaaacataattggtattgcattatttattcaattttgtatctcattagattggcttaattttcttgtgttacttaagttccccataaatactgaattgctacatgctattttttctcaggaatcacctggttatttgtttatagttgctttctatttgtttcttattggagggctgtcgttacagcaaatcatacagtaaatatccgtaagcatatgtctttgtttcttatctcttgtttattccttcaggatagattcctgaaaggtcaattactggagcaaagtatatggaaaaaaaagaaaggttcttgatgcctactgccaaaatgactttttagaaaatttccaatattcaactatctgagtatataacatctataaatgataattcttattatcgttcttaagctctctatgtactgatttggaaagatctccagaatttgtcaaatgaaggtacagaatcatctatagaagcaaccatatgtaaaaagggaagaagtaagaattgtgtttatatatgttcatattcgcctgaagacacaatttgcagggacatagaagctaatgaaaaatagttaccaatggaagaaggtagaatgatagggatttttttaacatatctttttaattatttaatttttgaaccatctaaatatatttatttccaaatgttcatttaaaaaattcaaccttaaatggaaaaataacattgaatttcttttcttttgactgaatactctgggtcatggggcctgccctaaggtgtggttaatataaccggtgagactacattggggaaaagtgatttctcctttgtcagcaggtatcaattgcagataacttatattggctaggggtaggagttcatgttgatttccacccctttgtgtgtttgtatgtgtgtgtgtttctgtgtttcttatttttgtttgttttaaagagagaaatagaacaagttgggtgtgtaggctctgggagggagggagatacatgatcaaaatatactatatgaaaattgttttcgaagacttaaaaaaatcaaagaaatgcaaaagtagaataaatattaagacagtctcaggtttcagattctctctagtttccttccttccgtataatcacctaaagggatagtttcagaccttgtagtggtttaacttatgcatcaatctcttcattttgtgttgccaacattcccctaatattgtaaaacttcatgttttgggatttcctttgttccctaatctcacaaacacctggcctttagcctgtagttctgttttttcatcttcctccatcctcgctaacttcagtgttattgctgatccttactatgaagtatacttcagactgactcttccaggaacaccaaaagaaagtgagtgtgtagttcgtaagcactcatatcctgagtcaatatggagccagaaacccaggaatagcatggccaaagggagctagaggagagcggagcgcctttaaagggggcacaagctcatggaagaagacttctttgaagtatagatgatttgcatgccctcctagcctagaagggcaggaaccatcaaagttacccaactttatttggataactaggggaggaatgggaagactctatcaagggccttccttattcattcatagagtcattcattcaaataattacatgttctgagaccattccacatattgggccagtccatttttatcagtttttcttttgtagtccatgctattagtgacttaagaaatagttgcttagcaaaagtttacaaaaatgttctccttggttatatagggcttatatttttaagttctatatttaagtctgtaatcctctttgttatttcaaaaaatgtattaaaagtttttggttttgtttgacctatggatatctggtatctaattggttccttatcagttattgaaaagattgtccttccttcattgcttgcccttggcatgtttgcaagaattcagttgtcttatgcttcttatttgacaggctttgccagaccacgaggatgagatcccagagacagtgcggactgtacagctcattaaagatctggctagggagatccgtctggttgaagtaagaagcatgggagaagggaaggcatttgggaagggctggagactcaaatggcaggtcagaactttgtagctgccataacgcctaggggaggagtgagaagactctagcaagggccttattcattcatttagtcattcattcaaataattatgtgttctgagtacatgccacacactgggataggaatgatatagtgcctgtccataaactcacagacatacttgacctctgtgaaagtgtttccttatctctaaaatgagattaatgatatctactcaaagttgttaagaggattaattaaggtaatgtgaattgaaaattgagtatagttcttggcatgcagttggcacttaataaattctaatgatagactatagtgatagttgtagttgttacttttaatactttgacttaatctctgaattctacaaaataacaaactcaagttgaagatgattacaaaggcatgtttcaacaggtggcatacaccacaaggcaggaggtatagtagtaagaaactcagagaagcctgggttctggttcctgctctttcacttgaaagcctttcagagtcccagtttcctgatccataagctgaggaataactttaccgagctttcaaatctttggtaaaattgagaggtaatatagagcccctcacacagtgcctggcagagtaagtactcaataaatgtgagtcattgttattaatagactttttagcaaagagaaaactcagtgtgggctggtaaagtagcagaggcaccagagaaaaattggacttgaggatgtttaagctgtcttagaagtctatttcgtgtctaagagatctgtgtatttgtcgttccctcccttccctactcgtctgtgaatgtctgtctttccctccctccctcttactttctctttccctccttcccttcccccctttcttccttcctttgtttctttctttcattgtatatgtatgtatgcatgtatgtgtatccatgttacagggtggtttgcttctagaatttgggcttctgtcttcactgcttacagcatgtttcactgtctacactgtagtctacagagtctacatcctacctcatttttctccatttcactcactaataccttttaggagtcagtcatatgactatatcatttccagttcttacataatccagttttatacaaacagaactttgggctggctaggaaaaaaaactcatgagatagaacatgacttgttcattgactttcaaacattttaaagcaatagaatactttttttttcaaataagatcttatatggaaaccagtttatataacaaatcaaagcatagctgctttgagtaggataaaggttagagacctagagctccccttgttcctctcatctgccttccacataccatccatccccaagatttctcccaggaagcgcaaagaaaccacagaacatcttttaaaaattacctttttagtcttggcttttaattatacagctgaacaaacaagctctagagcttgttccatcagataactttccctaggtcagaaagatagctggtagcaaaattacgactagaaactttcttcaaaacttctatagtccttatagtttcaaccacacagacaagtatttgattatttttttattttgtgtcagctaatcttggagtcttttccctccagttttgacagtaacgctgggctttttctttgctcgtcttctctttacttgtcaatggctgggtaaagaaatgccacccaataaatgtatgatggctcactgtacagaaaccaggggtgtgcatatgtggagcacatatataagccacttccttggcagtaccattagtgctgggaacagacctctgctcttagcatagagagaacacttgagtaagctctaaccccctcgtgtactaatactcttgtaggacatcttccaacagaacgttgggaagacgagcaatatctttgggctgcagaggatcttcccagctggctccatccccttaaccaagccagcccattccacttcagtatccatgtccaagctgtcactgccctccaaaaatggttcaaagaagaaaggcctgaagcccaaggatatcttcaagaaggcagagcgaaagggcaagcagagttcagccttggggcctgctggccagttgagctataatctcatggacccatacagtcatcaggcactgaagacaggcccttcccagaaagcaaaggtgggtgctggcccatgggttcagcccaaccctttcgggacccttgaaagagcagtatttcaaaaaaccaggctatcctgttccatctcttagggcccctggtgtttggctaccagttccactcatttaacaggcatttattgagtcattttctgtgctgggcactgtgataggtgctgtggatggaactcaagaggctgagaggctagaaaagaaggaagatagacataaaaacaaatgagtgaaatgcagtgtggatgccacccatgatcaaggatatatgtggggctatgaggcacagaaggcagttgattctatctagataaggcttaggagctctttgccaggtacatgacacttgagttgaatcttgatatactcaggtgggaatgagatttgagaaagttgtctgtcaggttagaatcttgaacaggtccttgtctccttcctcagggcttcaccttgtctaagtattgtgttgccctatctggatatctaataatggtgccctcttctctatttaggtaccatgtttcacaagctatgctatgttttccccaagccagctatatattctcaacctcccactcctataattgttggaggtggggggttggggacaggcatatcagaaggccttatgtcagagggttgacagatttgtagtaaaaccagagaaaactggccattttgatttatctgggaatctcagactggtgacaactgagcctcattcttctacagttcaacatgagtggtaccagcttgaatgattcagatgatgactcagcagacatggaccttgatggcagtgagaaccctctggccctgttgatggctaatggcaggtaagatgggtaaaagaagcgcagaaataactgagattaccagtgacgattaaaatatggacctgggagttggaacataggtgcggggagggcagtatttagggtaatatcaaaatgttaatagatatttactttgtttagaagtcatggtggatgggggagaggttgggagtctaactagtaattttgaaaatgatgttttataggttttagaattttagcaagttattatggtagaactactagtagaaatgttagtaagtgtacagattaggagcattagggttttgggttgagacatggctcagctgttaaaagcactttctgcttttacagagagccccagttttcagtactcacacatggtagctcacaatcatccataactctagttccagggaatcagatgccctcttctgatctccatgggcactaggctcatgtgtgatgcacatacatacatacatgcaggccaaatattcatctatataaaataaaaataaatctttaacaaaagaacatagggaattttagttaagttttattcactatatgtatagagggatgggggtcaagggcaatacaggggtgccacagcatagacaggatgatcagaggacaacttttggaaatccattctttctttctgataggggttcccagaatcaaactcactttggcaggttttgcatcgctacggcttttacctactgtgccatcttgctagcttaagaacatgcattttaaaatatgcttttataattaaatgcatagtaattcagtttatggattatattatacacagtattgtataaatgtgtgaggaaaaatattcagtgcatactgcatcattgtaatgatatgtgtctggaattaattcagatgtttgccagcacaggttaaataaattatagcatatccttaaaaaagagtccaagtattagagaatttaaaagaatggagcagtttaatatctgttagcacaaaaagttgcccaaagtaatgtctttttttcctattgagatgggtgtctcactatgttgctcaggttggtcttaaattcctgatctcaagtaatgctccaggctcccaaatagttgccacttatagacattccctgtttcaatagaagttgttttttttttaattcatgtcagtgattgaatttagggtttgtatatactattgaactacatacccagtcaaacccccacaccttttttttttttttaagttctacctatgtacctcagggtgacattgaattcacttatgtcggttaaggctatgttcatcttgaaatcatgatcctttatatcctgactgctgggattgtaggcatgttctactgccatttctggctcggtacatttatacgtgtgtgtgtttgtgtgtgtgtgtgtgtgtgttttaatagcataattcattttttttacttgttttgttttttcaagacagtgtttctttttgttttgtttgtttgtttgtttgattttttgagacagggtttctctgtatagctctggctgtcctggaactcactctgtagaccaggctgacctcaaactcagaaatccacctgcctctgcctcccaagtgctgggattaaaggcatgcgccaccaccgcctggccagtgtttctttttgtagctttgtctgtcctggaacttcctctgtagaccagtctggcctcaaactcacaaaaatctacttgcctaccaattgctgggattaaaggcatgcaacaccacacctggccttaagatttatttttattttgtgtatgttttttaccttaatgtatatatgtgcactaggttcatgcagtgcctaaagagaccagaagagggagtcatattccccagaactggagttatagacagctgtgagctgccaccatggtgccaggaattaaatctggaacctctagaagagcagccaattaatctcttaaccattgagccatctccagccgcaagatatgtatttcagtgaaacaaatcagattataaaataacatgcagttgtacctttacttttaaaaaggcatacattttagtgtgtgtgggggggtgaaaaacaatatatgtattttttatttatatttttactttttagaagatgcttaaatttcagtttatatggtttaaaattcaaaaagttcagtctatggtgatggctcagcggttaaaggcacttatcaccaatcctgatgagaccctgttcatctctctgaaagaagaaagccagctcctttgaggcagcctctggcttccatgtgtgtactgtgacataaatatacccttgccgtgaaataaataaatgttaaaaaaaaacccaatatgtggtagagcacgcagtgaaaaatcctgtttatctctttccttttattttctctatggacaaccattttttagtcagcatgtaaatagcagatttcattatgacatttccctttaaaatattttttatttaaattttttgatacaatatattttgatcatgtttttccctccccaaactcctcccagatcaccttcctacccattcaaaatcatgtatgtgtacatgcatactctctcttgcttgcttacatttttatttctaaaaatcaaaagctgaaaatcccgagaaacaaaaccaaggcaaaataacaacaacaataacagtagcagcagcagcaggataaaacaaaacagcttactaaaaaataacatggagtttgtttttgaccaactaataccttgcatgaggcctaccttggagtatggtttacattccattggagagaactgattttcattttgctagcaagtatcccttgggaccccttgaatctgtgcaagtattgtggatgcaaccccagtctctttgaattcatatgtgcatcagttctatgttatctggaaggaactattttcttggaatcatccattatcttaggctcttacattctgccttctttcctgcatagatccctgaggcttgagagtagggggtctgatgaagatactccatttagaaatgagtgttccagagtttcttactgtctttatttggtcagttgtgggtctctgtgttaattcttgtctactgaaagcttagcttctctcatgtgggtttaataaggcactgatctgtgggtatagcagtatgtcattagtcatgttttgctatgttcctttagcataagtaattatgatattttcatacacatataattttatttggtttatatttacttctccactaccatcctctgtcctccttaatccctgccattgatctgcttttcaccaaaaatattgccccttcttttatatatgatgtgtatgtgcatatgtataagtatataaatataaagctaattatagatttctacgtgaaaaatgtaatagtttgtcttttttccttattattctctctcattctacctcttctctagatcccttctttctagatatacatctatgtattcaagcaagtatgtgcatttattacatatattgtgcgtgttattccaaacctttgacaggacagtgcttatttttagaaagtaggataagggaaaagagaacaaacatttacttacataggattttctcagtgttgcatcaaggtgtcactcactctgtagttcacactggcctgctattttctatgtagctcaggctgacctagaacttgaggtaattcccctgacttagcctccatgatgtagaggttacaaatgagtaccaacataacctgatttaacaattattttaaaaaatacctttatattcagtagtgaaagtgtaaaatccaatgtgaagctccaaagcttcagaatggctattcttaactgtacatatgttcactgaaatgaatatggatctggttaatttgagtgtgtagacttttttgttagcaagttatttataattgtaagtaacatttttcaaaagaataaaggaaaggttgttaataaaataataatcttggtaatcagttagtcgtgcagtcctgagattgaatcccagttcgaatatatattgactatgtgacatggaaaattaatatttaatattttaaaaatatctctttatagacaaaatttactttaagatttggaggtgattaaaacagctagtgtgtttatcattcttataaggcatagtacatatagtgttatgtgtttctaataaatggtaacccttataaattcattgataaagatgaaaataaaagataatgtaattatggccagaggctaagtatgtcatggagagattattatgcatttagagaattggagggaaggaaaggcaacacagagttattatctggaattgtagaattcaagaatgaatgcaggtaatgtaggaatacaagaactcctagtctctttgtagaaaagcattctcttcagatcctaagggaaagtgtattaggtccacctgacaaggaactaagggaaaatgatagattccgagagcaccagaactgcccttgggacttgagaaccctgttgctaaagagtaatattgaagagaatgttgagctctgctggttttcagagcttctgagaggtctcctggggagtagacaattgtgagtcctaaatgatcaattataatgactagtaagatgttattagacgcgttctcacgaccggccaggaagaacaccacagaccagaatcttctgcggcaaagctttattcttacatcttcaggagccagggtgcaggaagcaagagagcaagaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacatctccccctatccttttaataagagcaaataggccacccatattaatgagagtggagatagaggtcaaatccccagtgtgtaggtaaaggagccatgtacaggattagctcttaggctcacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccatgcaactctctcgggctgctgaagcacactcactctatcccgtgcaatgagtctagcctcatgggatataagagctgagtggccagcgacctattgcctaagcatagatatatcatatatcagggggagctccatgttctagtcctgcaagcgcctgggcaataaccaccttgtctctcctagtttgggccttaagcttacagaccaatcaaagaagcaacactaatccacagcaaagtgtatctccaaataatattaatcccacccattttttaaagaaagaaaatgctgaggagatccaattgggtaatcctttggtcagcgacaggtccaagcacgtggagttgacctgaagtctcaattcccgaagggatctgttcaaattcagccatccaattctgtaacatatactgaaaaagactttttgacaaattagctgccctagtaaatttaacatactgaatggaagtaacacacaatcccggaaacttttgtttacaccccagctgagttatttgtcataatacatctagttgtatctggacaagatctatgagttgattaaccagcatgagacctctctgtatcttgacattagctgaggcctgttcatctatgactgtagtcactgaggctgacaaagtgttaatggtgtctgtcgtctggacctgtccagacagagccaaggctgtctgaatcaaggctaaacccagttcctagttagtgtaaaaaaaacaggagaatacttgagcattatacatcaccgtcattgggagtggaaatgtcgacattatcccccaacgctgctctctctttattattgacgccctggacatcaccaagacgagggacattagtattcccttggtcagtctggatttttcgggtgagtctttctggtacccaaaatgggttgtctttattctgtgggaaaacacagatagctcccctggatcttatcaaaataggatccgggccataccatttattatcaaggacatttttccatttaaccatctcattgggcctatctggctctgaacaatgacgttcagccgcagtatggccatgaacatcaatatttaaaaaattgagtgtaaagagtgccaaagacaccgacactcttggtgctcggggtacagtctcctcaaaagttcccctcttctgttttataagataggctttgagggtgcgatgcgcacgctcaacaataccctgtccttgagggttgtatggaagtccagtcaggtgggttacgtccatctgacggcagaactgttggaatttttgagacgtataagctggtccattatcagtcttaaggagtctgggtttcccccaagcactccatgcctcaagacaatgttgaatcacatgtgaggctttttctccggttaacggagaggcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagaactcacagcagctttgacattgagtaacaatgtcacgggcttcttttcttgtcaaggagaaacgactgcgtaatgtttcagccgtcacatgaaaattgttatgaaaatttcttgcagcctctaccggggatgatagggcagcagccaccactttagtggccttatctgccaaatcatttcccagagccatggggccaggtaggcctgaatgggctctaacatgagtaatataaacaggagatcttctagataacaaaactaattgtatctgctgaaaaatattggcaactctactggaaggcttaatcactccagccacttctaaaagatttactgcattaaccacataacaggaatctgacacaatattaaggggttctaaaaaggtttttaaaacttctaagaccactaaacattctaccacttgaggtgaattttcattatattgtttggataccactttaccattagccacataggcacctatgccagtttttgatccatcagtatataccacaatcccatttttaagtgggtttcttactgttatttgtggaaacacaacagattgattttgggcaaactgtaagattggatgttttggataatggttatctatttttcctgaaaaggaggtaactaaaactgcccaatcattagatgcggctgccaaggtttgaacctgtgcagcggtataaggtacaattaaaagatatggactttgcccaaagtgggtgattgctgcttttaggcctttaagggcaagctgtgcaattgcatcaggataccaatctattattttagctggggatacgtttggatggatccacaacaatggcccattctgccacaaaactgcagttggcaattgtgctgtcttaaagacacacaaactgaaaggctgcgaatcctcaatacgttgtaattgtgcattctgtaaggccttttccactttttgtaaggcctggttagcagctagagtaagagtcctaggggaggagatatgaggatctccttctaaaatactaaacaaaggccttaactcagcagaaggaatctttaaaaaaggtctgagccaattaatatctcccaacagcttttgaaaatcatttaaggtatggaggtgatctcttcttatctctaccttttggggcacaatcttatctggggacaccacagagcccaagaattgtcctgtatcagaaatttggaccttttctgtggctatctgtaaaccccactgacttaaagttttaagtagaaaaggatatgccttttgtagcatggtaaggtctttatggcacaggaggatgtcatccatgtaaaggagcaaaattaaagaggggaattgttccctcactggcaaaagagcttcttgtacataaagttgacacatagtaggactattggacattccctgtggtaagaccttccattgatacctcttatcaggttccatgtgattaatagaggggatggtaaaggcaaatctgggcctatcccttggacacaaaggtatagaaaagaaacaatctttaatatctataataattaaattccagccacgtggtaaggcggaaagtacagggagacccctctgtactgggccaaataagttcatttgctcattaatggctctgaggtcatggagcagtctccactttcctgactttttcttaattacaaaaattggagtattccaaggtgaggtagagggttcaatatggcctaattttaattgttcctttaccagttgaatcacagcttctagtttttcagaggataggtgccattgaggaacccacactgggtcccctgttttccatggtatgggtcgtgctgccccaatggccgctaaggaaaacccagaccctgtctgtcttggtttccattaggtgagatgggctctatccttccctgttcttgatgtcctaacccttttccttctttataacccatctttgccatgatattttttgctttagctgaataccctcccgatggggcattttcattggacaaaataaggcccaaatgctgcataatatcccttccccagaggttaaccgggagtgggagcacataaggtatgaatttcccttgctgtccttcagaggattcccacgtcaaggcaacggagcttatagtgggacatgattgatatcctaggccctgtaatgaatgagatgactctgtggtgggccatgctttgggccaccaatgtgtagagattatacttttatctgctccggtatcaaggatgccttcaaactcttttccgttgatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttagggcttgagcacaggacctgtatttcaggggaatgttgacaatccataactccagggtggactactaagccctgcaaggtgagtgaaccccggccgagaataaggcccatggttcccgggggcaaggatggtataggctccaccggcaccggctgaatactcatttgaggcattagtaggaagtcggaggcggcacgcaggtccacccttgtgggtcttcctgggtcgcctctctgactgcttcctgggtcctgacaaaccggttcccatatctttgagggccctgggaccgagggcccgatgacccgttttttggcacatcagttgattgactatcaggtgggggaaggactctgccctttatatccctcacagagcgacactggtcagctctatgataacccttgccacacttagagcaaagagtgagagtccctccctgtttatctggagctctgcaatctttcttaaaatgcccaggctttccgcaattaaaacatgtcctctgatcatttctgctcatggagcggttctgagattggaggatggcggccgctaagcctgcattggtgagaggtcccccaagctctcgacagaccctgagccagtcttgtaagcctttgttctttcttggggctatggccgctcggcactcctttgtggcttgctcatagattagctgttctatcagaggcgcagcttgctctgactctccaaaaatacgctctgctgcctctgtcattttggccacaaaatctgagaaggattcctgaggtccctggattatctttgttaactgaccagtggtttcacctgctcgggagagcgccttccaggccctaatagccgtggaagaaacttgggcataagctccccaatggtagtttgtctgatcagcagaataagctccctgacccgttaacaagtcaaaagtccaatctctctgctctggagtcaaagcagctgcgtttgctcgggcctgcgcttgtgcagcttcgtgccaaagcgctctccattccatatatttgcccatactagggagagcggcttttacaaccgtttgccagtcggcaggagttagtgccatgccggcgagcctgtctaactgcaccaaggtaaaattagcattggtttcgtatttacggaccgactcggcaatttctttaatttgtaagtattctaccggagcgtggacacgcccaccctcggctccttcaaagaccggaaatgcctgttgtattttcctttgttcctctctgggaatgaatgagtctgcgcactgcctctctgcgcactgcctctctgcgcattgctgacgcactacgcagggcgggggctccgcatagggcggaccttgaaaccgactgccctgaggccaatcagcaaactggccttcgccagccgcttttggcttttttcttgaccaattagctggctggtaatgggctgcttcttcctcccagtctgtttcctcagaggaggattcttcacctgcttcagagctactaagagctggctccccgagcccatccagcgatgagcacaggctccttttcctagagacctccgctaattgatctttcttcttttccctttttcctctttttcttctaatctctctccaggtattcctacctaaccttaacttttcctcgggttcaagacccttggaaaggcctgtatacttattttgtgtaccatatttcctctttgctcctactctctctccccgctttacttctgatagcttgtcctgaatttcatctagaatccgccctgccttaaccacttgataacatgtgaaaaggaacaaaagggcttctaacactagaaaaaattcaaggccaaacatattccactttacttctgatagactgtcttgaatttccttagaaagttcaaggccaggcttacctcgtaaagctatactcactggtactctcgttccccagctgaaaagttctgaattcatgcagttgaatccttcttaacagtctgctttacgggaacctttattaccgcgacccgcagttctggttctggaatgagggatcttccttgcgccagtcccgagttttttctcgtcccggaattcggcaccaattgttattagacgcgttctcacgaccggccaggaagaacaccacagaccagaatcttctgcggcaaagctttattcttacatcttcaggagccagggtgcaggaagcaagagagcaagaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacagtaagatacaatgtaaagagatctctgtaccccttctccctgtcttcttcttgtgctacttctgttgatttgttgcagctgccagaggtatttttaactaaactgagaaggtatagaaatatatatggatgaagtatatttgggctttttccagtatgaatatattgcaagagtgaagtgtagatggaacaagattggctctgtgtcatatatctggaaatttaactagatgatagatatgtggccatttattatacatttacatttttgtatgtgtttaaatttttcataactaaaaattaaaagatgagggtataggcacatgacattaaatagctgctgtgtgtcaaactatcttagctgtcaacatacattactgtacttaatcctcacagctctcaaggttaatatagttattcccatgttatacatgtgaaaaatgtgacccagacagtttaattatactctctgtcatcaatgggcctttgctgtgtaacagactctgtattaacattaactccatgagctagaaaactaattcactgaaagacattttagcaaaataggtatttgctaaatatatgaattttctgattttactagaaacattcctttttaactatctaaaattgtttactatgtattaacagcataatctaacatgatctgttttccatcccctttatatacgttttatatatattatatatgcatatacatatgtgcatatactatagagagaaacacacacaaagttttggctggcctaggactacctatggaaacagggctaaatatgaactcagagatctgtccacctctgcctcaagttgatgggattaaaggcatgtgcttccatgcctggcatgtattatttctttgattaacaaagatattcttatatatttatgaggtgtaatgtaatgttgggtagtgactggctcagtattttttttaaaagttcaaactacattgagatatatataaggtatcattgttaattatattcatcctgttatactatagaatagcagaacttactccattaataaaatgataacatcatgcctattgattggcctcttctctgaattaatattaaaataactcttaaagataatacttattagtaagatttcttgagttataatttgcacactataaattaaccttcgcaagtgattttttttaagtttatagagtagtccagttatcattatagttcaattttagaatattttaaccttatcccaggctaaatctaccaataattactaatatacttattgtctctatagattttctttttctggatattttatattaatagaattagagataagaaaaaaaagatgataccatgaggaataaattattaaatattcaaaaaaaagaattagagataaggtccttttttctttattctctcatcaatatatctcaaccacagtttcccctccttctcctcccattcatactccctcctccagatccattccttccctcctcctttttttatatcaagttgcaaaaagactagggacctcccctcatattaaggcttgatgaagcaacccagtagaaggaaaagagtcccaaaaggaggcaagagtcagagacagcctcttctcccctgcttccactgttataagttccataagaacactaagctacacaactgtaacatatacacagaggacctagttcaggacccccccccccacaggctccctgattgttggttcagtctctttgagcccctatggtccccgattagttgattctgtgatccattttcttgtggtgtccctaacccctctggttccctgaattcttccactgcctcttctgcaggattccctgagttccacctaatgtttaactgcatctgctgccaaaacttgctggatgaagcctctctgatgattgtgctaggcttcagtctacaactataactaaaaagagtatcattcagaatcatttcattgacttttttttgctgctagtgtttaggtgttttttttaaaatagtatttattattctgaattaaatactgtttacatattttaataatgtcataataactccataaatatttattctacatttattaaaagtgaagttgatattatttttttcattaagtacttaaaacccaatagcagcttccccttcctcctttcctccaagccccacctctctcctcctcccctaccatcccttttcctttctcttcagagaagaggaggccacccttggatatcagcctgccttggcatacaaattgcagtacgacaggtgcatcttttcctattggagctagagtaggcagtccagttagggaaaatgaatccagtggtagacaatgtagttagagatagcccctgctcctgctcttatgggactcatatgaagaccaagctgcttgtctgttacatttgtgtaggggacctaggtctgtcacatacatgctgtctggttggtggttcagtctgtgtgagcacctatgggcctaggttatttgattctttaggttttcttgtgatgtccttgacctctctggctcattcaatccttcctccccatcttccacaagattccctgagctttactcatgtttgaatgatgggtgaagcttctcagatgaaatctgattccctcagctgatggatgaagcctctcagatgacagttatgataggctcctgtctgcaagtatagcagaataccactaagagtttaaggagtagactctcattgttatgggtctcaagttggtacagtcattggttggccattccttcagtttctactccaacttcatccatgcacatcttgtaggcaggacacattatgggtctaaagttttgtggctaggttggtgtctccctccctacactggaagtcttgcttgcttataggaggtgacagttttatgttccatatcccctattgctaggagtcttacctagggtcaccctcatagattcctgggagtttccattgtcctagctttctagcttgttcaacccaacaagcagatgaaaaagtcagatgcagatatttgcacccaaccaatggacagaagcagctgactcctgttgttgaattaaggaaggctaaaagaagctgaggagaagggtgatcctgtagaaggaccagcagtctcaattaatctggacccctgagatctctcaaacactggaccaccaacaggcagcatatatcagctgatatgaggccatggacacacatacagtagaagacttccgggtctgtgttcattcagagatgatgcacctaaccctcaagagactggaggccttggggagtttagaggtcaggttgtggggggcatccacgtggagactggatggagtggggagcaggtgtgggatgtggagcagacagagggtggagggaggcagggaatggaatatggagtgtaaaaataaattaaaattaaatttaaattaaaaaaaaagaagaaaaagttaatgttggctcttgccttatatattgcctttaatatgttcaaatatgtgctttgcatccgtgatctctccaagacttttatggtgaaggggtgttagaatttgtcaaagatttttcaggatctaatgaaatgatcatgtgatatttttctttcagtttgtttatatggttgattacattgatggatttttgcatattgaaccattcctgcatccctgggatgaagcctacttgatcatggaggatgatgtttttgatttgttcttggctttggtttgcgagtattttattgagtatttttacatcattgttgataagggaaattggtctgaaattacttctttgttgtgtcttcttagtattgtttaggtaacagggtaactatggcctcatagaatgactttggcaatgttctttctgtttgtattttgtgaaataatttgaaaagtattggcattaaattaaatttgaaagtctggtctaattctgcactaaaccatctaaccctggacttttttgcttgggaaacttttaatgactacttctgtttccttaggggctataggtctgtttaaattgtttacctgatcttgatttaactttggaaagtgatacctatcaagaaaattgtccatttttgtagagtgcaggttttgaaataagatctatcgatgctttggatttcctccgtctgttatgtccccctttcatttctgattttgttaatttggatattctccttctcccttagagttagcttggctaagggtttgtgtgtcttgttgatttcctcaaagaacaaactcttggtttctttattctttgtattgttctcttagtttctaattgactgatttcagctctcagtttgattatttcctgccatctatttgtcttgtgtatgtttgcttctatttgttctagagctttcaggtgtactgttaagttgctagtatgaggaatctctaatttcttttttttaagaaagataaatatttattcataacaaatctttttttatataattttttattacgtattttcctcaattacatttccaatgctatcccaaaagtcccccctcccgccccactcccctacccacccattcccattttttggccctggagttcccctgtactgggacatataaagtttgcctgtccaatgggcctctctttccagtgatggccaactaggccatcttttgatacatatgcagctagagacaagagctctggggtactggttagttcataatgttgcacctacagggttgcagatctctttagctccttggatactttctctagctcctccattgggggccctgtgatccatccaatagctgactgtgagcatccacttctgtgtttgctaggccccggcctagtctcacaagagacagctatatcacagtccttgcaacaaatgcttgctagtgtatgcaatggtgtcatcgtttggaggctaattatgggatggatccctgaatatggcagtctctagatggtccatccttttgtctcagctccaaactttgtctctgtaactccttccatgggtgattgtttccaattctaagaaggggcaaagtgtccacactttggttttcgttcttcttcagtttcatgtgttttgcaaattgtaccttatatctcgctatactaagtttctgggctaatatccacttatcagtgagtacatatcatttgagttcttttatgattgtgttacctcactcaggatgatgccctccaggtccatccatttgcctaggaatttcataaattcattctttttaatagctgagtagtacttcattgtgtaaatgtaccacattttttgtatccattcctctgttgaggggcatctgggttctttccagcttctggctattataaataaggctgctatgaacatagtggagcatgtgtccttcttactggttgggacatcttctggatatatgcccaggagaggtattgcgggatcctccggtagtactatgtccaattttctgaggaaccgccagactgatttccagagtggttgtataagcttgcaatcccaccaacaatggaggagtgttcctctttctccacatcctcaccagcatctgctgtcacctgaatttttgatcttagccattctgactggtgtgagatggaatctcagggttgttttgatttgcatttctctgatgattaaggatgttgaacattttttcagttgcttctcagccattcggtattcctcaggtgagaattctttgtttagctcggagccccatcttttaatggggttatttgattttctggagtccaccctcttgagttctttatatatattggatattagtcccctatctgatttaggataggtaaagatcctttcccaatctgttggtggcctttttgtcttattgacggtgtcctttgccttgcagaagctttgcagtttcatgaggtcccatttgtcaatcctcgatcttacagcacaagccattgctgttctattcaggaatttttcccctgtgcccatatcttcaaggcttttccccactttctcctctataagtttcagtgtctctggttttatgtgaagttccttgatccacttagatttgaccttagtacaaggagataggaatggatcgatttgtattcttctacataataacaaccagttgtgccagcaccatttgttgaaaatgctgtcttccttccactggatggttttagctcccttgtcgaagatcaagtgaccataggtgtgtgggttcatttctgggtcttcaattctattccattggtctacttgtctgtcagtataccagtacaatgcagtttttatcacaattgctctttagtaaagcttgaggtcaggcatggtgattcctccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcatctttaatttctttcttcagagacttgaagtttttatcataacaaatcttaacaattgattttacattctaagctacaaggaaatagcaaaacagcaaagagaaaacaagagctgaagaaaagcagtttaccatctttcactctaacttggtgacacttcattggcccaggccctgttctggcctgttttccccaagaacactttctggtttacagctcactcgtgattctgggttaaaaccacctttctcctgagggttctaatttctttatgaaggcacttagtgctatgaatttttttcttagttctgctttctttgtttcccataagtttgggtatgttgtgccttcatttttgctgggttctagaaagtctgtaatttcttttttttctactctgacctagtggtcattgagtagaaagttgttcagtttccctgaacgcataagctttctgttctttcttttgttgtgtaaatccaactttaatccttggtggtcggataagatatgggtggttattttaattttctttttcctgttgagacttactttgtgactgactatgtggtcattttggagaatgttctgtgaggggctgagaagaaggtatattcttttgtgttttggtgaaatgtgctgtagatatgttaggttcatttaattcataacgtctgtaaatttcattatttctctccttagtttctatctaggtgacctgtccttttgtgagattggggtgttgaaatctcccactattgatgtgtgaggttctatgtgtgatttaagctttgctaatgtttcttttaccaatgtggatgcatttgggacatagatgttctgaattgagaagttatcttgatgactttttcctttggtgagtatgaagtgtctttccctatttcttttaattaattttgattgaaagtctatttcattagatattagaagggttactccagcttgcttctttggtctgtttcttagaaaacctttttccagccctttattctgaggtactgtctatctttgttattgaggtatgtttcttctatgcttcagaagactagatcctgttttcatgtacattctactagcctgtgtctttttattggggaaattgagtccattgatattttgagatattaatgtttaatattaattgcttattcctgttattttgatgttggtggtagtgtgtgtgtttccctttattacttactagtcatgtgtagctttagcattgtttctctcattttaaaatatttttttttagatagagtctcttggcgttcaagcagaccacagtgttgcactatagctaaaattgaccttgaactcttgattcttctacctccacctcccaagtactaggcatacagaagtgtaccaccatgctaggctcattgtatgtttatttttaaatggtgtgcacctgctggtattagtggaggccagaagagggcatctggtcccttggaactagagttacaggttgttgtgagttacctggcatgggtgctggatccaaacttaagtcctccacaagagcagcagttgttctttattgctgaaccatccatccagccctgtatgttgttgtttttaaataaataatggtgggttttttttgttttggttatgtttggtttgggctgttggggatgggacccagaacctcatgcatactagacaaagtgctgtatcactgagctacgttcccagtctgaaaatattttatagttaacagatatggtgtaatgttttatatgtctacagtgtaaaatgattaccatattcaaaataattaaaatatctatagagttagaacttttcaagtttgcagggcaatattgttgactaaataatcaataagacctctagaacttactcatactacataactataactctatcttttaaccaatatctgtcgcatctcatcttatcctttataactaccactgtaccctttacttaaacaaatttctatcttttaatagatctgagataaaatcagctcatgcatcttctttttctgtatggtttgtttcacttagcatgttattaaaactaatcagcttttttttttttttttttttttttttttttggacatagactctttctctgttaccctaggctaacttcaaattcaccatcttcttgccttagtctctagtgtactgggatgataggtatgccccaccatatcttactatcatttgggtttggatttttctattgactaatggtatggaatatattttttgtgtgtttgattgtgtttatttagagaaatttatatttggaccttttgttgatttcaagttatcttagttactgacatcttattgactctgccttttgccttacagaaggagcttttcagattcatgaggtctaatttatcaattcttgatcttaaagcctgagccattggagttctgtttgggaaatttcccctagtgccaatgagtgtgaggctcttccttactttctcttctaatagattcagtgtatctggttttatgtgaaggtccttgatccacttggactagagctttgtacaaggagataaaaatggaaaggccatccagagactgtcccacttggagattcatcccagatacagacacttaactgttgtacgtgacactattgtggatgctaagaaatgattgctgaaaggagcctgatatagctgtctcctgagagaccctgctagagccttacaaatacagtcggatgctcacagccaaccattgcactgaggacagggtccccaatctagaagttagataaaggactgaaggaactgaaggggtttgcaactccatagttagaacaacaataccaaccaacaaacaccccccccccaagcttccagggactaagccactaaccaaggagtacacatggctccagctgcatatgtagtagaggatggccttgtcaggcatcaatgggaagagaggtccttggtcctatgaaagcttgatagatgccccccagtgtaggggaattgaagacggggggggggggcaggcgtgggtgggtgggtagaggaacaccctcatagaagtagagatgggggtgggatagggggtttctggaaggatgggaaaccgggtaagaggataacacttgattatgtaaataaattaagataaataaatttttaagaaacagaaaaaaatggatcaatttgcaatttttctacatgctggctgacagttaagccagcaccatttgttgaaaatgctatcttttttccactggttgattttggcttctttgccaaagatcaagtgaccatagttgtgtggattcatttctgggtcttcaattctattccactgatctacctgtctatcgctgtaccagtaccatgcagtttttatcactgttgctctgtagtacagcttgaggtcaggcatggtgattccaccagaagttcttagtttgctcaatcctaggtcacaaagatattttcctgtgcttccttctagtagttttataggttttacatttacgttttcatctgtgatacattttatattagttttatatataaagtgggggtaatagttcattttatttgtttatatattaatagataaccagttaactcagcatcctttgttaaaagaaatatccttttctcctaacaattgccttggtacctttgtgaaaagtaaattgaccatatttaattgtgtattctggattatttatttatttattttaattaggtattttcttcatttacatttccaatgctatcccaaaagtcccccataccctcccccctactcccctacccaaccacttccacttcttggccctggcgttcccctgtactgaggcatataaagtttgcaagaccaatgggcctctctttccaatgatggccgactaggccatcttctgctacatatgcagctagagacaggaactctggggggtactggttagttcatattgttgttccacctatagggttgcagaccgctttagctccttggttactttctctagctcctccattgggggccctgtgatccatccaatagctgactgtgagcatccacttctgtgtttgccaggccctgacatagcctcacaagagacagctatatctgggtcttttcagcaaaatcttgctagtgtatgcaatggtgtcagcatttggaggctgattatggaatgaatccccgggtatggcagtctctagatggtccatcctttcgtcacagctccaaactttgtctctgtaactccttccatgggtgttttgttttgttccatttatctgtctacatccattcttttatttatttaatttttaagagacattgcctttttgttttgttttaagacagtttctgtgtagccctggttgtcttggaactttctgtgtggaccaggctaacctcaaactcagatgtctgcctgcttctccctcttgagtgctgggattaaaggtgtaagcctccacccaggggacactgtcttagaacaatgtcttaccatataatgctgactgccctggattttgctacatagaccaggcaggcctcaaactcacagagatctgtctgcctctgcttccaaagcattgggatatacctgcatgcccagcatatatgtctattcttatgccagtctcatagtacctcaattactttaccagttttgaaactatgtcatttaagtgctttagtgctgttttttttaaagaagtattacctattttaggtccttcctttgcatgtcaagttttattttttaacagtaccatacacatacataatgcatttgttggttctaagaacagttgatcatttatttttgtagtaatttttgagaatttaattttaatatggtcacctaaataagacctgtgtgatggctacaacagttgtcatcccaacttgagtaagggcagtcacacaagatcttaagcctagattaagggctacaggcaagagataatcattcttctccaggaagggggcccctaataggttatccaatcccatgagaccagtcttaaagacctaaacatacaagcagcactatagccctaaacacataaacatacagtctgtactatatggatcagtaggctgtatttatgtgtgtaagttattattgtaacataagcgacaataagacgttatgaatttgagatggagtaggggaacatgaaagagtgacttagtggaaatgatttaaatgcggtattcgtgtacatgccaaattttacaaaaataaaacagtgcattttgatgaggattacattgtgtaataacttagggagaattacctttgggggaaagtaatgagtgtcgattgagggatttgcacatgttaagcatgcattctaccattgtttcattagccctacaatgactcatttcgtggtcttgttctcatttttctagtacgaagaggatgaagagtgtatccaaatctcggagagccaaaattgcaaagaaggtagacagtgcaagactggtagcagaacaggtcatgggagatgaatttgacttggattcagatgatgagctgcagattgacgagagattgggaaaggaaaaggcgaacctgttaataagatcaagtatgtttctgttttattttttatttgtcctgccatttcacacttgttttaggtttaaattttatggcttttagatttaccaagctctaaatacctacaagattagaggttatttggtttgggttttttttttcagttaattccttggtggccattacttcagagaaaaaaaatgcatttttgtttgtttatttgttttcaagacagggtttctgtgtagccctggctgtcctgtaactcactctagaccaggctggcttcaaactcagatatacacctacttctaactcccaatgttgggattaaaagtgtgcacactgccacccattggaaattatattcttattttgcttcctttgagtgtttggctcagatgcatcataaccttgcctcatactaatatattgcattgtattttagaatttccccggaagttgccccgtgcaaaaccttgctctgaccccaaccgaattcgtgaacctggagaagttgagtttgacattgaggtaggagtgtgtcctagatctggcaaagggacaagcatagtatgtatttaatttctgaaatagaagataaatactgaatgctagggtagggatattcttcactgtagagcatttgcttagcctgtgcaaagccctggattcaatttctgtccttgtgaaaaaaattaaattggacactaagttttgaccagcatataaatggaagattataattgagttaaaatattttaaaatattaaataaaaggcagtatcacttagggaagagagtatatgatttgtagtttatgatgtgtcccttcacacattcttttaattcattgtttcctaaattgcttgtctatcaagtagaaatcatagtgctttacaaagattttaaagattgaaatggaatgataaatgtactgcataatagatggtctacatataggatgttaggactcacactgtcaaacttgtactagaaacttaccagacctgccctgtacaattgaggcagtatattttttctttaacaggaggactataccacagatgaggacatggtggaaggggttgaaagcaagcttgggaatgggagtggagccggtggaattcttgatctacttaaggccagcaggcaggtggggggacctgactatgctgccctcacgtgagtaatcttcattttctaggctatcaaaagagtaccacccaaagggctaggccagctaattatttgttgagcatttttatatgttttgggtttttgagacatcgtctctttatttatcccaggctggtctggaactcctagtacttttttgccttgcctccaagtgagtgctgataatacagacccaacatgtaccaccatgcccattactgaaccaattagataattaacaaggatatttatgctgggagaataatgtgaatgtgaaaactgtccttaaaatcttcagagatggcagtaacaggatatgtagacttgaggaagaagcaattttaagtactttggaaatgggccagggagagtcatagaaagagaattgttaataaaaggaaataatgcagcatagatggtgaaaagaggattctgtctctccacattgcttgtctttagagagacctgaggcaaaattcgcttttcataaaaacagattttagtattatcttcattcttaaccatgaatggttctttcctttgtaataccttgattgacatagctattctttctgagtgttctgacatttggtttcttctggctacaataacttccccagtgtttctcctttgtcctttgcagtgaggccccagcctcccccagcactcaagaggccatccagggcatgttgtgtatggccaacctgcagtcctcatcatcctcaccagctacctccagtctgcaggcttggtggactggagggcaagaaagaagcagcgggagctccagcagtggcctgggcactgtgtctagtagtcctgcttcccagcgcaccccagggaagcggcccatcaagaggccagcatactggaaaaacgagagtgaagaggaggagaatgccagtcttgatgagcaagacagcttgggagcatgcttcaaggatgctgagtatagtaagaacatgttagaatattaggctagatcaaagagttccctttagcccaatttcaatcctaactctaagagaaaatagcctatagtgaacacaggtctcaaccttaagctagatacttattttttttccctgagccatgttttcttgctctgtaaaatggcagttatctgtatccccataagttgttgtaagaattaagagataatgtttagactcagcattaggcctttagtgcctttctcatggcaagtcctccattgtggtatagttagttctcttataattagctgtcatctggttttggtactgttatgtttcacttcaacaaactcatttcctctcttgcttatttgactgttatcatctgtatttttaatgttctatgttaatcaattcatttcttgcaaaggtatataccatcaggtctccatagctgagcattccatatccattgtttcatccatagataaaagtatgtggaaaaaaattacatatgtattgaacatgtatagactcttctttccattttcttctaacttgtatagtacaactatttacattcaaagtaaattattgaagagcatggagtgtatacaaatataataatattttatataaggaacttaagtacacatgagttttggttgatgaaggaggacattctgaagtcaattcccttcaagtatcaatggaaaactgaaatgaccttcatggatctttacatatataagaaacaaatcctaaaatatgatgattttggaataatataatgaataaagcactggtttatataatgtaggtaacaataatgctgatttttttaatgttttcaaaattatataaatgtaattttaattgagactaaaacctagagaaagccaaaactccttagacctgatacttttctttctgagcatattttctttttgttgtgttcatacaacttatgtgtaaacatatatatacagtgtatagttttgtttaatgtgtgtagctctgcagttttcttggatttctttcaacatcagtacatggagatctgcttcaacacatacagttttgcttgctgcaaactattctgtagcatcacaatgtttatttctttctctatttgacatttaggttgttcttaagggttttttattgcattgaaaatcctttcaataatctttttgtgtctattttgccaggaaatatctctctagaataggaaaacttgttgagttaaagattatatacaagatacatactgatagtgtcaaactatgtttcaaaaggatcagtttatgaatagtgtatgagaaatacctttttccttacattttttattaggtattttcctcatttacattttcaatgctatcccaaaggtcccccatacccacccccccaatcccctgcccacccactccccctttttggccctggcgttcccctgtactggggcatataaagtttgcaagtccaatgggcctctctttgcagtgatggccgactaggccatcttttgatacatatgcagctaaagacaagagctcccgggtactggttagttcatattgttgttccacctatagggttgcagttccctttagctccttgggtaatttctctagctttatagtgggtggatattataaatcatttatgttctctaactaaaggttgtgctttctttgttttatatattttttgatcctttgttcattttctttgagctatctgttcattctttcaattatttctcttttcaaaaaaatttcttacggatttgtagttcttttcgtattgtttaattattgtttctttatcattatcatctcctcctccttcttctcttccttttttttttcaagacagggattcactgtgtaccccttgctgtcctagaactcatgttgtagaccaggctggccttgaactcgaggagccacctgcctcttcctccttagtgctgagattaaaggcatatgctaccactacccggcttccttttagtactttttattctgtgtttgttaggttattttttatgtattcccttttttgctagagaggaacattgtgtatttcttctcatgtctgtacaagcctcatatagttgaaagctactggggaaaagacagaagagtagatgcaggaagtggatagagtatttttctagtctttgctattgtagttccagactcctatctccttgcctcatttttttctggtttgctcttttctgtacatcatagtatcatcgtcaagtaacctccttacaggaagattgcaatattgttctttttgaggcaggttttattaagtaacccaaggtagccacaaacttatgatcctcctgatacacagcccacatctaaactgcaagcaggagacagagagtacactgggcatggcgcaaatctattgaaacctcaaagcccacccccagtgacacaccccctaacaaggtgacacctcctattccttcctaacagttccaccaaatggggacaaaatattcaaatgggtatatacagggcattatcatctaaactaccacagaaatctgataaaaaaaatttccattctgtaggttgcctcattactcaattactcattcaagcaaacaatgtttgctgtacaaacactgtttagtttcatgaggtcccaattattaattgttggtcttaatgcctatactatcatggtcttgttcagaaactcctttcctataccagtgagttcaaacatactccatcatatctactctattagggtcagggtaacaagccttatattaagttcctaaatccatttggagttgacgttttgtgcaacataaacggtgatgatccagtctcattcttccacaggtagctatctagtttgaccagctgtcttttctctgagtattagtggattctttatcaagactcaggtgtgtttttttttgtgaatctgcaatttaatctgttgatcaatgagtctatattatgatatgaaatcctggattttaatagctctaaaacttttgttgttattcagcactttttgactctcctgggacttctgtgtttcacttatgatatttaagattgttttttcaatttctttgaagaattgtattagaattttgatggtgattttattgaatctgtagcttgctttttggcaagaaggctgttttcacaatattcattctgccagtccatgaacatgggaagtttttgcatcttctgttgtctctttcagtttttcttttcagtgtcttcaagttttgattgtacaaaatttcacttcttttgagtattccaagatattttgaggtagttgtgaaaggtattgtttctctgaattctttctcagtatgcttgtcatttatatataggaagactactgatttttatgttaattttgtatcttgctattttgctgagtatacttatcagctgtaggaggtttctggtgacatctttaaggtcttttacatatagaaacatatcatcctttcttatttatatcccccttatctccttcactggtctcattgttgtagctaagacttcaagtgctctgttcaaccggagtcaggagagtggcagccttgtcttattcccgactttagtggaaatgctttgagtttctctccatttaggttgatgttggctgtcatcttcttgtacattgcctttattatttttgagataaatctcctgtatctttagattctccaggacttttatcattgtggaatgttaaattttgtcacaggactttcctgcacttagtgagacgattcagtggtttatgtcctttatagtctatgttgtggattatgtttattgaattttatatgttgaaccatctctatatctctggagtaaaaacaattttgattacagaggataatctttttgatatgttcttgaattctgtttccaattgttttgagtattaagggtccattgctttccattcaaattttagaaccaacgtttccacttctatgaacttgctttgaaagggattgcattaaatatgtagatcactttagggactattaatgtcttaacagtattaagacatccaaccttagatgtcttaatactaagattggatgtttttacatttatttatgcctttgtagttttttttttacctcttatatttcatctgttagatttatttctcctcatttttgatattactagaaatacaattttcttaatttcctttatatattagttattactaatgtatagaaacaagactaattcttatatgttgatcatacctttttccaactttgtagagttctgttattacctataatgtcactcccaaactcccaacccccaacccccaacccaactatggtaggttctttagaattttgtatacatagggatgattttatttttgccttttcaatgtgattttttttcctttttaagttttacacagatatctataaagttttgtttataagcaggaatttggcaatttctagtagtccttatattattaggtaaggatgttagtttaagagaaatttatacagaattctaattctaaaaagtaataaatgttagtactctgtaaaatgaagcaagcttgattattagcaacactctgtgcctattactcagaagtacttctgttttggtctccgtatcctatgatttttttttccattttttattaggtatttagctcatttacatttccaatgctataccaaaagtcccccatacccgcccacccccactcccctacccacccactccccctttttggccctggcgttcccctgtactggggcatacaaagtttcctatgatttctaaaacagacctttattacttcattcctatcacagccttaacacaaaggttttctttcttgtgtgtgtgtgtgtgtgtgtgtgtgtgtgtgtgtttgtatgtgtgggtattctggcatagaaatttgggatgtgtcataggcatgtacccaaagccaaggtatttcttatattttgggtttactgatttggtactactgtatcctgtggatcatcattttctgccactgccagcagagcttgaagtaaccataatactgtaaaaaaaaggcattgccacttgaactttcagctcttaaccacagagccatccctccagccctgcagttcatgggcctctagaactggtttgtaggaggaatgtagaagatttttggagatatagaatagaaaaccccttaaatactctaagaaaagcaaaatgagacattttaatgggatttaaaaaaaaacgaatgccaaaagaaatatggaccttggaggaccagttcttgaggcttcagaaggaaacaaagtctctatcgggacctagcctaggggccattcatattctatcaattgatctggctgtattctggcagcatcctgagaaaaggtgaatatttttttttagtgaaagaaatcccaagacaggatagcattcaggttaggatgtgtcttggttacttcttgctcttctcaaccaggtagtgcataaagatatgaaaagtgtgcagtgtgatgcaaaaagtagcctgactgagttttaaaatgtggccacagaagaaataaaagtagatatggttttgttaaagagactaacactaataaaagagtactgagatgatagataggaagttatcctaagggtgaactcatccaccaaggctgcaactagtgaatatacaaattcattttgagacagggataggactgacaatagcactgaatggggttcctggtttaaaaaaagcttcataaaaatgcttccaagattcagttactaaaacatacaaaagctactatatctttgttctaagagggactatatatatcttgagctggcagctgaacaaggcagtgtcacccacatgatactagttttgggtgcatgaaaaattcaggattgaggaagtgatcaagttttgcaccatggttccacatgtggctgaatccaggcaatgtgtggcagggctggagtccctgcaaggaaatacaataggccactgtgtgaagctattaggtgaaaaggtccaagttacaatacaaaccctaagggttctggagaagcaagaactataagatctgtctgccaaggaaagctttaagcaaggagtatagcaaccacatggtggctcaagaatcaaataacataaaaattgctcaacttttatattcatatcctttcataccctaagatatcattaataaatatttaatactgtccaaaactgaggatcctatatctaatgttgaatactaaattgtttcaaaacatacaaaatattcattgggagttaagcatagtaaaagagcataaaatgttaaagatgaatcattaaaacacaagaaaatcaagaaggaagaccaatgcgtggatacttcattcctccctagaatagggaataaaatacccatggaaggagttgcagagacaaagtttggagctgagacgaaaggatggaccatccagagactgccccacccggaggtccatcccataatcagccaccaaactcagacactattgcatacaccagcaagattttgctgaaaggaccctgatatagctgtctcctgtgaggctttgccagtgcctggcaaattcagaagtggatgttcacagtcatctataggatggaacacaggacccccagtgtaggagctagagaaagtacccaagagctggtctgcaaccctataggtagaacaacaatatgaactaatcagtacccccagagctcatgtctctagctgcgtatgtagcagaagatggcctacttggccatcattgggaagagaggcccttggtctagcaaactttgaatgccccagtacagggaaatgccagggccaagaagtgagagtgagtgggtagggaagtagggcagggggagggtataggggacttttgggatagcatttgaaatgtaagtgaagaaaatatctaataaaaaattttaaaaaagaaatatattcgaaagcccttacatgataccacctgacatagtgagagagtatttaaaatgcattatatatctgtgtaccttgtgtaacaatcagtttacttaaaaaagattatcagtgcttctaggagagaaattcttttatcagtaagtatattataaatatttcaaaatagcaaaaactctttgaaggtaaacattaagaaaatgctaacttcaagcactgtgagaaaaattgtcaataatattttcatgatgtttgtagaacattattttaatattttcaacttaatattcaacaaacaaaataattattttaagatacatttcattgttatgtttcccttttcatttctgattttattaatttggatactgtctctgtgccctctggttagtctggctaagggtttatctaccttgttgattttctcaaagaaccagctcctggttttgttgattctttgtatagttctttttgtttctacttggttgatttcagccctgagtttatttcctcccttctactcctcttgggtgtatttgcttctttttgttctagagctttcaggtgtgctgtcaagctgctagtgtaaggtctcttcagttttgttttggaggcacttagagctatgagttttcctcttagcactgatttcattgtgtcccataagttttggtatgatgtgtcctgattttcattaaattctatgaagtctttaatttctttctttatttcttgcttgaccaagttatcattgaatagagcgttgttcagcttccatgtatatgtgtgctttctgttgtttttgttggtatttaagagcagccttagtccgtggtgatctgatagggtgcgtgggattatttcaatcttcttgtacctgttaagacctgttttgtggccagttatatggttaattttggagaaggtaccataagggtctgagaataaggtatattcttttactttaggatgaaaaatgttctataaatatcttagatcaatttgtttcataacttctgttagattcactgtgtctctgtttagtttctgttcctatgatctgtccattgctgagagtagggtgttgaggtctcccactattattgtgtcgggtgcaatgtgtcctttgagctttagtaaaatttcttttttgaatgtgggtgcccttgcatttggagcatagatgttcagaactaagaattcatcttggtagatttttcctttgaccagtatgaagtgtccttccttatctttttggataacttttggttgaaagttaattttatttgatattagaatggctactccagcttgtttcttgggaccatttgcttgggaaattgttttccaaccttttactctgaggtagtgtctgtctttgtcagtgaggtgcatttcctgtatgcagcagaatgctgggtcctgtttatgtatccagtctgttagtttatgtctttttattggggaattgagtccattgatgttaagagctattaatgaaaagtgaaattttaaaaattagaagaaaagtgattattactttctgttatttttgttgttagaggtggaattatgtttgtgtggctatctttttttgggtttgtagaaagattactttcttgctttttctagggtatagtttccctccttgtgttggtgttttctagggctggatttatggaaagatactgtgtaaatttggttttgtcatgggatatcttggtttctctttctatggtaattgagagtgttgctgagtatagtagcctgggctggcatttgtgttctcttagggtctgtatggcatctgcccaggatcttttagctttcatagtctctggtgagaagtctggtgtaattctgataggtctgcctttatatgttacttgtcttttttcccttattacttttaatattctttctttgtttagtgcatttggtgttttgattataatgtgacgaggagaatttcttttctggtccagtctattgggagttttgtaggcttcttgtatgttcatggcatttctttctttatgttagggaagtttcttctataattttgttgaagatattcactagccctttaagttgggaatcttcgctctcttctatacctattatccttaggtttggtcttctccttgtgtcttggatttcctacatgttttgggttaggagcattttgcgtcttgcattttctttgactgttgtgtcaatggtatcttctgcccctgagattctctcttctatctcttgtattctgttggtgatgcttgcacctatagctcctgatctctttcctgggtttttctaactccagggttgtctccctttgtgatttttttttaattgtttctagttccatttttagatcttggatggttttgttcatttccttctcctgtatgattgtgttttcctgttattctttaagggatttttgtgtttactctttaagggcttctagctgtttacctgttgtctcctgtatttctttaagggagttatctaaagttctctatcatcctcatgagaagtgattttagatctgaatcttgcttgtttcgtgtgatggtgtatccaggacttgccatgttgggagaatttggttctggtgatgccaggtatccttggtttctgttgcttatgttcttacgcttgcctcccaccatctgattatccctagtgctccctgccttcaccatatctgactgaggcctgtcctttctgtgatcctggttgtgtcagaactcctcagagttcagctgtctctgggatcctgtgattctgggatcctgtgatcctgagatcctgggtgtgtcacagctccagggagtcaagctgcctctgaaaccctgagatcttggtgtgaccaaactcctgggatcctgtggtcctggacatgttagagcacctgggagtggagcttcctctgggtgttgtgggactggttgcagagtttgagtccaaggtctgctcagagcactggcccagaccagaaggaacctgtgccactggtcgagcagagttcctgggtgcctgggtcccgctggtcccacttacttctggcgttggggcagatgttgtatcctcctcacctctaatcctatccccatttcatttcttatatgatgtatttgtcttttctttgtccgtctaaatcaaatacttaccaattatattgaacttttcaagagataatcttattatttttaaaatcatattacatatattgattgattgattttgtgtgtgtgtgtgtgtgtgtgtgtgtgtgtgtgtgtacgcgagagagagagagagagagagagagagagagagagagagagagagagagagcatgtgcatgcacctatactgctatggaagttagaaggaattgttcttcttgttctacatatacatttctgtggttgtacttatattatcaggcttagtggcaacatccttgttcactgagccatctttctggcctaattttaagggatcttttaaaatctgttttttaattaaaatataaatatatcttttccccttcagttttctaattctaataccttccatgttcctccccacctcttctcaaattcatggcctcttttccttttattgcataagtatataaatgcaacttgcttggtccatttagtccatttagtgttacttttaagatgtgatttcatagttgacttgtgttgacttggtgttattagatatagtagtgggtgggggtttatccctccaaaagattgattctacctctctcagcagtactttagttgcctgtagttctttatttagggatggggaccagtgagattcaccccttccatattagcatgtctgttggtactgttcttcaggtcttgtttaggcagtcatattattaagatattctgggtccccgccatttctaggaaatgcagtctcagactagatttcctggtcctgacttttatcatctttctactccctcttttgtggtttctcctgagctttgggtgcaggagttatgctgtagatgtatccattgtgttttgacacttcacagtcagttctctacattttgaccaattgttgtttttaaataatggtctccatgttacaatgagaagcttcttggatgagaagtgaaagctatacttatttgtgggtttaagattaagtatttagaatgcagatatatgacctcactagccatgggtagttggctgggtttccaatattaggtataatttccctcctgttgcttgccaccaagataggagagccattattgtacccttggagatatcttgctgtgctgtttggttcctatgactcacagcagggtagggttattagttgcttcccttccttggcagtttgcataccaacttctggaaccatgaaagctactccttaaggaggagactttcaggtcagatccagctcagattctctgagtcctgggtataaagtgtataatgccatccatagtaggaacttcaacctctgggaggcaaccaaggacaacagtaatgtgctgtaatgttttaggagtctcttgaactcctgacaaacaacttgaaaggtggtttttcagtcatgtactggagtttttgttaatagtctgtcactctttgggggagtattattcccccaaaatgtataactatatttaggttatgtatctatttatgcatattcatttaaatgtattacttgtaattttaggtaagtgaaaaaggatatgattccttatgtcttttttaatgaatgctatttttccctttctgttttgacattcccctctcatgtaaacctcaccccaccctcgctctcccttaatatcacctatatcctgctattctcctctctagtactccttctgtcacccccatggtccctttttactttattgctccaagatacttaaaattcagagctttgagctgcaaatagaagagaacatgtggtatttgtcttttggatcttgggttactttgatcagtataattttttctagttatatatgtttattgcaaatttcattcttttgtttttctttacagataaaccgtatttcaaagtatatatgtaccacatattcactatccttccatcaattgaaggacaattaggttgtttctgatgtcttggcaattgtgattagaataacaatgaacatagctaaggaagtatttgtagaaaaggtattaagtcctttgggcatatgcaaagactagtttttgaaaggtcagctggtatatttattttatagatttttgtttgttgtgagacagctttatctgtcctggaactagctctgtagaccaggctggcctagaactctcagagatctgcctgtctctgcctcttggccaccaccactcaaccctatttcttagctttttaagagttccttccacacattaatatctagagtagatatgtgaatttgcagctgtaccaataaacagtgaaagaggttcccttcccctgagttctctccatttgttgtcttgatcttaggcattctgactaggttaagctgaaatcgcaaggtagttttgacttgcatttctctggtgattgattttatttaattagtttcatatttttattggttgggaatttcacatcatgaaccccaatcacattcacttcccacgcttcccaggtctgccctgatgaacatttttaaagatacttcttagctacttttatttctccctttgagaattctctattcacattattagcccattttttaatgcatcactgtttttactcctattttctgaatattttataaagccatagatattaatcatttgtcaggtatgtagctgccaaagcttctctctgttctgtgggcttcttctctcaattgtttgtttttatcttatatgcattaatgttttgccagcatgtatagctgtgtgagagtgtcagatttccttaaaactggagttacagacagttgtgagctgccatgtgattgctgggaattgaaccctggtcctctagagagcagtagtgctcttaacaactgagccatctctccagcccacttatttctttagctgtccagaagctttggctttaattcctaggcaaataatcctattcagaaagtcttcccgtgcctttatcttgtaaaaccttgcctatcttttcttctagcactttcagtggttcaggttttacattttggtatttgagttactttttgttttgttttgttttgtttttgttgttgttgtttttcgagacagggtttctctgtgtagccctggctgtcctggaactcactctgtagaccaggcttgcctcaaactcagaaatccacctgcctctgcatcccaaatgctgggattaaaggcttgcgccaccactgcctggcttcagttactttttatgcaaagtgataaatacaggtttatttaattcttctacctgtagacattgaattttcccagcatcatttgtcataattgctatctttatccaatttatgtttttggcatctttattaactattaaatggctgtatttacatgtacccatttttcttccttctattatattttactggtccacatgtctggatgttctttttggttttaccagtaccattctgttttcgttaccatggctctgtaacagttttgaaatcgggaatggtaatccttccagctttgttctttttactgaagtttgttttaactatctggggtcttttgtggtgaatgttaaaatagtgttttctattttgtgaggaatgagaagggttttgattatgattacattaagtctataaataggttttggtagagtattcattaactctaccaatccatgaatatgagtgttttccccattttctagtattattctcagtctctttttttcagtgacttaaagttttcattgtagaaatctttcaccttcttggttaggttttagttcttgattttttttttatggctattgtgaatgagaatgtacccatatctttcttggtgtgttgttggtatatagatactgatatttttcttttttttaattatttttttacattctgacctcagtttccctttctcttctcctcacagttgctccctcctacctccccttctccccatatcccttcctcatccaagtctcttcagaaaaaggacaggcatcttttggatatcaaccaaatatggcatatcaagtttcaataacattaggtgcctcccctcctattaaggctggaccagacatcccagtaggagtaaaagggtcccaaaagcaggcaagtgaatcagagacagcccctgtttccactattaggagtctcacaagaaaaccaagctacaccaactgtaacatatctatgtcagtcccatataggctccctggctgttgattcagtctctatgggctcctatgagcacaggttagttgattctatgggccattttgttgtagtaccttgacccctctagctcctacaatgccctacccaccacctacccccaacacacacacacacacacacacacacacacactgcttccatagaattccccaagcttcataataatggttggctgggtgtctctggaactgtttctatcagttgatggatgaaagccttctgataataattaggctaggcaccaatctatgagcatagcagaatattattaggaatcatttcattgactttttgccaatcatgtttgggtctatcctagatttctgggcttatccagcctctggatcctggtcctctcgggagtgtcaaggtgggctccctctcaaggcatgagtctcaggatggaccagtcattggttgattactcccacaatttctgtgccacttttatatcatcatttcttataggcagaacaaattgtaggttgaagttttgtggctgggttggtgtccaagttcctccactggaagccttgcttggttacagaagatggcaagctcagtcttgtatctcaccccagctaggaatcttagctaatgttaccctgaagataactgggagtttccattgaattaggtttctaccttacccagaagatacccctcccaattctagccatctctcccagtactctctccctccctcctcccccctccccaattccagccttctctcccaatactctctatctccatcctccccctccaacctgaaccctctttttgtcatgcccccccattcacccacaatatctattctacttcccctttctgcagagattcatgtatccccctcctcaagacctctttgttacttagctcctctggttctgtgaattgtagcatggtttcctttaacgttataggtaatatacacttatgattacataccatgtttgtctttctagagacagttgtgagctgccatgtgggtaccacgaattgatccctggtcctgaagagcagccagagccatttctctagcctaaagtgtgtttcttgtatgaaacagaaagatagatcctcttttcacatccattctgttagccctttgcctttggggggttggggattgagtctattgatagtaaagaccaatgattgttaattcctattgtttgttgtttggtgatgatggtgtgggtgggaatggcatggacacacaaatgtggttcccttcttgtgcaagtgtgaaattatttcctgtgttttcttgggtgtagttaacctacttgggttggagttttccttgtagtaccttctaagggtaaatttgtggatagattttgtttaaatttgagtttgtcatggaatatcttgtttgttccatctatggtgattgaaagtttttctgggtattgtactctgggtctgtagtctctggcatctggacagtctacagcacatctgtgcaggcccttgtagctttgagaagtcaggtgtaattctgatagatctgcctttgtgttacttgacattttcccttgcagcttttaatattctttctttgttctgtatgtttagtgtttccactcctattattcttaggtttagtgttttcatcatgtctcaggtttcctggatattttggttcaagagtttttgagaattaacattttctttagactgatgttaacaagtctctcaagttcttttctcctatcttgcacgcctaagattctcccttccatatcttgtattctgtttgtgatgcttgcatctgaagttcctgttggcttacctagattttacatctcccaagattcccttggtttgtgttttctttattggttctatttccattttcaggtcttgaacagttttattcatttttgtatcctgtttattatttttctagaatttctttaagggatatattcatttcctctttaagggcttgtatcaacttcataagattggatttaaggtcatttaaatatccaaggcttgttacagtaggatagctggtggtgccatgttgtcctggcagttgttacattcttatactggcctccagtcatttggatttgaggttattataatttagctgcctatttctgtgtttatctttgatgaatggatgtttttttttccttggtttctctcaggtcttctggcatgagcagcctgtggttctgatgatcagtgagtcttcaggtttaatagggtgtctccatttggtgttttcttagcctgtatgacctctagggttttgggtgcctgtgttgcctattggaatctgggaactggtatgacttctgggattttagatactagtgtggcctctggagtttctagtaccatcttggcctcctgaagagcagggatcttctgcaggaggtgtgagcctggcgttcctagtaacattgtggccttcaatagagcagggtcttctgccagaattgtggactgagatataaagcccaggggagggggtgctgttggggactgctggaccagctttaagaagtattagaaagtgatagatgggtgttttacctggggttcctagtacttctggtcccagcatagcctctggtagagtaggagtcttctgctggagttgtgaaccaggatatggagccctagatacagatttttgtgattttgtatcctaccatgtgttgatcatttctagaagttttatagttgttttttagaatatgtgatgtgcaaatagggacagtttaatggatccttgtctactttttgaataatttaataagaattgactgtaattctttgcagatctgttaaaatttttctgtgaatacatttggacctgcactttttttttccaagacagggtttctctgtatagccctggctgtcctggaactcactctgtagaccattctggcctcaaactcaaaaatccacctgcctctggacctgcacttttgtagttagaattatttttattactgtttcctatgttgcagttctgtttaggttgttgatctcttcttggtttaactttggtggtttggatgaatctagaaatttgttcatttcttttagtttttttaagttaatgagctataagtttttaaaatattccattataatattcttaatttccttatgtctgttacaaatggttccctgttcattttttattctgttagtttagatcacctgtttctttggtttagttgtgtcaaaagtgtcaattttgttcatctttctatagagttcttagatttgtttattcattatattgttttctgtgtttctatcttactaggttctgctgtgatttttatttttatttatttcttgccacatactggatttgaatttgctttgttcttgttttccaaaatcttgagtggcatctttaagtaaaatatttgtgctgtttctgacttgtctgttttttgagacaaggtctttctgtgtagctttggcaaatctagaacctgcaatggagacagggctggcttggaatttagaaaggtctgcactgattaaagacatgagtcaccatacctgggtctttctgatttttaagtgtaggcacttagagccataaatctctccagagattttgttgtgctttgttttcatttttattaagtactaagatttttttcttttatttccttctcaatttcttctttaacccattcatcattcaacaatgaggggtttttatctcttattgccatgcatttgtgtacttattagacatttgtttgcttttgattttgtgttttattaatctttttttttttttttttttggtttttcaagacagggtttctctgtatagccctggctgtcctggaactcactttgtagaccaggctggcctcgaactcagaaatccgcctgcctctgcctcccaagtgctgggattaaaggcgtgcgccaccactgcccgtgtgttttattaatcttacagtaagataggatacatggagtctttctgaatttgtaaagatttgttttgcattccaagatgtagtctattttagagaagtagtctaatcatggtttcccctccaccaactcctagatcctctccacctccccacccacccaatttcattccctttctctctagaaagcaagcaagcaaaaaaatatccccacataaacagaatagaaaaaaataacacaaatacacaggagcaggtacatgggcttgcagggatggacttaccaggttatatcagagtcacaggtctggaactaggcctgtgggtgtggagatgggaagaagtggatgggagtgggggtatgaaactgttcttaggccactactttgccacccaaaatttcaaagtatagttttctgaccctaaggcaccaagtctttcttctgtgtcacacttaacttctttaaagtagaaatcctttcagacccaacaaagtaatattggtggcttctcctgaaacagctgtgttagtattcattcctttctaagaataattaaatgctttttttgaaataaaaaatcaggaggtaaagttttcacctctttgctgaaggaagaaggtctgaaaaatatagagttctcttctaggcttgggagtggcctcagaattttacgtcatcaattggatctttctagaccatattcccattaaaaatcctaagtgtcttgcctatggattatgaagaattgcctatggtttttatgataatctgcatacttctatttgtttctctaaggtaggatagttaaatatagatattttattagattgtgcagttccaataattttggtcctagtttaatttagtcgattttttcctattatgtttattaaatatgtactatttacttttcccattctttcacaaacaataaatacctacttttcattgtatgggttgctttagtataaaatcaaacacacatccctggcctcatttgtaaattagaggcagcagatgtaataatcagttcctaagtacagtactacatctccacggcaggcataaaacacaggttgcgatggagagctgagaaggaggaatctgaaccagattatgagagcatgattatactcttttaaaaattatttacattccagctcctctcccagtaccccctcctatagttcttcaacccgctcctccttccacttgaatctgagaggttgcccccactcctagaccttccccttccctgggtcctcaagtctgtcaaagattaggcacaacttcttccactcaggccataccaggcagtgctggggggggagggctcagaccagctggaatatgctacttggttggtggctcagtctctgggagttcctggagtctgggttagttgagactgctggtcttcctatggggtcactctccctttcagcttcttccagcttttccctaattcaactaggggtccgtgactttagtccaatggttgggtatctgtatctatctcagtcaactgctagtagggcctctcagaggacagccatgctaggttcctatctgtaagcatatcatagcatcagtaatagtgtcaggccttggtatcccctacccccatgatatggatccaaaattggaccagtcacaggattgcctttccctcagtctcttttccattttatgtcactgcagttcttttagacaattctaggtcagaattctttttatggtagattagtaatttgatgccttgtctttctactggggtagactcttcaagttccctctccccattgttgggcattttggcaaaggtcaccccattaagtcctgagagtctctcacttctcgagtctctagtactttctaaagcctccctcccctgcaaggctgctggtgctggtcttctgtgcttctcttctggccctgccgccatacctgatcctgttcgcctttcccctaccccatccctctcccatcctggttcctcccaccctctgcctcaggtgattattttcttcttccttctaagtaggattgaagcaccctcacttgagcctttctgcttgataaacttcttatggtctgtgggttgtatcctaggaattctgtacttttttgctaatatccacttatcagtgagtacttaccatgcatgtccttttgggtctgggttatgtcacccaggatgatattttctagatccatccatttgcctgcgaatttcatgaagtcattgttttcaatagctgagtagtattccattgtgtaaatgaaccacattttctgtatctgttctttggttgagagacatctaggttgtttccagttctggctattataaataaggctgctatgaacataatagagcacatgttttggtggagcatcttttgggtatatgtccaagagtatagctgggtcttcaggtagaactgttttcaattttctgaggaaccgccagattgattcccagagtggttgtaccagtttgcagtggaggagtgtttctctctctccacatcctcaccagcatgtgctatcacttgagtttttgatcttagccattttgattggtgtgaggtggaatctcggggttgttttgatttgcatttccctgatgagtatagaactaaatctagagttaaattttaaaaggtgagccaagtagctcacatgagtgactaagaatttggtgaatgtagaaggactttcataacaagggtacaactatagaaaaggtacaaaatgtaagatatttaggaaccttctgcagttgaatgtggattatgtaaatgaatatacttgaagaggaggaggaaggactgaaatatgtatcattctgtctttgttcttatggatgaggtttaatttatttaatttatcctgccttcacctctccccacagtctatccatctctggagtctgatgatgatgaccctgctttgaaatctcgacccaagaaaaagaagaattcagatgatgctccatggagtcctaaaggtgatctagcattccgtatcttatactctgtaggactaatcaggtgaaaaatagagatcaatgtaagacatctgtaatccaagatcttattcagctactcatttgcaagcatctgttacttttagtaccatgttaggtgccagggctaaattgattgtgtgacatagtttgtgtaatctagctaggaaaatcatagctattgtttttgaaatcttatgacttgagatgaaggaaaccagaagagttcactaagccatctaaagcttctaagaacattctggtaactgtcatcgcagccccactatgataattttgttttcaaggaggaaaactatgcggactcttgggctctgcaagagtcccaagactgtcaactactaagaagttatccctaaggaagggaaggaagagagggaaagtaggtacctgaagtaaacatgaagttttaagagagaaagtaattttctttatctcattggttgggctatttgcactgaagagcattcaagggcttattaatttttgaatatgtatgatatatgtttctatgtatagtgtttgtgagtgtttatatatgtatgttcactcctgtgtggttatttatatatgtttgcagttgtgtgtatgtggagttgagagaataacctcaggtgtgggcccttgtcctcccactttgtgacagaatcttttcttgttcagtgctaattacctctattttcagggattctcctatctctgcctcccatccattataggcattctgggattatagatgtgccttaccacatccagtttggtgttccaaactccagttctcatgtttatgtggcaagtgctttgccattgaattatcttccgcagtctatgatactttcacttcttaataaactacacaaatgttaatggcctaaaataatatttaccatttctcatgattcttttcttttaaatcactcttaatctagaacagttcgtcttggttttgttagttttcttatagaaactgatataatggtactgtagccagtatcatcttctagatttatttgctttcatgtaacattggcttttttttggggggggggcttcaaggcagggtttctccgtatagccctggctgtcctggaactcactttgtagaccaagctggcctcgaactcagaaatccacctgcctctgcctcccaagtgctgggatcaaaggcgtgcgccaccacacccagctacattggctttttttaagagattggttttttttctcatagtatcatttaagtttttctatacttgtactttctaaattctcaaaatactgtaaatagcttgcttttaatttcttaacaactcaaatattgctgcaattcacctgttactacatgattgcatgctgttccactatagttatcactaatgacatgaaaatgttcatactctgagctgggtgtggtcgattttgcctttaatatctgcacagagagacatgtggctctttgtgagttcaaggctagcctggtctacatagcaaattttagggctacagagagagactctttctcaagaaaacaaccaactaaagttcatacttggaatcctatatgtgttggtgctatctcaatttcaccagctttctttcttgggactagcttattatgccctgtaaaggaatacttagacactatgtgaatatccagttctctagaatcagtgtttcataaagacttgcaatctggtgatatattttttaaagatttattttattattatatcgaagtacactgtagctgtcttcagacacaccagaagggggcatcagatctcattacagatagttgtgagccaccatgtggttgtgggatttgaactcaggacctttggaagagcagacagtgctcttaaccactgagccatctctccagcccgatatttttagttttataactaattccacatttgtaagctggcattcttgcgtgtatatgtgtgtatttgtctgtctgcctgagtatattcgtgtatatttggatgcacatgttttgtttaatggtttatcttctgtctgactattcaaaacatgcttaccttttaaaaagtacattatagagccatttgagatgactcaacaggtagaggtacgtaccatgcctaacagcttgagtttgatctccaggacccacttattagaagtaaagaactgactcctacaagttttcttgtaaccttcatagttatgtcatggtgacatgcacagtgtgagtgtggatgtcagaggatttcagtataaatgaggagatagctcagtaaagtgcttatttgtgcaaatatgagaaccagagttcaacaaccagcacccacttaaattataaaacaaaaacaaaaccaactagcattgatgatggatacttgttatcctagtgctggggaggcacttgcccattcataatggcctatgtctgtcattgctctatcatgtgggaggcaagatctcttgttctttgctgctgcatacccctagactacttggcccattgtcttctagtgctactcttgtctctgcctcctagcttactctaggagtaccagaatcacagacaaaagctactgcatctggctttatatgggttctgagaatttgagtttggatcttcatacttgcaaagcagatgctttacacactgagccatttcccaagcacccttgttttttaaatgttattctatgattatcactgaggtgggtatatgtgtggaggtcaaaggataactttatggaattggttctctcctttcacctttatgtggattctagagaatgaactcaaatcatcaaactttgtttggtttttaatgtatatggggctggtgattgagccctggtcctcatgcttgcacagaaagcactttaccaagctgtcttctcagccctagctgagattcgtttgtaaagaaaagctttcttttttcacttgaatatttgttgctcctaaaagatgcttattgaaaaaaataaacagatagtaatatttttaattcagtactgttaaggtgctattaaaagttatgccaagaacttcaagaattcattgtttggtatctatagaataataatcttcaataggtagtatgtgttacatatcaagtcatttacaccaattataaaatctgagaaagaagagataggtgggatcagggaggacccagatattttatatatgttattatatagcatacttttgagggataggcatgttttaaatatgtaaaagtaaaatatatctgtcagatgatgagtctgagtatggagggcagggtaatgcaatatcatactctggaggtgcaataaggaagtcaattgtctgaagaagcagaaagtaagggtgtttagcctgttttctgcagctgtaatggaatattacaactgactaaattctaaataaaagactatttttcttatggttctagaagctggaagtctaagagcatgatgctggcatggtatagtccttcgtgttaaattgtcccataagtacaagacgtcatatagtaaaagagtaagggggctggtgagatggctcagtgggtaagagcacccgactgctcttctgaaggtcaggagttcaaatcccagcaaccacatggtggctcacaaccatccgtaacgagttctgactccctcttctggagtgtctgaggacagctacagtgtacttacatataataaataaataaatcttaaaaaaaaaaagaaaggaagtcttccagtgtcaccatcagtaagtaaaaaaaaaaaaaaaaagtaaaagagtaggaggaaaaaagagagttgaaatacaccccttttaatacctaacctacacctacaataatagctttatactattcaggaaaacagcgctatcatgacctaattgtgcctcttaaaggtctcccatctaatactgttgaaaagatcatttaagtttccacaagaattttggagggagtgtttataccatagcagtaggtgaggaaacaagtttggaaaagtaggtaagtcaggaacaacaaggacataaaagcacataaacaacattaaatgccagttcaaggaggttaatttgtattcatgtaagccttggtcattaaataggactctgtgaaaagctagaagcaggaagaacaatataactacctttggaatagtcagaagttgaagaatataattggcaaatagattagcatcctgtttcccttgcagcccgtgtgactccaaccctacccaagcaggaccgtcctgttcgtgaggggaccagagttgcctccattgagacaggcttggctgcagcagctgcaaagcttgcccagcaggtaagagttgacacccagctggtggccctgctactgatgacttagagcctcaaaattcagacctgtagggtggtaggatcctgctattatggataatctttggtctttgtctttggcagtattccagcccctcctatatcctttacatcctagctttgtggcaagctacttccatgggttacctagttgacatgaattaggatgaaaaaagagatcagagaagtgtccttgttgatgtcacttgccccccctaactatatgtaattcccacagatgggagtgggtggggggagagtcagttttctttccaggcgtggtccctagtaggtcacccatgccgcaatggaggccccatgcccatgtataatagacaacagtaatttgacttggtgagttactttaaaaacaaagaatatatgaaattgggagggaaacatgattggggagaatctttaaggtgttgcaggtaggggaggtaggcatgaatatgatcaatatatatttcatgtatgtataaaattctcaaatatgtagaaaaaaaaatggaaaaaatcttcagatagaaaaaactagatctgttatttgccttcagatttagtcctgaggaagtgactcagttgagtacacttaagttttgagtcactcaccagttttggaatttggccttttacaaagagctttttcttaaaccctttatcaaatattattaccttgatctctaacccctgcttctcaagagaacaaaattcaccatttttcatcctaaaaggtcaccttcactaaatcaattttacctcttagtattagtttacaatgtgctttaacatgtagtttgctcagaaaccctaggaatgtttggaggtaaagtgtttggttctttaacaatatcacatagctcctcatgccacatcctatagcttagagtactattgagcatctgccttatgtaggtgcccctatgtacagtgtctaatataatatttccaataatcttgttcaatagatgatattttcatcactttacaggtaaagaaaatgaggctcacttaaatgactagtccaggataagacagccagtaaaatggaggagacaagattcaaactcatatcctctaacttcaaatttcatgctacttgaggtttttttctttttctttttctctttctttttcttttctttttcttttcttttcttttttttttccgagatagggtttctctgtatagtcctggctctcctggaactcactctgtagaccaggctggcctcgaactcagaaatccacctgcctctgcctctcaagtgctaagattaaaggcggctactgccgggcactacttgagttttaaagtgaaataaatagttaaatgtttatatctttgagtaattatatcctatttaagtgaaatttaagaactgtttttcatatgatgttctgtagagctgtaacgtttctgaaaaatgtcttagaaacaattatttggagctaacagagatcaagcagaccaatcaagagatcaagtgacttttctttgactaaaacttcccctgccattcatcagtgccacataagatgtaacttttaaataaaggttttctgttgctgtaaacaaacagatgaaagtgtaaaaactactcttagtgctttctaaggagtaagtactatttgggttgatagaaatacttctaagaagaggctttaaagttgggggaggtattagatgctattttgtgtgtgcacgcgtgtggtaactaggaaggatttcaggaaaatattattccttgctagaggtcataaagccctctttgtttggtctcgagggactcctctctaatctgactaccctccaatgtctatcgtttatgccagccatacccactacggtgtttacgatttaccccaaattccaaatttattccaaattgccttatgcctttatttgcataaagccattccttttgcccattcacttcacctacaatcaccttatttctttgctcttcatctgtacttctctatagcattatcacatggtacttatgatcataaggatatgttacactctttagatgtattttaacttagtatcctcattttaataatgacacatgataaatcagtgttgaagtaaattgaatgagtgaatgaatgagatttttctggattggaaacttcatattagaagatgagtatagcagggacacgtggtgcacgtctttaatcccagcacttgggaggcagaggcaggtggatttctgagttcaaggccagcctggtctacagagtgagccaggacaaccagggctacacagagaaaccctgtcttgaaaaaccaaaaaaaaaaaaaaaacaaaagaaagaaaagaaaaggaagataatgagtataagtaaagttataaagtggattcttgccagtcactggtagctcaggcctttaatcccagcaaacaggaggcagaggtgaaggcaggcagtttatgccagcacccaccccccacactaaacaaacaaatgtataaaagtaacagattctgggacagctgcaactgcctttatataatttctctttttctcagttattttatgagctttgattaagattaagtaaagagtgtgtatatatgtcctcctaggaataacacgatataaagtaaggcttaatgacattttcaccttcaatctttatcaatatgggttgtctagccacaaagtagaatactattaaagtatgaatttggttgggagcttcctaacagctttttcaatagagaacttggcaaggtataagtgttctatcataaattaatccactcaccacttacatgcaaaagagattagcagcaaaggtagggaattttaatctagatatgaagacacaatttatggagttagactagagaacaggagaacagaattcattcttctgggttttatttgttgtttgtttgtttttgtttttgttttaagacaagggctctctgtgtagccctggctgtcctggaattctcccagtagatcagactggccttgaactcagagatccatctgcctctttctcccaagttctgtgactaaaggcatgcaacaccactgcctagccagaattcattaatattcatgagaaaagattcctgctaagactttggctgaacagagcagattctgaaaccagagtttgcatctcaacttgaaaatgtcattatatctgtaaccttaggaaaataacttaaggctggagagatggctcagcagttaagagcactagctgcgtttccagaggacccaggtataattctcagcacccacatgacatatcataactgtctgtaactctagttctaggggatctggcaccctcacatacacatacatacagggaaaatatcaatgctcatttttttaaaaaatggaaaataacaggtaagtataaagttttttatttttagaatgggaatataattattttttactatttatttatttatttatttatttatttatttatttatttatttattatgtatgcagcaggccagaagagggcaccagatgtgattataggtggttgtcagccacaccatgtggttgctgggaattgaaatcaggacctctgaaagagcagccagtgctcttaacctctgagctatctctccagcctgggaatataactattaattttcattcttaaaattattaaatgaataattcaggagcaatgcttgcatgtattactaataattctcattcctctgaaatttctctgatagccatagcctaacagatcttctgaaggcgagtctaggcttttgttcccaagagaaggctaaggaatatagtcatggagttggtgtgtgtgacatttcagaaagttgcatgctgtcagcacgtgctcagggctccaaatgcccattgtcaggtacctacaagatgctgggagaagtggcacaacttcatatttattctatacaaattgagatattaaattaaatgacttaaaaaattgtcgagtcttctgttcaaagaaaaaatttgcaaaatgattaaaaagctatcataagaaatggagaataataattagatactttattttataaccacattctttgatattttaaataaattttcagagaaatcttaaattaaaaaaaattagatactttgagttccttttacatgctatatattttaatgtcatttaagctttctaacaattctgaaaagcaggtattactttaccatttgcagacaagacagctgatattcagaaaggttagtaactttaactaaaatcatctaatttaggaaatagaagcctgggtttgaactcacatttaccatattccaaagcttacacgttactctcagttcattttgagaagatttgtaaggtgtctagatactagatctgactacttttctataaggatttgtgtttaaattacttattatccttgcacttttgttttgttatttataaaatgaagaggttccccccaacacacataggacttttataagaatatagtaaataatgtacttaagctgctggtgtacattagttattaggaatgcccatagttcaccagaaacaaagtcttcaaaatcatttacacttggcactttactattaagtggtaggtgatgaactatgggtgaatgatgtcaaagaaatcactgtagactttggaaggcctgtattgtgtgtccatacaaggtggacttagagagaatgggggaaaggggcaggatgcagaaacatgttgaccattgtcttcttactttctgggaaattttctttttctttttttactctttaatatctccaccgatttggcttatatttcaggagctacaaaaggcccaaaagaagaaatatatcaagaagaagcctttgctgaaggaggtagaacagccgcgccctcaagattccaatcccatcatgacaatgcctgcaccaactgtggctacaacaccccagcctgacacctcctcctcaccccagccacctcctgagcctaaacaagaggctctgtcaggaagtcttgctgaccatgagtacactgctcgtcccaatgcctttggcatggctcaggcaaatcgcagcaccacacccatggcccctggagtcttcctcacccagcggcgcccttcagttggttcccagagcagtcaggcaggacaaggtacatgacccaaatggagattaaaatgagagctcttaaaagctccctggtctaaatcttaagtgttctagtagttgagaataccaagaagccaaacttcaggtgcttggatattggccttccaatacctacagctcaatagtccatgaagaggcaattaactgaatttaaatagaagtaatactagatttaggtttgaaagattcctctggtggtcatagtggaatctggactagaagtaagtagtctatacatttcattcagaaaggactgagtaatgaagagatgataaatgtgaagagtagtaggatgtgagaagtgatttgatgtcgcaagacagaaagatgcatgagagagaaaattcaagcccttcttttcctcccattggccagagcccaatccatagtatatggatggatgtacttcaaggatactgagcttggtgtgatgtttagggtcgactagaataagggtttttaatgaaagaaggccctgagcatgacatcctcagggatatggaactatagtcactaacctactgatcaggataacatgaatggcatagaaatatattgacctccttaaaaaattttctaaggaaagtgattgaacccaaagtaagtaatggaaaacaaccagaaaactagaactatagtgactatgactgctgcagcaatcagagaaggagtagccaagcacatggcactgaatagaagtggttaaggagggttccttgcctgatatggtgtaaggatgaagagctttgttgagagagaaaaacaaagcatggaggtgtggtatggtgctaaagttgctcataaagcctctgtttattttgacccttccttacaggaaagcgtcctaaaaagggcctggccacagcaaagcagagactcggccgcatcctgaaaatccacagaaatggcaagttacttctgtgagacgagccccatcatgtcctactccttcatcccttcacccccattgccttcttcgttgtcaactcggggcactcctggatcctatgagccccggacaaggtgcattgtcctgctttcttgggactgaccaaaggcacggactatctccaactccctttcccacttcccctatgagtatcctaccttctttttccatatccataaatagcaggtaaatgggagacatttccaactgacaagaaccttttcctgctccacccacatatttcacttacaccttgtctttattcttttccactgctcctctatatggaaggaatgaggaggagcaacataaagggagtctgggcctgtcagtttcctcagccatggagtgagaagcccagtgctcaacattttctgcacctccagccctgtctctaagcctgcccacctccacccattcctaccccttcctcacaaccgatggatataccctaccttcattcttgttcctgatagaaggttgtggtctttatcttcttttacctctttttcatgacaaaatgaagagggtctttatgaccctattatgggacaactccagagctggcctagaaaagctgactttatctgtctttgggggagggggaggagattccttttacttttcgaggtgggaaaaaggacagatacccaagcctttgaccatgattgttgcttagcccaccagaggaaactacttttgtctgactgcaaatgaaacccctatgatgatcttcaggaatttgcctgtatttttgaggccctgtagaacattatccccatagctataactgggttcaagcaggtacaaactcacctcctagaaatctgaagtacctggcacattgagaactatggcccctgccaccccacaaagcacagcctggaccttctgaagagggtgtggtgagataaccctgaagggtcattatcaggaacttccatgtttctttccccatctaagcttagtctaaagaagatttcagtactaagatcttcacccctgggactttccacttccagaccacaggccaactattcaagcatagtacagataggctattgaagtctgaagttagaaacaatgcccatatgtgaagtagcagatattctgatccgcttttctctgctttcctttgtgattgtcactattttccagacaatgtccccacctccctcttgtcttgccttactggcaatctgggcttgatggagactgccccttctgaacaacccattttggcactgcccaagtgggagtgtcctctaccttccactcgtcctcatcccagcttgcctagtgcttctggggaatttaacagctatgatgcagaccacagggaatttgtgaggcctctgtgttatcttttatgtttgtggcttatctttcttttttctatagatgtatcacctccatccttgttgggatggggggatactttagcatatttgctttttctaccttggggacccccaggggccaagcagtcctcctttagtcacaccaaaggcaaaaggcctggctacctcccctttagcacgtgaggtccctattcccctcctttctactcagctttgcttatcttggagatttcaaggcagcagtagggaagtaaggggaaagcaggagaagctcctaaccctgtatgggcaacttcctgactaaagactgactgttgtcaccaaaaacaggtccctagccctttcacccactaaaactccctcttgatctttcaatggcagctaattgctagcaccctcaccccacccattccaggcctcttttccctctgtttctttgttagaaggttctgtggagc

SEQ ID NO: 323 - DNA, 186 bp, mus musculus
ctgccaaactgtgaagctgacttgccttctcctagaaaccacatgccgcgtcacgcagtgcccgggctctgacggggctttcgggcagtgtccacctcagccctcccaccgtctggccctcagagccttctagagaccgaggtctcagccggggctgggggtcggggtcggggccgccgggcgcac

SEQ ID NO: 324 - DNA, 915 bp, mus musculus; identical to SEQ ID NO: 110

SEQ ID NO: 325 - DNA, 915 bp, mus musculus; identical to SEQ ID NO: 110

SEQ ID NO: 326 - DNA, 116860 bp, mus musculus
gtgtgagctgtgcagccgtgggggtggggggggctttgtaagccgagggcgagggagggggctgggggggggggacaagattgctactggcctcagaccctgcacactgttgcaggcctcgccaagcccctgcggcggaggtgagcttagttcccccctcccctcttccgggacctggggggacggggcggttttagactcctcgaggtagggggcagttcccacgggatctggctctgaggctcggaggtagccgctttggagagcctttgggaaaggctgctgaagggccagactggcggtagcagcagccttcctcgaacccctcctcctctcccctcccccagtcctctgcggcctccagcagagagctagctgcatctttggggacagcaggacagcggggaagcagcgaacagcgcgcaagagagcggccaacagtggggatgcgaggtaccggcattggccctggcctagtggccctagaaaagaagtaaaggcccagccttcagtttttctcttaagggttggaggaaggcggcttcaagaggaaaaggaaggtgaggggcgagcaggcaagcttcatggtcactactaggcgcgcgcgcgtgcgcgtgcatgtgtcctgatatgtatgtgtgtgtgtgtgtgtgtgtgtgtgtgttctgatatgtatggtgctgcaggacacacattcattttgtttcattgcattaatttttaaaactattttatgtatcttagtatatcacagcattcaattgtgtcccatttttacatagctatattgtatgcttggactacagtttatttaaccgtttcctgattgttgtacactagcttgttttctttgggggagagggggctattgcaagtaatgaatgggcttgtgtatgtttcgtgcacatgtacgaaggtattcctgtaggagaaattcttcgagaagtaatagcagaatcaaaacgtgtatgtatttcaaatcttgatagatttatctaaatctccttccccaaaggccataataatttacactctccaacgtagtacgatattgcctatttttccatagctatgccaacatgaattgttacttatctttatatcttttcagttatacagtaaaaaatcacatgtcgttgctttcattttactgctgtttgagcatattttcatttttctaattacaaaagtcagtagttaaatatgaacagtcttgtatataagcaataaacattttgaaattttaataccaacccccccactctaaatttcaagaaaaataaaaatatctggaagtaaactataaaactttcaggaatacaatggaagaacgtttgcataaatggagaaggaatatcaggcttctgcataggaagcctctattctgtaacgatattcatttttctatattgattcaagcagttgatgcaattccaataaatatactaagtttttggaacttgacgattctaaagtttatgagggggggatggctaagaataaccaagaaaatgtttttaaagatgggggtgcttgtacaattaaactgtactctgaaggaagcatgtttaaattagaatagacagaacaatggattagaatggaaaagctcacaaacgggccagactggatcccgatttattggagaaacattgttggttagacatgcaaaaactgccatattaaaatctccaagcgcctttctccccaccccaagcttgaatttgcttttgagggcagacgcctttgtttggagaaaaccactttattgggtcttttttgttataaggtaaggaaagcctcaatatttaaaactggtgactccggaggtagaactaatgatatgagcttttagtgaaaagatggattcaggttagcctgcagtgcggcgaaggaagaagtatggatattagaggtctttagatttttccccccatgttttgagcacaaaaactggtgtgtcattgtttccatttgcatttgtgtgtttattgtaaattgaacatcttttatgcgttagttaagactagcacgttattcctcgaggcaggtaacaatgggaacccattcttttcgctttcggaatggagtttggctaattggtacagccctgctggaagcgtgagaataaacaggttgactttttaagcactaggcaggctccagacacctaaatcgggggcggaggtagttttcaagacatggccgagatttggcgctgagctgtgtcatcgcgaggtttggtagcaagctccgcagtgggtcggaaacctcgtggtaagcgagatccctaaaggacgagagcttcctccctttccccgaaaaaactcccagtcattttcacgaagctccgcctttctcctttttaggagcgtgcacctggtctcgcgagatctcatgtttcctaaaggcgaggcgcgggcggtctcctgcggtgaattacgaaggtctcggcgaggctgaacgtaatatcgcgatagttcctacggcgcatgcgggagccggcggcggcatgctggctccgccccgtagtgctccgtgaggttgtgcgtcatttgcttttcgcttcgcgtggggtgagagcggagcggtggcgatttggggtttggtggcaagcgagggttgggacgggctgggctcagtttttcctggtccggtggaggttctcctgggatcacgcgaaggcggcggccgaggttggctactgagtgcaggagctgcggaggcgcgagcagcgtcttctggtgctgccgttcttagccggtgagttctcgcgggagcagggttacgtcctcgtggggattcgccggcggtggcggagataccttgggggtgggggggcagtgactagggtcgggccgcctgttaagatggcggcggcggcggctgcctgtcttgctcttacacggtaccaaggggttagctatccgcgtttgtgacgcttctcaggtaccagacgttaaggagatgacgaatggcgaaacgtcgtggtgccggtaaatccttcctgagctgaagaccatcctgtttcttaccggttaaagcgacaccatttcccccggcctctgcctcgtgtgggcctgcctttgccccaccaatcgctcttcgcctctgttttcgtcgtcgcagtgggcgggttgggaagtgcgggagggagtccatagttcattgggtagtgggctggggattagattaaaaagtgggagagagggacgcacctaagattgttctcataattattgcgcgcttgctgcttctcagcccttgcagcgacccatatgaaacccctagtttttcttgatccgaggtgggctctgcttccctgctcccgcggctttcgggctaaggtttgagaggtcaatctgtagagtcattagagtaccttccctttcccaaattctgtctccctgtcaaatcgctcagctacgtgaatatcgggatgcattattaaggggagaagttaaaaaaaatcctatcactcctcctctgtagtcctaatttagagcctagcctgaatcatctaccctgtcccatgtccttccgtggtgcttttggcgcagatgttaaaagagcttatcttattccctgcatttactccatctttgtggatggatcagcagtaaccttccattttcctaggtcctcttgcttgtttatccctgacgcggggacagcgtactgatttcttcaactttgaatgttttgagaccatacttgggcagaacaataaacgggtcagtggtcggataattgcagtcttagtggtctccttcgtgcccccactaggtgaaactttgcctttccaaccccttccacgctacaagctctgggacccgccccctttcccgcctatgtttctgtagtctgctggtctgtatatctttttgttttgttacagctaaccaacatttaagaactaagtctcacttcttaatccttatatttctctcttaactgctcttcctcccacccccaggagctgaatcccctagcaaggtgtcgacccccagtaccttttccttcctccaggagttttacccctaaaacagtcacgctccttttaaatttaaatttacttcctttctcctcaaatcacttctattatagacaattaattccctatcacgtgtttcctttgtagataacatgatttgaattactttttatttagcaccagtgttgcatagattgaggagatgctgccaacatttccaattcataggaagcagcctgatttagaaagttagtgtttgcttccagttcacattgaactcatgaccttgggcaaattacttttcagattttgtttgtttatataatgagggtagtaatgcttaccttgtagaaaatttgcctcagaaagtttgggtgcctttttaatgtgaaactgtattggtagataaatgtttttgtgccatattctacctttatagcctggtaaggtttttaaaaattgttatttcttcagctgtatttttctatgtttaggaataatacctattcgctcctgtctgcttttaattttttcctcataagccactttgtatgatcagtggttcatgtttgaatatgttctcactatttgaagcttctactggtgtaagacttttgaatgcaaaatcattctcttggaatgaccaccagctatgtttcggtcatgaaccacacccaagtgttctaccttttggaagggagtgcctcatcccttgcctactcatttttgccactccttcaaatacagtctgtcctgtccttcacctcacaaaagtcttgaaatttcatgccattgccagtttgcagtgttaaagagaacttaagcttcaagtgtttttatttctttctctttacctcatttatttctctttacctctatcatttttagacaaactttgtctaagttgggtcagtatggggggcatatttggcagtctttttatttaagtaggataatacctatatgcaagacattaggaaggttgatctaattaaataccatcatttccccctcaaaggcaaccacagatgactctttgataactacctcctgttgtgcttttgccattttatattttctaacattttactcggaagtagtttttcttactactatatttttattagatcaacactagagtggtttttttccttaattatgttggttgggtgatggggttcaagtaggaatatagttgcaagaagtatactatcattgacattttagtgggtaacatctgataattaactatttgtggatttccgttttgagcttcagggtttgagttggaagtgctttaggaaaatgaatttcctctttcattgaaagacaggtcactttattttgagactcttgtcttgattccttttacagtgggttaagcaataatcactaactcttgtcctttagaattatactaaatctgggaatgatgatcaaggcatgacctaaaaggtttaatttattctaggtagatctctgagaagagaggaaggagtggcagtaccaaataaaaactttgtctaaggttcagtgacaaagttcaacctgaatttccaggatgtttatcgtttgtctcccagtatggccaaaaagcacttatgaaggtgaaaaataattttaatgtgtacagctttttcttttcataaaatatgttttccttagtgtcagtttgttaaacatgctatcattttgtttgagttgaaaacagttttcaggggtattgtctaagtgtcactagaaacactatacagttctttttcagagtgtttagttactgctcaaagcaggttctaaaaatgcaagttggcatttaagggctattgcttcaaaaataactgattgtgtctattgatacagtggttaactacccaattctaatgaataatatacttcttttccacaatctttttttgtaggtccttcagtagcctgacctgagtgttagtgcttcagaggaacaaaccagtagaccagaacttggtcaggaagtttcaggaagctattggagcagtgttgggatttcccaccaggatgactatgattggctgtgattttaggttagttttttttttgtttttgttttttttaagatctttgcggttggtatttgtattttacatcttgaaatggagatggggctggaatttacattttttgcttgtgctgctttggttccattatatgggtcaggtttgttttatttttttttttaaataattttattggatggagctcattagacaattaaaaggaattgttttaaatgtatattgtcagtgcatgattttcacaaaatttgaaacataactgagtagtatgttgtctactcccccaggtatttttaacatttatcaactttagcctttttagttttaccctatggcacccccctttcccatagaattattttgaaataaacctctcttgatgtgttatttttatccataccaaaaattgtatagatattgagagagttcttgacagtataacccagaattcattttcagttgaagaaattgaaaatttaaaggtagaaaatgggctcattttaaaatttccgtgatattttaagtttgactcatgatccagagaaaagtccatttatgaaatagtttatgtagactttaagtctgttttattcttcaggttatatttctcttgtttttttttctccaatttatttgttaagtcctttttgcatttcctcacatttgaaaattacagtctatagtgatgtctagctcattcttgttaaagaccataggtaatctattataatgaaacaataatggtagtaatctcttatgtgatctcttaggtgatactgctggcttagttggtatactaaaatagctagtcatgggttcctttttctgtggccctctgatttgatacctgattttagttttccatatgaaatataggccttctggaagaaaaagttttttttaatgtgtatttgtaatatccttaggttgttttgttgtttttatgctctgttatcctagattctctgattcagagcttagatattaagaactggttgatgaattattttgcttgtgcagtgttagccattctgggtctgtactatggtcaaaaccagaaaatgagagttgaacacatatccttcagcctccagccagcctttagctcatacacaaatgtggacagagcaacggtttttgttcctatctttaaaatagtaagaactgcaagttaaaggaacagaaagtagaaaagtcatgaatgaaaaattttgaattatttagataaatacgattatgaatcactggtcaggtgttcaggtatttcagctgtgttcatcattggagaaaatacgattatgaatcactggtcaggtgttcaggtatttcagctgtgttcatcattggagaaataagtccctgtttgaaaattgattaaatattaaaggaattttggggagattccagcaagctcatgctttcaacagggaaaaaaaaaacgagcatgttagatatagtgattaaatattaacacttaagttcttatagtttaagcaaaaccacttagacccaaatcctattttatgaaactaggatgactggtacagaattgtgcacagtagacattccaatatttgaatcacccccttcttaacactggaagttcacaatggaaacagtgttggctttttaattctccttttgttgtgtgtttttagccaccagttcaaagtatcattgaaatgccaacttggttgctttgaaaatatttgcccttcacattccacattgcctctcatggaataagattaagtttctaagtctgttgtgtagctgtgaccatgttggactgctttgcagtggatcacacggccagacaggtcacaggtgcttgtactcttaggattttcttgtattttttttttgaccccttcaatgactggttaccaaatgtttatatatgttaatgtcagggataattcagctcttaagattctctggaagcttcttagttgatgtgtcatagaggttgagtcggtaaaacttgatgtacttgttgaccatcttggttttctggttatagaaatgcttttaatgaaggagtggcactctgaggaaaacaagtttgaggtgttaacctaatagtttccaactttgagtttcttaaaaaagtagttcaacggttgtcttttaaaaatcataatggtgacatggaaagtgattttacagaatgttggaatttgtgcttttatgaagtactataaaatgcaagttgtattataaatctgattcagctgattgaactaggtatatattcatcttagagactttgttcacataatcttaagagttgaaagaaagcagttttacttttttaatagtgataagtagggctggacagatggctcagtggctaggaaatgcccttccagagatcctgagttcaattcccagcaatcacatggttgctcacaaccatctgtaatgggtgtatcttctgatgtgtctgaagaaagcaacagagtactcaaaataaataaatcttttttttaaaaagggggcggggtggtggtgttggagatgtctcagtggttaagaaaactgattgctcttccagaggtcttgagttcaattcctatcaaccacatggttgctatcaaccatctgtagtgggatctatgccctcttctggagtgtctgaagacagtggcagtttactcacatacatggaataaataaaatctttttttaaaaaatagtggtaaataaaaggaactaaaagtaaaaactagagggagaacttaaattttttttgtaatttaaaattaaaaagattagggcctagagagatagcttaccagttaagacacaggtttggtttctagcactcacatggcagctcacaaccatatgaaattgcagctccaggggatctcataccttctactgacctcttagtgcaccagatacacacatagtgcacatatacatgcatgaagtcaaataaaatattcatgcaaataaataatttttaaaaacctagaaggttgctaagtgcagatggactacaatgaatcaccttaagcaactcaggttttaagttcttaaaattaagcatattgtatttggtaggtgcttacattttggaacagtttttagagaaagtttttctatggttgttatttgctaaatttatttatttgcctattttttaattgaagtatatactagtctttgctagtgtttttccatacacttctcttttcctcaccccaagttggttttatatgtttgtgcacagatattggtgatttagctttagctttgagtagctgaaactacaggtatttgccactgcaggaagctctcctttcactgttacagcattctaggaattgagtttttattggtggaaagacttctttctatacaatgataaagagtattccctcagttcaagttctgatccaatttctttgtttgtttttgtttttcgagacagggtttctctgtacagccctggctgtcctgggacgcactttgtagaccaggctggcctcagaaatctacctgcctctgcctcccaagtgctgggattaaaggcgtgcaccaccgctgccctgctctgatccaatttcttatctgctgtgtcatctcgtacaaattgacctctttatgctatagtgaagttgttcctttataaagtaatgattgaggccctttgggattgcaaactttatatgccccagtacaagggaatgccagggccaagaagcgggaggtgggggggacagggggagagggggtgggtatagggaactttcaggatagcatttgaaatgtatataaagaaaatatctaattaaaaaaattaaaatctggagtgtaaaataatgattgttacctatcatcacataggattttggataagttgaactaagtacatgaatcattaatagtaaatagtggctttaaaactttagggaacatcagatcacctagaaggtttattaaaccagattgctgtatcactaatttttgattccataatttgatggggaatagattttgcatttgtgggtttccaggtgatagtggtgctatcatataattgtagttggtgcagaattttatctacttctgtttctggactgatttctcagagagtgaaacactttactctttagtcttatttactgtcaccttcagctaaagtaaatacattctttgagaattttacatgtgtatacaatgcattttggtcattaactaaccacccagttcctgtcccagtttcatgtttaaaaagtgattattgttcttaatgtgcataatgtggatcatgtgtaacttaccaatgtccacttttcccaaagaaaaatgactttccctctacaatggccgttggctgccagtggctcctcaaactagggtgtaggtcttgcgtgtccttcccctatccatgctagaattttgattagcttgatcttatacagacaggtaatcacagctactgtgagtttacaagtgcaatggaaatatcgtatccagaagacattattttaaggcattttcccctgtcctctggcattaatgttctttctgcctcttcctatttcctgagccttgcaggtttttttttccaatttcctttaatagggttcaaacctcttctagcccaccacccaccagaggtagtagaagagaaaagttattacaacatgggggaattggatctctttagaagtagttgtttgggggtgagtccaatctttgttgtctggataccagccgttcagtccagtagggaagaccaaatataaatcagcagctgcggtctagtctacttggcagtctccatacaggaaccagcaaggggagttcaatccagaagaaagcacaaagcttggcaacaggaaggtctctgcaaaagcaccaagaagctgcaggaaacctcctcgtgggaagttctttgcggggaaggcggtggctgctgctgctgctgctgctgctgctgctgctgctgctgctgctgctgctgctgctgctgcttcttcttcttcttcgttttttgagacagggtttctctgtatatccctggctgtcctggcactcactttgtaaaggcatgcgccaccaccgcccggagaagttctttggagagcttctttttggtatggagttcaacaatacaatgtaaagcagagcaaagcaagccaatgcttgagctcctactgttggctcctatttatattctttctgaacatcatgtgtcctttcatgcatttgctatagcaatacatcctttaatctctgttttctttagcaaaacatcctttcacctgtgttccccagcaaaccataactgactttccaaagaagccagaagtttccacttcatggttaatatagatttcccattttaggcctgagcacttagtcacttagtcttcctgcattaactagtcactgcaaaaaagaagtttctctaagattgagagcagtttatttagtattgccttcagctaaaagcagttttgaaatccttactttcttgcacaatggcaactgggtccagaggtgtgataaattcaggttcgttccctttggtaaacatagggtatatgttcattcatgacatcgtgttttaatgatgtgaatctttttaattcattaaatcattgaggacagtgaattgatgtttcaataacaacattttgctttttcctaatattttatttccccttatttcttatttggttactcaaatacatagttgatgtagaacagacagaatgaacactcagtttttgtaccctaaaaataaaatggtatgtgcatgtgttttgtatgtgtgtgcatgtgtaagctagccatagactagcattaggtatcatcattcctttgctgtccacccacatttacttattgtaagttttgaaataggatcttctatgccttctcaatgctgagattatatgaacacccagttggtttggttttgttttaaatgtgggttctgaaacttgggtccttgtacttgcaagtaagcatattactgattatcttcttagttccttctctttttaggtctggcctggaattcactatgtagcccagcttggctttaagctcacagttttatcctcctgcttttgttttctgagtgctgggattaaggtatgatctacactcagcttttttctttctaaacatagctttattttaaaaaaatgcctaatgcctttatgcagtgtacatgtgctttagtgtatgcaatgtacatgtgcccatggaggccagaaaagggtattggatcctttggagctgtagttacagaccactgtggttcttgtaaccaaactccagttcttgaagagcaggttgctctcttaataattgagctgtctctagcctctaaatacagcctttgatatgatgttttggttccctgctagattcagaaggttatgtaaatgtgtatacctaggtactcatggatataaacattctgaggctaatgttttaaattcaaagtgtccattcttctaactaggaaaattctataatataaagttgcgttttgatttttcttggtataaaccctagtagtcttgggtagtttccttactattagtatgtcaggttattttaggattattatagatttcttccctagagctggaatcaactaatgtgataagacaaaatgtgagattgaaggaaattttctctttgccatggtaagagctttgtacccagtctctattttccttttccacttcaccttcccaggttgtttcattattggtcctacatttttttcctttagtaaaaaaatttttgctagaatttaaggggaaaggtttgtaaaatcttgataaaagtagaaggcatagagtgcaggcagttctagatttgggactttccaaattacagtttggctcagtcaacttcttgtttcgtctttggaaataccttcatttgttattggaatcagttttgtggttttaatgtactgcattgtttgccatgatcttccccttttacatggttctttactgttaattgtctttctattcaatgttctgccacaaccttattaatctgtggtgagagtccttgcaacagttaccagtttcatcaccatgttagaaaagagttattcaatattaacttctttaaaaccatttattttatgtagtatctaaattaccatgtatggttctgtaagtggaaactgttcttgtttttgtttcttgactatttggtactggctggccttgagcatgtgattctcctgcctcatccttcagaatgctaagattccaggtgtgcattagcacacctagctctgttcatttttaagtaatttaaggttttcgttttcattcttgtatcttgcctctcttcctttagttgaatagacataggttttctaattctcgtgtgcttcctcagcctctaagactgttatgttgagaaaccctgcaattgtcttctatgagtacagggtaataataacaagtgtttgggccaaggtgagagttcacagtgatacattcaattgctattactgtgctagtttagtctttggataaacctgtatctggtcttgaggcctgtgtcctgtcttttttagctgcctgcttccaactttttccctctttccttctgctggccctaaaatgcatgtacataatagtgagaaacagtatgcaaattaatatttgaatgggtctaggctattttactaaatttatattacttataagatgcttatcaaaatcctacacttacatgtttgtgtatgtacaggtatatataaaacttaaaatgtactttataggttgcactgagcctttaatatcatgatatgtaataaaattatgtaataaaaaattaataatattttaaggtactgcaattatagagtactctgtaaagatgaggccattatagtttatgtaatggctatgtcacttagggcaaattgagttagtttcctcaccctttaaatgagggcaataatatttatgcaacaccttttttctaaggatgtactcattggtgccacatagtggagatacaaaagatgagcaatccggtgctggtaagatggttcaacagtttaaaggcaactgttagcaagtttgatttctatcttaggaatccacatagtggaaggagagaactaacgtctggcatttgttctctgacattcatatatgcaccgtggcatactcacccacattcctatgtagaccatacaaaatgtagtttacaaagataagcaacagaaatggaacttgccgggagatttataaatcacactgaaatgctagtatgaacagtgggaggaatgagcaaaatgttacagcagtttatagggaaggtggagggatggactgagacgagggagggaaatctgcagttgaatgtaatatatgagagaaaaatacaatgaataaaaaaaatttaaaataatcccattactatgaaaaaaagtaaagactagcttcatgggcagcatagatctgtctacctttagaagacaaattatagtcatgtgctgtctaacaatatagtttctgcttgtggtttgttttgagaagataccttatgtagcccagaaactccctgtatagttgtcaggaatgtattctgtagtggaaggtgacattaagatttctgtaattgaaacattcattgtgcaagactagtttattgttgctggtggtagagatcagtaatgaattacagatacagaaatttatattgcctattgatggtgaaagattgtattaatgacatttgtagacatttattttaggatgtttccacaataatgaagtttccctaatagtgcatttcttatatttctgttaagggattcattcaccagcagcttttaaatagtaaaatcttctttatattccaccagaaaagttggaacagagaacttattatacatatcagactcattttgtgggcccagatttaagggtaataactggctatagttattatatagtcatgtatagtatatagtatagtggtggagttaggcaccaagttaggcacaagttaaacagcccagtactgtgccactatgctgtaggtttcctttaagcaacttgcttttatttctaaatgtgttaccaggtgtcatctatgaaagtacagaagtttcctcactgggggaaatttgacaaaaaaaaaaaaaaaaaaaacttaagtaaaaggcaggactccaaagaaagccccccacctataaacacacctttgacctacattccagtatgagtccaatttgtagccttttaaaaacatttctattctttgagaatttcatacagtgtattttgaacatttccactgtcatcctcttatgggttagcctaatttggcaggtttttaagggtgtttttgttgttggtttgtttttagaaggaatttttgttttgatagtctcattttagcccaggctgacctggcactatgtagctgaggctagcctcaaacctgtgccaatcctgctgccttaaagtccctaatgtttgaatttcaaataagagccattatagttaactcttttaaagactttttaaaatttattttatgtatatgagtgtactgtcactatcctcagacacatccgaagagggcatcagatcccattacagatgttgctgggaattgaactcaggacctctggaagagcagccagtgcccttaaccactgagccatctctccagatcccacagctaactcttgtctctgttttcacacatatgtgtggacactgtatgtcaataagtgggaatgaatgtcgatccataaaacttaagtgttttctgaactgggaatgtagttcattagtggagcacttcttttgccccaagtcctggatttggtgtgagcactgaaaaagaaaatgttttcaaagcccatttatttctcaacttttaaattgtgaagtggtatatttgctatttagaaaaaaatgcatatatcagatgaactttgtttttacaggcttttttgaccatttgcttttcttttgttcatttgaccatttggatattaatctttatcagataaatagcaggcaaagagttttcttccattcttttagtgttttattctaagttctgtttgctgtgtagaaacttatgatttcccatttgtcaattcttattacatccagagttttggttgactagtaatgtactataatcatactcagttgttgattcctacctagttgaccctgaatcagagggtagtatcaactgaaaattttggttttgcatttttgtgtatgtaagtaaaagcatgcattttaaatatgtggatgttttgtctgcaagtgtatttgtgacttgtttgtgcctggtgtctgtggagaccagaaaagacattggataatctggttctgagctctaatgtagatgctgaaaatgctctaacagtcatcctgagttcagttcccagcaaccatatggtggcccacaaccatctgtaatgggatctgatgccctcttctgctgtgtctgaaaagagctacagtgtagtcatatacataaaataaataaataaatcttaaaaaaaaaaaaaaaccagatatggtacagacccaatcattcagaacttctgagggaagtgtcaggtaaatggtatgtggattgagggtaaaattttaccttgagagaggtgtcatagtgaggaggtaacatttaagctcaacttttagggatattcaggagtcaacttttcaaaagtcttgagtgctagggaatgtgaaacttaacaagaccaaagcatgagaagaatactatataatgccattttgccattaagagagagagatgcaggtcttgggtgctgctttagtacttatagttagttttaggaatattgctttggtaataatgtgatgatgggattagagatctggcaggatagagccttaatttagcatacttttaatatatagagatggtacaatgataacctatgtacctgccacccagctactaacagttaaaacagcatgcggatgtggttttatttatttataccctactccctctttcagttattttgaaacaggtttctaagtcattcatggattggcacagctctcacggctgatctgtgtagccaaatctgtttatacagcttaaaaaaatgtatgacagtctccaccccagaaccgagtttggtatttgtgtaactaggtattttcagtttctaaaaagagtttcaggggaactgagtgacttgatttctgccagattaaaatactttcctgaactcattgatttatctgtaatgaaatttgcttgttaggtatggactggattttttcccaatttttttattaggtattttcttcatttacatttcaaatgctatcccgaaagtcctctataccctcccccctgctcccctacccacccactcccacttgtttttttgtagacaagtttctgaaattttataaagaatagtagtttaaaggacaatttcttaattttcttttggaagtggacaatggtgaagaaagcacttataatcttagaaactggatgtgatgaatcatctttttgccaggcattggtggcgcacgcctttaatcccaacacttgggaggcagaggcaggatttctgagttcgaggccagcctggtctacagagtgagttccaggatagctagggctatacagagaaaccctgtctggaaaaacaaaacagaaaaaaaagagtctttttttaaagatttgttttatttatatgactacactgtaggtgtttccagacacaccagaagagggcattagatcctttacagatggttgtaagccaccatgtggttgttgggaattgaaatcaggacctctggaaagagcagtcagtgctcctaaccactgagctatctctccagtccgataggtagttttgtttgtttgtttgtttgtttgtttttgtagagaaacatacatgcttttttttcccttttggttttttgagacagtctttctcagtttagccctggatgtcatggaacttgctctattggtcaatctgacctccaacccatagagaaccacctgttcctgcctcctaagtggtgggattaaaggcgcctggggggagcatacacattttatcttgagattttagtatattcagattttgtatgagacttccaagcaatgtctgcaaatgagtttccagattttggggggggggtgagtaaaggctgcttgttttgttatttcattttactgccaggtcatagatttagctgagcaatcctcccatgccattttatgtagctaaggatagggatactggtgcctgtagtgaggggcggtgggagtggttggtagtttgaatttgcattcttatccctgcctatagacattttttgaccttagtaaattggtcacagtcttcatttctcaagctgtcatgagggttagatattaatgtgtgataggtaaagtcttggctgtatattaattggaacttaggtcagatagagaaaggcttaaaaattatgcttagtcctccttcaggcaatcagtgatgtctataactctgtaatcaatagtgaataggctggggttttgttgtgtttttgtttgtttagtttggtcaggaattctaaaagtgatttttcttttaaattttttgagactatgtctacaaaatttcttccttcccctttgtacctccaaacctttcagataccttccctcttctttaaattcatactcttttccttttattaaaaattcttttacttattttatgtatgagtacttttgtcttcagacacaccagaagagagggcatctgatcctgttacaaatggttgtgagccaccatgtggttgctaggaattgaactcaggacctctgaaagaacagttggtgctcttaaccactgagccgtctctccagccccatacagtctcttttcattaatttttttttgtttgtttgtttttgttttggtttggtttttggtttttcaagacagggtttctctgtagctctggctgtcctggaactcactgtgtagaccaggctggccttgaactcagaaatccgccttcctctgcctcccaagtgctgggatcaaaggcgtgcgccaccactgcccagccattcattgtattttttttttttatttcaaggtgcatcttattgctttctgacatggtcagtgctgttcctacctaaattttctggttagagaagggcaagaggcaaaaagtattaagtatattcttttatgggaatttgagtttagtgttctagttttgtttgtttaaatgttaccacagtttcagttgaaattaattaattttgtgtactactttgcctgtctgtctgtgtctgtttatggaacctttcacataccaatagaaaattcagtactatatgtcaaggtttggacacacaaaacaactaatctaaggcatttgtaatactgctttaaatttggcccatgttatttggctcaggaaccactaatcttctgtaatgaaaataattacaagcgatgaaggtttgttataagtgaatgtatgacttacagaaaaatggaaggatttgaaaaacataaagcataaataaaagtatgtattttttctaccatctagaggcaagttttaatttttcgagacaaggttaatttaaacagccttggctgttctggaactttctgttgcagattggcctcaaactcacagaactgcctgcttctgccccctgaatactgggcttaaaggcatacatgtacgtcaccaccacctagttagaggcaaattctaatattgtaaaaatttttttattccttgatagttttatacaatgccattttatcatattcttgtactccttcctgatccaccctcaccttcctccccactcaacttgaaatgtttcttttaacactcattgagtctaatttgtgttacccagctacttttgggagtggggcctatcctggagtgttgtcaacctctacccacccaccataaaagaaacctgactctcctagcagctatcaaatgccaatagcatctcagttagttggtagagtttcatgtctacctcctactattcattttggtattttgtctgataggagcttgcgcatgtcttgtgcgtactatcttaataactgaatccctgtgtgcaactgttctgttcggtgggttttttgatattgttttgtttgtttttcaatgtactcaccctgtggtagatattttctcattaattgtcaagggaagtggaaatttcctagtaaagatttaagagtttaggtagaatatgatcctagtatttgtgctattcaaaactcatggaagtactcattattatgtgaatataatgagaagcttaattgttttgtacccacaactgtcacaggtactatggggactctttcagttatgttagctttttcagtgagttttgctatgtcatgcagactggcctccaagtcaagccaagatccttctgtcttggtgctgcattttctttctttaattcttttcttttctttttttttttttttttaaagatcaggtttctttttatggccttgaactcacagagatatgcctgcatctgcttgctaagattaaggtctatgccactatgccagtcttgtccttgtgcttcttaaaatttaatatagaaaccatctaaggatcttaactaaaatacagattctggtttttcacttacaagtgggtccagaaattcatcagtgctgcttatccttggaccatgctgagtagaaatgctatctacccatgcacgcaagttctattgagtcctatttgagaactacaggtgtcctcggtgtcatattctctctctgtgtgtgtgtgtgtgtgtgtgagagagagagagagaacgagaacgtgtgtacgtgtgtgtgtacgtgtgtgtgtgtgtgtgtgtgtgtgtacgtgtgtgtgtgtgtgtgtttgtgtgtatgtcagaggacaacttccaggaatctgttatcttccacttaagtagtaggcaattcttattctgtctctcactgaacagaactgctaggattataaaaacaatactgcacctagctttttgtgggttcagggatatgaactcaggctatcagacttctgtaacaagcacttttattcactgagccatctctccagctccttactccatgtactttagctgtatacacttgttctggatgtaaacgaaatttaaacttcaaaggtaaattaaggttgggagaatgatgaagtggaaaaaatagatgattaaataaaagtatttaagtagtagcattggtggtggttaataataattcttctattttctttttttttggttttggggtttttttgtttgtttgtttgtttgtttgttttgttctttggtttttcgagacagggtttctctgtgtacccctggctgtcctggaacttactttgtagaccaggctggcttcgaactcagaaatccgcctgcctctgcctcccaagtgctggatttaaaggcgtgcgccaccacaccccaattcttccattttcttaatagttctatcttctcaagcaaaatttaagaagaaccacttgaacaagtttgatacttataagcaaaacatttccagaattttgtttttaaaaactatcttctttttgttgggaatttctatgtaatggagtttttatttgtttggcctctaagatagaatccattccccaatcactattctctttatttgtgacactgtatactagttaaaatttagtctctcaagattcgctaaccaaacaaggtgctgattttcctgtgggcctttttttcctggaaatagggacaaattgggctgaaagaatatttgtgtatgaagtaataatacatcaagtctctaactgacatgtttcaaagtatattctttagaatgcttgaattgttagataccaaataagcactacttgaaaacactgttgtgtgccttccttaaataaagttgtttttagaatcattaagtatgtctgtcagcctggcagggtacttaaatgctcataacatttattttaaatacaggatattgtttggcttatgatgaacactaagtaaatattctccttcctgttataatagtaggtttgaactgagaacagaacttcagaattttaattgatatctcaaggacatactatctttcatttctttttttaactgttagtatttcttgcacttgagtgatagaaaacagactagctgttcactggttatagggagcatttatttgttttggctcctcatgtgtgttggtgagcagcatatatcagatgctcatacttggaatttgggacctgagatgatttacaggtctttctgcttcgaccagcatctaaagtctggtattggcagcagaagcaccccaactaaactgcttttgtgtccctcccttggatatggttacctggcttcccttaaattctaccattttccgaatgtagatgtaggctccttccagttctctgagctactagatactctttcaataaattgctttcccgcattacctggcttttatgttgtccttgacacttgaataatatagtatctatagtcaaaacagttttaattagagccagatgcttatttctgggaatattttaccagtgatctcatctacagtttttggtaaataacagcaaagtggtcatatatttattttatttagtgggtaaggtacttggtactttgttctttggaagatttttttaagtggttaattcacatagaaattgaacagtattggcatgtatctttagtttcagcacttgggtggtatgtggatctgagttccaggatagttagggccatgtagaaaaacatttgtctcaaagaatttgtatgtccccactgtaaatgattccacattatcagcattcctttactagaatggcatatttgttacagttaatgaatcatccaaagattatctatagtttacatttgaatttacccttggcattaggaatttggggggtcttgactatatttaaaatagcatgtatttaacctatcgtatggaatgacttcactgtattaaaaaatcttatgtactctattaactaactcctggcaatcagtagtctcaatattttcccagaataccatataattagagtagtctgttttgtttggtttgttttaaaatcaggttgacatttcgattgttcattttctctggagatccatctgcttctgtactgagattaaaggctctatatctggcctttcagattgacttcttttgttcagtaaccagagatttttccacatctatttcttgatagctcatttagtactaaatattcctttgtctgatatacaccaaagtttgacagttacaatgcaaataatatcttatattttatgaatatgcttagttctctaaagccattttagccatcttccaggcaatctaagggacttcttattctacatccttgctaacattctgatgtcagtgttctgggtttggttattgtaataggcatagtgaaatctcagtgctgattatcacagtctcttgttgtgtagcatcttttcattagttaattttctatctgtatatcctctctggtaaggtatccattaaaatttttattggtttatttttgttgactttctctattctttgtgttttttggtttttttggagacagggtttctcttgtgtagccctggctgtcctggaactcactctgtagaccaggctggcctcgaactcagaaatctgcctgtctctacctcccaagtgctgggattaaaggtgtgcgccaccaacgcctggctttctttgtgtatttttatatttttaataattgttttctatgtctttactctgtcttttgctactttggattaaaccaagcacttcatcgtgagccatgtcctagttaccttgatgccttttttagcaaatattttctccatgctagctagctttttttttattcatttaaaagagaatgcattaatatttttttcttggatggatacccttgtttataatttgaaacatcgtcaccaaaacctgtatcatctaactctttttggagatgtattattttacattttgtagataggtctatgatccattttgaattgccttttctgaaaaatgtggaattttattgttttgtcgtttttatgatgcatgtgggtgcacagctattccagtaccttttaaaaaaaatctctcatgcatatattgactttgattctttgtcagagttgaccaatttatatggggctattttagggcttcattttctgttccattgatttgttcttccccccacccccattggctagtaccgcattaatgatctgtagttttcctcctagatctgaacatatttaagtattcttaagctgcttatataaatggtattcatttcaaatccagttgttcatggtagcatatgtaagagtaattgatacattaaccttgtattctggaggtttcaggagggagtttttctttgtggctattgggtgtattttttggattttctacatagatgaaatgataagacacattccaatctatgtgtcttttacttacctttattttggacctcccataaacaagtattttaaaaatacttaaaaataaattaatagaaaaaagtgagagatctcaatcttttgaagcacatcaaggtttcaaaaatctgccaatccaaaaaccaataaatggcaaggaataaagattagggaagagattaatggaataagctgaaagaacaatacacaaaaatcctatccttcaccttgcacattaatcagctagaaattgatcaaagactttaatcctccaaactcagtcagaaacatagggaatacccttctaggcactgggggtaaatagcaagtttggaacagaattttaagagcagagtaactgaaccaagtatcagcaaactaaatatgtaattacagagttgctacacagcaaataaaattataaagaaagcacattgacagcccacagagtgggaaaaagtctttacaaggtatacttcagataaaaggtttatattcagatttactgagaattacgtaaacactaagcaaatacaacttgcagtcaacatctgaatgatgagattgagtacgcagttttcagaagaaacacaattttgtaagtagatttttaagcgatgtctttaccttattctatgtgtacgactgtttgcttgtatgtgtgtatgtgcaccatgcacacccagtgcccttgaaggccagaagtgagccaagtcccccggagttacaactgtgagctgccatgtgggtgctgggaactgaatccaggtcctctgcaagagcagccagtgttcttaacctctgagccgtttctccagtgttgaaacacaattttaaagtattcacatcccagccatcaaggaaatacaaataaaactactttgacataccatttcactcaatgaggatagctacctatccagatgtttgagggaaaggaaatagggaaagaagaatgaaatagggtacttcattcccaagtaccagaagatagagtaaaaatacacaaaacaattatccaattattcattgctggttagcgtgcaaattaatacaactaatatgggaaccagtgtgggagtgcttcaaaaaattaaaaaaacactaccggatgacccatcgttccactcttgaacatatactcataactccatatcctaccgtagagatatttccactcccatgtttattgctgctctatttattattccaaggaaatggaatcaacttatatgtccatcatgatggattgatggataaatggataatgaaaatctggtacatatgtaaaatggactatttagtacaaaaccataagatttgctggaaatggttggacattgaatgttctgtctgactgagcttgggggattaaattaaggtctttgatcaatttctgactgattaatgtataaagagaaagataggaatctaattttatttgattgttttttttttttttaaataaatctttgtttttttttttttaagatttattttattgattatatgtaagtacactgtagctgtcttcagacacttcagaagagggagtcagatctcattacggatggttgtgagccaccatgtggttgctgggatttgaactccggaccttcggaagagcagtcgggtgctcttacccattgagccatctcaccagccctgattgttttttttaatgtattgttctttcagtttattttattaatctcttccccagtcttcattattccttgccatttactggcttttgaattgcagttttttagaaagccttaatgtgctttgttagattatttatttgagatttctcactttttattttccattcatttattaattcattcaccttacatcctgatcatagtcccctgtccccatttcccctctcatagtcctgcctcacacatacctcattccccttcacctctgagaagggggaggtccccctctgggtactaacccaccctggcacctcaagtcactgcaggactaggtgcatcctcttcgactgaggccagataagacaggggaataggatccccaagcaggcagcaggcagggttacccacatcaagtgttgggggaccctatgaagactaagctatacatctgctaaatatgggggggggacttaggtccagcctttgtatgctttttgtttggtggttcagtctctgggagcccccaagggcccaagttagttgactctgttggtcttcctatggaatttctatcccttctgggtcctttagcccttcccacaactcttctacaagactcccctagtttcatccagtgtttggctctgggtctgcatctttttctgttagctaggtggagcctctcagaagacagttatgataggctcctgtctgcaagcataacagagtattaatagtgacagggattgttgcttgcccgtggcatgagtctcaagttgacccagtcattggctggccattccctgcattacttgtaggcaggataaattttgggttgaaagttttgtgggtggtttagtgactctattgctccactgagagtcttgcctggctacaggaggtggccacttcaggctccatattccccactgctctccttcactggatctccctccacccccacatctctcactttctaatatgagtactataaattttcctcttaggactgcctaggttgtgtctcagaagggaggttctagtaggttgttctcattttgttggtgtctaggaattttaaatttccctttgaatttcctggatagcacactgttacttcaaaatgtatcacttagtccccaaatatttttgtagtttctcttgtagaattctttctgcttttattcttttatgctctgataggacacaaggaattagtgtggtttctttttattttgtatttgttgggactttttgttctatgataccaattttggaggttccatgtactgctgagaaaaatgcatattctctgttaggtagaatatttttaatgtatctgttaagttgattccatctgaagttcctttgcccattttcatttcagaacacctatagaaatgagtggtatattgaagtttctcactattattgtacttggacctatgtgttttttatgccttttgctgtttcttttatgaaattcgaggctccaattataaatggttgattcttttcccagcctacttaattcacccattttttcatagattgtgcactttcgtgtacaatcttataaaggagtctatcgtccaccttatataatatttcttttttttttaattaggtattttcctcgtttacattttcaatgctatcccaaaggtcccccatacccacccccccaatcccctacccacccactccccctttttggccctggtgttcccctgtactggggcatataaagtttgcaagtccaatgggcctctctttgcagtgatggccgactaggccatcttttgatacatatgcagctaaagacaagagctcccgggtactggttagttcatattgttgttccacctatagggtataatatttcattaggaatttttcaaagtgctagcttggttgttattgattgccataatttgtgtttgtcttgaactatccttatttcttcatcattttgaaagataaactttgctagctaacattcttggctcccagttacttcagagtttgataagacattacttcctttgtgttggtttctgtttgatgatgaaaagtctgggctatgtctgatatttctttggcctttgtacgtaagttgatattttcctcatgttacttctagtatatttatttactttgtatttttgacatcctgactaatgtatcatggagtttcttctctggtcatgtctatgtggagttctttctatatgtctttatgtgtgtagttttatctacttgtactataatgccaataaatagcctgtgtttctactgattttatctgttccttctttctacaccatgaattcttacatttcacctcttgattgtatcccagaatttttagaaataccattcatactcattctcgtgtgtgtgtgtgtgtgtgtgtgtgtgtgtgtgtgtgtgtcagagacagatagacaggcagacagacacacacacaccaaccgactgaccactggaacctcagtcaaaacctggatcattgccctttaagaccactggagtcaaagctttagtctctcagggatccttgggtgccactggggctggagacctatctaatcatagtcttcttagtccctttggagtcagaggcctgaacttgtggttattcctaagcatggctcctgttgtgcccctggggattcccagttaatagacccctggggcacccagcctctgggctagcccaggataccagataagcactccactaacaggaagccaaggggaggtaggtcacttggtggagtttccaaagcagtctgctacaagaaaatggagtagagtcctgggccagaggctaacaggataccaagttgaagtacagcctcaaggtgactggagaggcaagcaggcttgagagttctttatatattctaagtactatacatgatttgtaattattttctcccaataggattttatataccttttgtttaattctgggacattttgagttaatttttaaaaattaattatctgaatatatacatgtgtgttactgtgtatgtgagtgcaggttcttgtggagtccaaaagagaacttggatcccttttggctggagttatatgtggttatgagctatatgaagtgggtgcttggaatcgaacttgggtcttctgcaagagcagcacaatttgctgatctatctctctagttctttgaattaatttatatgagctgtgacacttgggccatagattatcactttgtatatggatttattcttgttctgacaacttttattgacaatgcttccttgatgtcacttgggtgtatttgtatattggggtttttaatctatcttaatgatatacatgtctctcagtcagtactactctgtgtgtgtgtgtgtgtgtgtgtgtgtgtgtgtatacatgtatagtgtcttaatgtataaaatggtatagagtggtagtaatagtatttgctaggggtttggaaaatactgtccaaagaatacaagatttcagtttaggaggaatgaattctaggaacattatacaccatgatgacaatagttaatggacatatgaaaattgttgagagtcgacttttaggtgtttttctccatacccccaaaatttatatgaggcagtacctcattaactattttagcaattctacaatttgtgcatagttcaaaatatgttggagaccataaatgaatggtttgtatctcttagcttaaagtttaatataaaaaatagtgactggccagaagtagtgcttgggaggagaaataggtcgatctctgaattcgaggacagtctggtctacctagaagaattctaggacacccagggataaacagaaaccgtgtttgaaaaagccagaaaagttagtagctgatatttaatggtggtacatgcctttaagcttatcattcaagaaacaggcaagtgggtcttcagagttcaaggccagcttggtatacatagtgagtttcaggacagccagagcaggtctttattctcgtttaaaacaacaaaaattaaaatccctcaaacccaaacaaaaaactgagaaccagcctcacaacctgaatctaacccctcaaccctacatggtgaaaggaaagaaactagcgcttgccaagttgttttctgacctccacatgcatatatgcataacacaggtgcatgtgaacacacaagcaatttaaaatttctgaggtatggctgagataaaaagctgtttgaccctacccctcaagagggttaggttgagccttgcatgcttgttatcctatcactacagggggactaactgaccctacatagcaatactctgtctccaaaaatagtgtttaacccatgagacaagacaaacacctccccacccccacctactcctgtctgttgggaagataaggattgttgggggtggcatgtcattttatgcaatagtctaacaattgttgaattgttcttgcttcagcaaataacctcctatcaatgctttttaatttcaactcagtggggcacacacaaagagaaatagtgaaagtaggagtggtcttgctgggaagaaggggttccagcaggaatgggaaagagcagattgacatggagtggggcttacaaactaaattttttatgtaaacatgtgaattgtcaaaaatagtgatttgacatttttatttttccaagttgtttctgctattgttattcctttgctttcccatacacattttggaatagtttaggtttactcaagagtcttactgggattggagtaggaatagtgttgtgtattgtctatcaattttaggagatttgacatctaccatgttgaatcttcaggatgttatgagtgctcgtgtatagtatttgtcagtgcatatgtatgtagaagcagagttcaactttgagtgtgtcactctattgttctctatcatattttttaatactgagtctctgaacctgaggttttctacttctggtagactgactgaccagtgagtccccaggatctgttttcttctcacctgccccaaacactgtagttacagacttttacctgggttctggtgaactgtattcatgttcttgtgcttatactgcaagtacttttatcactactaaatctgcttggccattctgcgaggtgttttataaatatgggattttttaaaaaaaatgtagataaaacttgtctagaaatagggaaagttgtgttcttttctggtctgtgtgctcgttactgtctagtgttgtactattaagggcaagaacttccaacattgtctttgaataaagtgatgagtacactctgagttcagttcctcattcattctaaagggaaaacatgcaccattatatacttgagttgtacaatgttggggcagattgctacttctcatatcagaagcaatttaattgcttctctacatatacctgtatctccaataatgggatctagtgttagctgtaaaatcttttgtaagaacaacaacaaaaaagcctggtagttaagtgtacaaattgttcagtatatggtttctactccatggttaagattgttgtcaggatctagttggcctcattttaggtattttgaagttgttgataggagttaatcttgtcctttgtgttagatgatgaggtaattttacaagggaatttgtagttacatattcctaaatattaattataggagaacgttgtttaatgttcaaatactgtataaaccaaatgttttgggtgataaatatttgaaaatatattaactttgatttatatgtatgtcaaaaatgacatggcctcaaatgttaatatttaaacataatatttaatgtgcctatcattaaaataaaatactgtggaacattcttaatcttttaaccatctcttccttaatactcattgattgagtagatgtaagcaaaacagataattaggacagaagctacctgggatgtgtatgtattcatgactggttaccttaaatagcaccagatctttctgaagagcctgaaatctacctctaccactgtgcatgtgtcctttttgatagtaggagaaatgttgatttcttactacaatttggtcagtgtatcttcaaggacttatctgttattaaatgttacaggcattacatgggtctgattaggctgttacctattttggggccttctaaattacttggtcttaccaaagtgattgtgttaaactgtcagaacagttttagtagtgtcttacacattgtttcttagtatttttaaaaaagaattctctgattttttttttcaatttttatttgtttgtttgtttgtttgtttgtttgttttttcgagacagggtttctctgtgtagccctggctgtcctggaacttactttgtagaccaggctggccccaaactcagaaatccgcctgcctctgcctcccaagtgctggatttaaaggcgtgtgccaccaccacccagctaagaattgtctttgttaagacttctctttcccgaaggtcctgagttcaaaccccaccaaccacacgtaaagagatctgataccctcttctggtgtgtctgaagtcagctacagtgtactacatataatgataaaaatctttgggctggagcaagtggagttgaccagagtgagcagggctgaccagagcaaggagaggtcctaaaattcaattcccaagaaccacatgaaggctcacaaccatctctacagctacagtatactcactcacatacatacatacatacatacatacatacatacatacatacatacaaaaagacataatttatcttcctgttaaaaggcacattgccaaaaccatcacatggcttagccttaatccttgtgtttagctgtgagttaacattacagtggggcgggggcgttatttggcttatgcgtccacattatacagtctattgttaaaaggagtcagggaagaaacccaaacaggaatctaaagtcgtgaactgaaccagacataggccatggagagggagagaatttactggcttgttctttctgccctgctcagccttcttgtatactccaggaccaccagggatgtcactattcacatccctgtagtaggctggaccttcctacaccaatcattaattaagaaaatgtcctatagactttaggcagtctgatagagacattattaagtgatattttcatttcctttctcgagtattttctttagacctaaattaatatttagttgcttttttattatctgttgcccagcctagccatgaattcccattgatccttcttctgctccagtctggagttacaggtgtgaatcatgatgtctgattcagtagatctatatttcatgttataacttttacttaatcacaaacttctgttatgtaattgtctgcagtattttctagcagttatatagtcaattcaaaaaccaattctagagctgaagagaaaacagttaagatcactttttcctggtacctgtatggtagctcacaaccatccttatactttcaatatatctaatggcttctgggccccacgcctctatgatgtacatacatacatgtgaacgaaacacacacataaagtaatttgatttaaataacaactttaaacatcttaattggggcttttggtactttctgatttttcacttttgtacctactcatgcaatatagattaataatgttaaatgtttgtgtacatctttaaaattttgcctaaattcccagaccccccccccccataactagaggcttatagtgagttttccaccccaagttatcgaaaaaccttgcatacttaactgtgtcaataaagagtttgaaatctttataataggagaagaaaaaaagcttttttgttttggcttagtttggtttggggtttattgtaacggggaatgttggttagttttatctaaagatactctgccattttctgtctaataaccatatcatcgaattaacataactccagtgttacactaggtatcttgcatactcttcatctaatatttgtatttctaagactgtagagctgtagaatatctgtaactttattttctcattactttggggtttttgttttttggttttttttttttgcagatcttaaatcagaaaactgaaaacatgaaagtagacaggactaaactgaaaaagacacctactgaagctgtgagtatccaaatttgctttgtgcattttctttatttcaggaaaaaaatcattgtgaccagttcagcagttctgatcttccaaataagtatgtccagttaatacaaagtgttaactatagtaacttgtgaaactaggaggaatatctctgtttgtctagcatgcatgaggccttgggttgcatcctgaacactaccagaaaaaataatactaccttgccattttaacttactttgattaaaaattagtagccaagtgaccagtggaaaaaggaatagtgaataatactttaggtatttgttccctgaaagggactctcaggctacaatataagcattgaaagacagtatgacaatggaaaagagatgtagaattaaaattgactatagctaatagaacttaagagttttttgttttgttttgaagacaaaaatggtaagttcattgacttttttattagccttttattttgtattttgacattggaatatcagtgtttttactaaatgccatatattgagcatattaatattgtttctgtaagttttcatttgattctgtttttgatgtgttttggtatttataagttttgatgactattatatttaaaagtgaagaataaaaaagtcttaaggaattaagatttttaaaaacaagacagtgccatcagcgtaataatatatttatacgagagttgaaaatcaggacaacttagcatacataagaacttaatagagggattatatattgtgggaaagaacagtattagtcaataaaatgtgccaagacaattacatttgatttgggtgggatggtgcgggggactgttttactgaagtaaattgtagataagtcatcaaaagtcagatatttttaaaagaaattataggagaagtagaacatacaggtgaatgtttaccttgtcttaggtggggattgcccttccaagcattaaggcaaaggacaaaataccaaaatggaaatgtaaaataccatatccaaaataaaaggacacatgacaatagccattctaacaggtatgaggtaatatctcattatgattttgatttgcatttccctgattattagtgatgttgagtacctttgtatgtgccatttggccattgtctttggagaaaagtcttttcaaattcctttgcccactttaaaattgggttatttgggggtttttcattatgaagttgaagaatttcttatatttttaaaattaactccccccagaagaatgaaaagtgaaataagttaattacagaggaacaaatactgcatgattcctctactatggggcatctaaaatagtcaaaaggtatgtaagtaggcaacagaatgaatgatgtttatcaggggagggaatggggaattgttctatggctatgtataatttagtaaaacaagtgagtacaaagtgaataaaaagttgggtatggtggctcctgtctaaggagactgaggcaaaagagccacaagttcagggctacatagtgttaccctatttgaaaagaaaaaggataagtttcagaacttacagttactggtaaattgctgtgtactttaagaatttcgttgaggataaacttcatgttaagtgtttttaatacacacaaatacacaaagggccacaaggaaacttagaggtgatatatttttcacctgaaatgtggtgatggtaaaatgagtgtatggatccatataaactcaccaaattatgttaattatgtgctgtttttgtatgttcacaattaagctcagttgtgtgggggagtcatgggacatgacaagctggagaaaatatttgtaacccaaaatagttaatatcttttgtaccatgtcagtagaagaaatgaatatcccaatgacaaaatgggcataaaacctttcagagaaggaccaaagccagtaaactagaaagagtctctcttacaggtgatcagagaaatgcaaattttattttttatgctaagtgaattataaggctcttacagtcacacttatgtaaatttcctagcttctatcagattatttaagaatataaaatcactgactaggtgtgttttaaggcttgggttgccttatttactcaagcaacatagaagattgcccagtttctcatactggtgttagtactcggttttattaagaaatgttttgtttttcattgattttactggtgtcagtactaggttcagtttttaagatttttttttcattgatcatactggtatcagtactaggttttatttttaagaaacatttttggtctttcattgatcacttagaatattggcagtatttcaaaggatttcccccataggtttgataatggaaacaaattcaggtaaatcctggtagcagctttgaactgacagatggcttgccttttcctgtgagtcgggacagtcccacttggtttgcatttatgtacagagaaataggaaaaatactgtaaagagaagtaaaccttataattagaaaacacgagcaccttagatttaaatgtgtgtaatagatgaaccctgtgaaaagttgggttggaggtgggcctataccaaatcccatgagatggttcaccaggtaaaagtcttcttacaatttaatctcaatgagctcagcccctagaacataaggtgaagaaaaccaactctgcatgattgtccctgtcttatgacatctgcacatatttactctctctcccttctttcctccttccctatttcctcctccctgtcccctaatccttccctctttcccctctcagcaataacaagtctctcactcacaagtttaaaggatttctttgaaaataagagagacaagaaaggttgggtatgatggtgcaaactttttaaatcctagcaccggggatgcagaggcaggtagatatctgagttccaagaccaacgagggatacatagggagaccctgtctcaaaacaagaaagaatttaagcaagaaagagaaggagacaattgtttataattttttcatataccacaaagatagagaaatttaatacttgagtttgggaagtagcatttaagtatcctattttggtctagtccttggtaacctctaaagcattcagtggccattagtgaggttgagttctaggaaagatggtaaaaggtccaggcaagctgcctttgtgccttgtatggcttgtccagttagactcagatatctcataactgttcatgatgccaagcagagtctttggcaaggccatagtatcctttgctaacaatattgcattcaagcaagatctggcttgggtaccaggtttgtgagatattaaatgccacgtaatggtagacataccaagtttttacaggactcagatgttaacaacaaaatgggtattacctaacccacagaatcataacaatgaattagcctatctttgtcattagaaatttaaatacatgcatttgatactaaatccaagtaaatgaaaaagggacagatgaactgtgttaacaggtgtctcaaattctccatgttttctgttatttattcttctttactgtttttcctacaatctatacataaaagggtgtgaggctgaggtcaagcctggtttatagaagaatttggtgttaggtgtttttcatacatatcatcaccaaaatttgaggtagatcctagcaaagttgagaatttggcttaaagaaaatcatagttttaaatatcttataggagatgggaatctttagggtttcctctagttttagatttcacaacagcattgttggatatataggtggtatctaactattcatctctttcttgatgaggatactgagattcaaagtaagaatgactttaaatctaaatctcatgttctttgtttcgtttttaaaatttttctcttgtgtgtacttactaagtggcaggtacttgaatatactcttcaagctagcttgttagattgtgttttcctggtaagtaatggatagtaagtaggattcatcatagtagtcataaaaccaaaatcagaacatagatttgtttgtttccaaagctagtttattcccatgacaccatttatagaattaagtaaaaaaaatcactttcccacctgttgtccattaatagaatgtttcccagtctcagtccctatcccattttccttaccactttcagaacctttattataaattctcaatccactccttgatacctgataatggtcctgttcatcaatacaagatatcaggaatgtatggaaatgggaataccaagtaagaatagagtcttagttttacaaagttcagaagctctatgatcttttctaattcaaggtttaatattatagaaaaataaatcattgctagccttttcctttcaggctggttggcgttctcttctctcttctctcttctctcttctctcttctctcttccatcccctcattttccctccttctaacattctggttaccttttaagctatgttgcaaattatttatttttgcttttagtgctgcttagtttatttcctttgtttctattgtccgtatacttcaagtagtttgcatatacaggtttattcagatttaaacaaatgcatagtggattgttgggattaaagtgtttcctcacaggcttctattgtaatctaaactatttagttttatataagcaaaagttgaatttctttgtgggtttaagggtcccttttcccattctctttgtttcttcctcattcctaaacaccttttatgaatacttgtttgtttttcttagcctgcagactgcagagccttaatagacaaactcaaagtttgtaatgatgagcaactcctcttggaactgcagcaaatcaaaacatggaacattggcaaggtatgtaaaatccatgataacagaggatagggaacatgctattagtacatcattttgtgtgctttgatgatgaacaagagaactgtaatggaatagccttattctatagttacttaagtatctagtatatgtgtcacagctcttggctactggtatttagcctgaattgttgccaagaattattttttaaagataaaccaatgtgctgagccagagagagagagttcagaaagtaaaagcatttatttccaagtctggtgacttgagagatcaagtctaatccccgcatccttcataatggatggaaggaatcaattcttctcctccccccaccaaatttttttctgacttctacatgtattctctggtgtgcacatacccacataaatacattgatgtttgaagaagtgaaaacaaagctaagtgttaataaaactctacttcaaagaaccatttagtgttaaaagaaccattattattttgatgatgggcctcactgtgtggcctaggctccttggactatatatccttctaccttagcctcctcaatactgagattactagagcataccactaagccacttttatcataattttatatcctctttatccttctttctagtgtgagttatatcactgggtggatctgttggaccgctttgatggaattctggcagatgctggacaaacagtggagaatatgtcatggatgcttgtatgtgataggccagaaaaagaacagctgaaaatgcttctattggctgtattgaacttcacagccttgctcattgagtacagcttttctcggcatctgtacagttccatagaggtaagagaatataaggctatgtggtctgtttttaacttaatcgtgtgtatgcacaaacaagggaatttctgtttctgatggttgtttgctttccttttcattatggatttcttaagatagtaagtagtagtaagtggtggggatttagctcagttgtagtatacttgcctaatgggtataggcccctgggtttaatcctcagaaccacaaggggaaagagataatagtatggcatttcttaggcataagtattacctgtcttaggattgatgtgaaagtttctctgtttcatacttcaaggcataaagaatatagtacctgtattgaagcattttatggactatttagtaatctttgtcaaagattatttagaggtattccaagttattcttaaactattaaaaatagtttgattttcttattaatgtgcttataattttcgatgtcttttgccaaaacacatacactcctcccatcatacctgtggggggggggtgagtttaagcacccgttccttattcagaatggtatatttgcatgtaacctacatatatctttgtaaatacttaaactcacctcaagattatttgtaatacccatcacaattatatcacttttgttcctatgaccaaattgctgacaagaacaagggaggaatgtttttgaggaaacagatttcattcttcaaggatggtggtagtcagcttcatctcatggcagttacatactactttttttgaaccaaaaaaagctataatgcccaaggcttaaaccctagtgccctaattctaaaagttctacaaccttgtaaaactgactagtggctaactaagggttcagaaacaagcttatagaggggcattttacactcaaattgtagcagtgtatgtgcagtgtttatagttaactttgtcttaggaatactgaccaaactctgtatgggaatgtacctcaaaaatatatgtctatccatggtaagttgaatggatgaatgatatgggtgggacttataagagcctattgtattctttgtacccataaagactgaggtaatcaatccatggtcaaaagggcactgaaaagggtttaacagttgattacttctagcgtagaactcaggtttgaattcctaccatgtaagcatggaaggcttacaactatatgtaactccacttccagtggatcttattccctctacttgatgtttgcggctacatggttcacagacatacattcagacaaaacacattaaagaaatcttaaatttagtggtcataaatagaagttattttcctttagccaaacttgatgaccttgataccaccctgttgtttttgttttattttctgaatgattttggacaagtagtagaatggttgaacatcaagtgggaatggataaacagtcagtcttgataaagaaatagatgtgctgcccaaggaagtccatataaagtaaacaaataaaatacttttgttaatttctaactcaattacatagtgattttagttttatccagttatgtgctgcaacatattggtgaatgttctctgtttggaaaaaaaagaggttactcccaagcttgtcgtactttaatagttttgagtaattgcacacagctgttgttgatagttttagtttctatgtgtcctttatatatttgttataaaggaaataatagcatacacttagattcatttcacaatgcttagaaatataaatttttagtcctacatatgtattatagcatgtttctatcttgaaattcttccttatgagatacagatataatatcgagctgcaattttcagtgtttacagttattgaactttctagtcagctgttccttggatgcaggattatatattgtaagagattgacttatttttgtgtattgtggctcaataacttgatagcttttaatgttgacacacattattacattaaaagaatttcttttgaagtttttagtgccaagtacttgatccactaaactttgtcccttttttgtttctatagcatttgacaactttattggcttcctctgatatgcaagtggtgctggcagtccttaaccttctatatgtatttagcaaaagatcaaactatatcacacgtcttggatctgacaagaggactccgctactgacacggctgcagcatttggcagaggtgagtctttggggaagatatcagcatatggttaaacaggcatttcttgttttgccaaagtggattagaatccttttgttaactttctgaggtttacaagtatttgtgacagtgtaacaaagtttcaaaaagcacgagtattctcaactattaattaaatttgaaatatttcatcaactctgctcaagaaacaaaattcttgtttcaaaactgatagtgctgctttggagaaattcagaataaggattctatgtgaaaaagaagcataccgagagaaaaaggttagattcgaatctttaattctgataaccagttttctcatttcggaatttaaataagaattgtttagaataatcggagaacatttagtgctattttttccaaattggatattttctttatttacatttatgatgttgttctcccttcctccccccaaaaaaaacccgatgttgtcccctttcccggtttttctctccagaaaccccctgtccccttcccccctcgacctgcttctatgagggtgttccccccactcacctacccactcccatctccctgccctggcattcttctacactcggacattgaacctttacagggccaagagcctctcctccctttgatgcctgacaaggccatcctctgttgcatatgcatctggagtcatggcttgctccatgtgtacgctttggttggtgctttagtccctgtgagttctgggggggtctgcttggttgatattgttgttcttcctatggggttgcaaaccccttcagctccttcagtcctttcagttagtgctattttctaatggtggtattgtattggagtcaagatttcctacaggaaaatttaactctatccaaagattgtggtattcctagaggttaactgattgataacacacagtttgctatgaagttgtcttagaattttttttcagggtctttatcttagttactattgtcctattgttgtgaggacacatgatgaccaaggtaactttagaagaaaacatttgagagttttttacagttcataaccatcatggcagaggaatacggtcataggtagtcatccatttggcattggaacagtggctgagagcttaacatcctgatttgcaagcaagaggcagagtagagactggccctgtcatgagctttctaaaacatcagtagcacacccctgacatggccacaactattcacaaggccacacctcctaattcttccaaaatagtctactaactggggactaagccttcaaacatgtaattatatggggcccattctcaatcaaccacacttgcgatagtctgaagtctaccctcatgatcccatctagtgctaatattacaggcatgtattaccacacctgattggaggcttgtttgttttaatagtcaatttaatggttaccttggggttgactcacttttcaggctattttagtttctttattcacaagtttaataaattttatgacttatcagtgctagggataaaacatggctttgctcatgctagacaatactaccactaaactgtacctcttgccatcaaacctgctttctaaatatattttgagtgtttcctcattgtaagaaatgtaagacagttcaatatgggatctagagttcaaaagaaaaagtttaatctttgataattaacataatgtttgcaaacaacttcagttaaattaagtggtccatacacaaaggcatgaaagtaggaggtcttgttgggaagaagagttggttggggggaggaacggaaggataattatggataataggagctggggggagccttgaatctcaatattcatgaggggaggcaaagacaagtagagagctctgtgagtttccggctagcctgatatacatagttccaggacagccagatacataataaatttctattcatcacgttaatcaaacattagggttcagcaggtgcttaccaccaagcttaacagtaatgaccagagtttgatccagacactatataataagagaatgacttctaaaagtttccttctgacctctacatgcatactatagaatgcaggtgtgcatgccacatgcttattaaataagtcagtaaaaatgtagtaagaacttaaaaaaatagacattaagtacataaactcaggaagctcagaagttttaaatttgtaaataattaacctgtggtcctaatggatgaagaaaatttaaaaatgagcaaaatgccaagtaattctttgtcttttaatttgtagtagagcaatctgtagagaggatttcagcagtttggagcgtactcttgtggagggctggagctcaattcccaatgtacacacagcgcctcatggttgatcaggagcatttgacaagtctgatctctttgggcaccagaactcatggacaaattattcaacacacacaattaaggacttaactgtgtaatgaaagaaatgatttgcaataattattttaaaagtgtttgttgcagacagtggggttttcttttggtttcctagggagatgatacaaaattgttagaactggccagtatgtggaaacatacatcttcaaaatccagcacttagaaggaataactattatccagtgggctacttgagttcaaggacagcctggtctatatagagaattccaagccatccaggcctacatagaaagatcctgtctcaaaaaattgttaaaattcagtgtgatagctaagcaataaatcatcacatgggagtagcacttaatatatatatgacaccgatctgagggtaaagttagaaaataatcttaacattaattaaagtttcatccttaaaaacctcaagtctttttttttttctcacgtctgaatactttaggatctcatcttgtaaggtggtgctttaagcatgctctaagcatgactgatatatactagttattttttagatatataccaacttaattaccagggtcatatgataatccccactgggtaggtgagtacatacagcaaggctaataaattaatgagtattattttggggggaaatgtatatgggcttagttcctagaaaagttatgagatgcaaaatgtaatgttcttaggtgtttggaattgctggagaattgttatttcatacctggggtctctttaaagcctgtaaactagttcctgagtcatttccacttggtaccattaaagaactttatacccaacccttcctggatgaaacactgtctttgacaaattcatttataactgagaaaacagtacaaaaacataagattaaaaaaaagataatggactagtgctgttttaatagtcctgtttagtgtctcctaaaaattataaacatttgttttggtgacaaagcagattttgcttcctagtattaaaatacaaatacaaaataaggaaattggttgtggtcagtttgataaattttctcaatatgtatattagcacttatggcatatataattttttttgttgtttttggtttttttgagacagggtttttctgtatagccctggctgtcctggaactcactttgtagaccaggctggcctggaactcagaaatccacctgcctctgcctctggagtgctgggattaaaggcatgcgccaccacacctggcaagaaactatttcttgctcgttgttcaggatctatttcacaaagaattattctaagactaggtcaaggttcatttactattatctttcaaaactctgaggagttctgactcaaccaggattactaatccgagtgctgggattaaaggcgtgcaccaccatgcccggcggcatatatacttttatatcatgctttattagtgtactagctaagtgtttttcagtgttatctattacttggggaaacagaaggaaaaaaatgattgtgtcaagcttctgccttgtatctttatatttgtggtttttttcttacctgtttcttttgtgtagcctgtagactttgtatattcctatccatatggttttcaacaaatttcttccgtggaattcctgaaaatagccaaaagaatactagaaacatagtgaggaagtacttaaactgttttataaaggtatagtaattagaataatgtactcaactgatggttcagtaggttccaaaatcatatacagcaaacatgtaagaaattaagttatagcaatggtagtgcatgcctttaatcttggggttggtgtggtttgtgctggagtgggcagatcatttcttgagtaccaggactatacagagaaaccctgttgagagagagtggggagaacacataatttatgctaaagatgactgtaaccgaagatgaatggattgttatgattcagtgttactattcaggaaacaatttggtaaaaagcaaagttaagataaagaactgaatgcttaaaaatacaaatttttggctaaagatgtagtttcactgcttgtctaacatgcataaactgagtgtggtagtgtaaatgtgtattcctagcactcaggaagataagaaattgaaggtaagtccttgcctatgtagcaatttcaagaccaatctaggatacatgaggctctgccttaaacaaaaacatgactctataaaataattgaagggtaatagccaggcatggcataccacttaagtccagcatttgggcaacagaagcaggaggatgtttagttgttggtaagcctgagctgtacagcaaaactgcatttcacagagaggttggaaagaaaagagaaaacaacacagcggtaaaaagtctttttccgtgaaggaagaaatcagttctttctccaattgagaaagcgtaaccttttatgtgaaaaatttgaatacagtcaaattatggcatctatcgttgtctcagtttcctttctatttgggtaatttgcatttttcctattgtcatagtaaattctttttgttcattaatattttcctctttatttctgtttctttcctttctgtttttattgctgttccctttacaaactacatttttatacatagtatgttcatcatcataaacataatttttggcttctgtcaaagaacttagatagttctgccctaatacctttgctgactgcaatataattcttaattttggtttggttctacttcctgtatgtcacaaacctggcttcaggggctcttatttagccaattagaatgattatacaacactgtttctcctgtatccttcataattttaaagtcagaaccacatagttgataccgtcaactttagctgccttcttggaatggagcctgctcctccctttaaattatatttgcataagagttgatctgatactcctttttaggaacagaaaatcccttaagcatttcctttcataaattgtaggactaactgggtgtgggggtcttagcccaagggtattattactctattccattttgtgtctggccttatctctttatctctttcagcacaagccatggcaccaacatttaattttctgctgttccttttctctttaaattgtatatttcatatttcttttttgtcttgcttggccttttcctttgtaggcctgaataaaggtgattattactaatctcaaaaaagaatcaataataggatgtcttggattctctatgtttcaaaatagtccaaaaattttcagtttagctccagggagatttttcggaccaggacaaagacagccacattgtttaccaaaatatcaggagttaggatctttatttgctaatgctgttttctgaaacctcttgagctatgcctccatagttcactttgttctcagcactgctgtcttcaaaactcctggtaggatggcctaataagcctagcttacagttttcaaccactttgctacttctaaagtcttctacattcttttcaaataatagtatggtcagtcctgtcacagcagtagcctactttctggtaccaccttttgtcagtaacttttaaattgttgtgataagagacagtatggtgaaagtagtttttagacacacacacacacaaacatttaatttggtgctaagagataagagttcatggccatcatggtgaggagcatagcagcaagtgggcatagtgttggagagcagtaggtgagaacttagaccttgacccacaggaatgaggcggagagaaaactaaactgggttttgaaattgttagcatcatttgacccctcttttctgtatcctgtgcttttgggttaataaagacttacaaaaagcttacttttctgggattaggcaaattttgttttgtctactagtagggttttgtaatagagatctttgaatgacagcttcagtgatacacattgtgttatagatttatcaaaaacatgctgacgtgattatatttctaaagaaggaaatgataacctttcctagtagaaaaacagccaaatagtggttgggacacatactggattagtgagaattgtatgaaggcgtttgtgtttgagctgggccaggcatgacttaccttaaggcaagagtaaaagtagcttattaaagttcgtagttgtagctgagatgactagcaattacttaaacaaaaacaatgctattcttgccagatgtggtggcatggatcttttaataccaacaacaccaggaggcagaggcaagtggatctttagaagttcaaggctagcctggtctatattttctagtccatccagggatatacaattagaccttgtctcaaaaagtatatatatattgctaataaaattttggctatttcaaaggtcaaagatgcagactagtccataagcaaaaataatatggtttgaatttgggatatggaagttaccaggaactgtgctactcattaccacaggcacttgtttgaaagcttttatacttaggttagcaaaacatcttagtcatgttcttttgctgtgatgagataccataaccacagcaactcttattaaggaaagtacttagttggggcttgctatataggttcaggggcttcgtacaggatcagcatgctaggaagcatggtggcatgcaagtagacatggtgctgagagggatcttgcgagctctacatctggaccagaaggcagaggaaacactggggcctgactagggcatttgaaaccttaaagcctatccctggttacacacttcctccaaaaaggccacacttctaatgcaactccctaagcatttgaaaatatgagtctataaaggccattcttattcaaaccaacatgcaaataatatagaatcttagagagctcttggtttatgtcaagaaaacatggttccaccatggtgaaggaaagggttaaaaaacctagaatggtgagaaaggccagctataactaaattccagcaagtatgaatttatacatatggaatgtagtagctggctagcattgctgctttgtactcttatcttgagcagctccatagaaccataaaatagattgcattgtttgttttttcattaaacactttataaacttatgaccataagcgtggtgttaactctttttttttttttttctttaccaagagctggggtggaaaggagaatggctttggacttgcagaatgttgcagagacttgcaaatgttggtgagttaactatttgggatatgataaagtcttgttctaagcctcacttaacaatgaatgtatgatatataaattgacacttgacattaggacttttgtagaacttgaaaaattagtgcataatatctttaggaaatttgagctattattgttcctgttatagataaaaaagtctcagtagtgtgtgttcatataaccagttctgaaataagttgaatttatttaatcaaatcccagaaagctgggaagagtagtacttccacatctgtatttgggatatggcacgaggaagagcacgacttcaagaccagctttgactacatttacttatgtactcacacaagtatcagaactctgagcagtgttcaggaatgactgataggaaattttttttttaagaattatttattacagggatctgtagacaaatcaagagtagttgacctacattttatttccagcaccctgtggcaactaaaaacatttgtaactccagtgccaagccctatgattagcctcttctagcctctataggcaccaggcacttacttggcacagcagatatgcatgcaggtaaaacactgatacaaataacattctaaaaatagttttttaaaaacttaggtatactcttaccttgtcaccaattctcttaaggatttaggctatcctcccttctgctttctgtgcttcaagtagagcctagattgtcatattcatcattaagtagatatgatcaaatctaactaatttatcttctggaaatgtttatcccttagtaggatggttcttatttttagttgcagaaatctacatattaaagcaggttactttcttaccttagctgatagatgatcttcagtaagtagctgtgaatggatgttggtaataagggaaatatgtcttaaatcttactcagtttggagtttcaattttgagaacatattttaatgaagaattctgaagctcattctgcatgttaagactttctgggtttgtgccatgactgttttcctgttttagtccttggctttatcaaggttgagatttggcatgttaacagtttgaaattcttatactttaaaatggtacatgtacacgttgaactaaattttaaaatgatagtaccctgtccattacaacattccctagaaagaaaacatgaggctatcattgtttaccttgtattacttttgtagagttatataaaaagatgtgctttgagggtgtagattttttttttggtttggtgtgtatcaatgcagaaagccatgaaaaatgttctagaaaggtatagaaaggagtgtttgaagtaatagaaaaagtgtccataaggaggctgttaagatatttttacaagaatgccctttttcattctttaactgatgccaagattttgaccctgttcactattatttattaaagttgtatgcattgttacttggcagacttgaccccaccacaagaataactatagtcaaaatttatgtattaaaagaaagagtaacagttaatctagatgttgaaaacagatttgtatctctaaacttgagccttctgattctgcttctaccaaatatctgattaaagacactattgatatataatctactactgtcacaatgtgtttgaggaaagtgttggagatgtctaaaatcagtttaagctcgatatgttactctgttttatacacagaaatatccacccagtgcaaccacactacactttgaattttatgcagatcctggagctgaggtcaaaattgagaagagggtgagtcaggttattttgttgttatttatagactctcttagtttaaatgaggggatgttttgttctctatcactgccctttgaagctagatatacctagaagctctttaggaaaaattaatcatatgcctacttctcacatcattaattttttaaaattatttatctacattccattccaccttacctttccagttccctctcccagagttcctcatcccattcctcctcccccttgcctctaagagggtgctctcctctcccaccccacccccatcattaggttttatgctgggacctgccaaaagttacaactccttttattgggcattaccatatttgtgtgtttgctcagagtctctggaatgtatcctaatagtcttagttggatttcagtttctgtatttatctcagtctattaaaaagagctctggtttgcatgtaaaatgttacttaaatgatgttctaaattcctggatgatctgctatgacttggtttggcatggaaactccccaatgatttttcttccactttcattgttaaatttttttttccagaataaaattgtcttcaaaacatgagaaagtattctcatgtattctgtctttggtatgaatactaaaattgtggagatagttagacaagggttaaaaaggaacacaaaatatgaaacatgcctggctaacagaattatagttaaatactaccagtttgaaagaagcatcttgtgactgttatatgtgggaaatggatgcttttaatgactatgaaattaccttgattctcagtgtttcttacagggtatttagtgaatccctaacaggtatttcaactttttaatttcagacaactagtaatacactacattatattcacatagaacaacttgacaaggtaagagaattctttgacaactggttagttcatttttgtttgtagccttgttcttaactaatttttttctaatacagatttcagaaagtccttctgaaataatggaatctcttaccaaaatgtacagcattcctaaggataagcaggtaaaatacatctgaaaaatatcttgcatattgtggatttccaaatatactaataagttgggcaaacagaagccatagcaaaattgatatacatttggagtctgaccatagcagattcgctacctagatttgtttcctcttcttgaggacaataacttctagcaccttatgatagattggaaacataaacttgtaagctgattcaaaatgattatctagtagtggtgataactttctcaacattttggatacatttaggagaattctattgtgttagcttgttctgttctttttggcagtggtcggatatttattgaaaatttgaattattatctattaatgtgtattgacaatttttgaaatagtagtatattgagagatccctgttttgccactctagttctgtcatctaatctcagagtaaataatactagttcagtttgatactctagcaacaaaactattttaccaagcagcataaaagtacacaacagctcaagaacctatcctttgtagtgatttactaatataagtcttacatctctacagatgctgttatttacacatatacgactggcccatggcttttctaatcacaggaagcggttacaagctgttcaggccagactgcatgcaatatctatattaggtaagaaaacactaattaactggtcctaagtaggcactttgaatttgatttctgatgagtgccatctatctttaatgctacgaggctttattatggcaacctaaattataaatgtatttgctcatcccagttactactgtagtcattcatcatcttgagctcctttatgtactagataaaaggaaacttttattgcccagttacatgggcttggttgtcatcatcttgtccctgttattcttgataatcccttgtccagttctcccatcttttcagaggtataattttgaagtctgaaaataattaaatggttaatactctatacttttactttgctataggagaatatataggaggttttgtttttaattatgcagaattctaacaggccattttcatgtaagcatataatgcactttgagtgtgtaatacctactatagctcatttctctcctttttggccaattttacctcatatttgttccccagataattttatttctattattatgtcatcagcacataactgattatgtgtgtaaagagtgtgacatacaaatgagagatatgttacttgtccattttgcatgaagttgcatctgtttttctacaaatgacataacttcatctttatgtggaagtcacatgtttttgaggctcccaccatggttctgagaattgtatacctacacactgtattccctcaggcaacttcaagtacgttatatttggacagtatttataagctattttaagaaatgaaagaaaatcctggaaattgtcctgtcacatgctaggcacattacaaggcaaaaaaggacaagtatcactattactacctactttcatttagtttctgcctacatactcttagaactgactacattgctatgtttgtgttcatacctagtacaatttctggcattataatgattatccaaaaagttaatgaatgtactcacgtctcggccatattttacttcagagtgtatgccactattacctcagtgtgtgattcagcaaaaaaaaaaaaatatgcattttcttgagccagggtctcactatatatagctctgtctatcttagaactcatggtataagccaggctatccttgaactcacagagatctacctgcctctgtctcccaaatcctgggatttaagatataggtaggctactatgccttctcgatattacaaagtcttttttgggggtggggggtggggttgtttttgttcctttttgggttttttgtttgttcgtttgttttttgggtttggttttgttttttggtttggtttggtttggtttggtttggtttggtttttggttttccgagacaaggtttctctgtatagccctggctgtcctggaactcactctgtagaccaggctggcctcaaactcagaaatccccttgcctctgcctccagagtgctgggatcaaaggagtgcgctaccatgcccagcgattatgcacattcttaacttttagtagtgccacatgaatttgacagtgtacaatagtctataaattttctttgttttaataaggatttgtgttataagcaaagaaagaagccaagtctatacctttatccaaagcatagttacagttcaatcaagtagtgaagttaagaaaatgaactctttgctcccttttcctacaaaacttcccccaaattccttctgataattttagtagaaaaatatgtggttattcagattttaccacaatcatataatgtagtgattttacccttttgtgctgattggaatgtgtgttatacagtggtggcttaataactgcatttctaccaaagtctttgcttttcttttgcagtctattctaatgccttgcaagagtcagcaaacagtatcttgtataatgggttgatagaggagttggtagatgtccttcaaataacagataagcagctcatggtaagtatctattaatatgtacctatcaagttttatattgcatatgccttctgtttttcttaagaagtccaaaagtatcctagaagtggagcctgaaccttttacttttttctttttggatattaaactgtgaaattactgaataccaaatacacattgttattctctactgaccccattttcctcaaacagttttaataaaattactgaaaatttgattttgagatattagcaccttcgttcagttgtccatttgtttttgacactgtttactttgtcctcataggaaattaaagctgcttctttacgaacgttaacatcaattgttcatttggagagaactcccaagctcagcagtattattgactgtactggaactgcctcctaccatggatttttgcctgtacttgtgcggaactgcattcaggccatgattggtaggtttgcatggtaattatttacctaggaacatttcatcgtttaacattgtgctaggtaagtaactgaggaaatcccaactttctttgtagatccttccatggacccatacccccatcagtttgccacagctcttttctcctttttgtaccatctggctagctacgatgctggtggtgaagccttggtctcctgtggaatgatggaagccttactaaaggtactctgcttttgctttctaatataattgtgtgaaaatcaaataagagagggcagatttttaatgttttacagtgagtaaatagcacagaaagtttatcctaaaagagttatagtttatgttctagttgccacatgtatctattgtcaatattgggactttttgtaatccagcgtaatttggtagactggaggccctgggtctagacagtactacatgcatagtagtgtgacattatgcatggccctaagaaaaatgtatgtaagagtccttgtaaagttttagtttaattataacaggatttagattagttggttgattggcagtaggtattttgaggcaatgggtcttggcctctctggcttgcaataaaataagctgtatatatttaatcatctttatgaattgttatgcatgtggcctcaggaggttgaatatagtccttgaattcataactttattatttgacaaaacattcagcatatgtctttatcttctctccagtttcatactatgctgactcaaggggacaccaatactatattttcgaaaagcaatattaatttttatagctctgtttttaaattattatgtttacccctcccttccttgcaggtcataaagtttcttggtgatgaacaagaccagataacatttgtaaccagagctgtcagagtggttgaccttatcaccaacctggacatggcagcttttcagtctcatagtggtctttctatcttcatctatagacttgaggtattattttcttaagacaatttgcatagactttattggatcccagtgagtgctgagtctaggaaaatttccacctatcataagcaaccatcttacctctcttaaatttctagaaactgagtttataatttgcttgttattcttcattataattttttaatcccaaaaatgtataggagtttcttaatatttttcccttgattgtagcacgaagtagatttgtgtcgtaaagaatgccctttcgtgatcaagccaaagatccagagacccagtaccactcaagaaggagaagaaatggaaactgatatggatggtaattaacaagttattaagccaatgatatttccatgtatgtgatttttctattatcctatccaaattctaattcttactcataaattaaaaggcacacaggtttccaggtatatctttcaacactttttatataaatgatatataaattgttagggatagacctgggaggtaaagctacagtagaccactaaagtcactctacacatttttttagtttattatcttatttacactactaaaacctaataagcaccgtgtagtcaaaatactgtctttttttttttttttttacctgataaattacctggagactataaactcataaatgagaccttggaaaactatcttaagatcagagattttaattggttattgtttagggatcttttaagtgacaaaattacaattgcaaaaccagatcattttagttttcatgtgtgttatatgggttttttttaacactttcatctctttcctaatagaataaaaattcataatagaataaaaaatactgccccaagcagatttcttataatttgcaatagtcttaatgacagagattattattgtgtatcttactatgtttatgataaaagtactacaaatgtaacgcgccgttttgttaatagtaaatagtatgttgttcctttttctgactttgtttttgggcaccattatctgtgcatgttgcagtccacagaaatccttttgctcagtttctgtttctgttttattgggaacaagctgacatttaagttcacaggtgagattccaagtgttgaataaaatgtgtttattaactgctgataaataattgttgactatccattgtaaatcagcaattgtcagaatttaataagcagaacaataagtgcttggtagattctggcgccatctgaaatgcttgattcagtaaatttgcaactgaagaccaggaaacaagtatttaaaactaatccaaacgattgcattgaattctcaaagaaattacatactcaatacaaagaaagttacacagctgttcgtccttactacttgtgtaagtaggtgcatgcattaaaataactttaaaatgttacatttataaaattaataagatcccctttaaagtttacataactgaaacattgtagatagtaaatatttgcttttcaaatctaaaagtaaatgttaatgctcagtcttaaccctctgccattagctgttaatttgatgtgactcaatacaactttatttccttttcattttcacatctacaagtatatagtttttagaacagagagagaggagagcacaaacacattctgcttttattgttcattctatgtatcatagccatccttccctatgaacatcagtgctttttatatttgttaattaacctctgttagtagtcttgacttactacctccctcttagcagtaacatacaaagttgcatgttttacatctcactcagtggacgaagttttctcagaaatctttcttttcttagtaccttttattctaattagtttctttatcataacttgtactttagttgcagatgtaactatggaaagcagtccaggctcgtccatatctatggagcaccggctggatgttgaattaagggcatcaagttccaacagcagcactagcatctctggccctggcccgggtcctggccctggtccgggtcctggccctggtcctggccctggtcctggtcctggccctggccctggccctggccccggccctggccctggtcctggccctggaccccgtcctggtgcgtagacacatagatacacagtcttttacagtgactgacttattaaactagtgaagaagagaacattacacggcacttattggtacatttgaggataatcttataagaacatgtcttgcaacattttatggtcttctgttagttcacacagtatcaaaacagacatttcggagggcagataatatccaaaagtgaagtttgaagttgaatctttttactctacagtatttctgtttttatctttttctttttgttcctctgtctgtctgattttaataccggtcatatgctatctttggtgatttaatttcagctttcagaatactctctctcatgtccagagatctcactttaaatgtctgctagttttgctttagtggatatagacgggtctcttagtacatgttttgtgtgcctcttcactgtgatttaataatgagcacaatatgatacttttttctttctcccatgttaggagttcagtgtattccacaacgagcagcacttctcaagtccatgttgaatttcctcaagaaggccattcaagaccctgctttctcagatggcatacgacatggtattttgattctgtatactgttttctaagaccacttggttatccagattgttctttttcatgttttcttgatgtttttctaaagcatacttagtaaactgatagctttttgttacttaatatgtttcttagacatgagggttacttacacaactccacttcccagctttggattctgatctcttctatcctactgccacctctcatagtctccatgtctgttcttattttgaccctctattcaagctaactgcatgaataaactaaggcgttatatgaaacagaggccatagacttgatcatttatttactacagtataacatattgctacccatcacccttgatcttcgtgcctcacccagacttatcatatgtggtctttgttcatatttcttttagtgatggatggttctttacctacctctctgaaacacatcatcagcaatgcagaatactatggtccatcactcttcctcctaggtgagtagaattgaagttcgggctaggttgaatgttctggcatacatttataaagtacctggaggcaaaaggcagtcagttctcttgagttcaatgccagcttgctgcatgtgtgtgcacgcaagcttttagaacttttttttaatttctttttttatgagatattttttcatttacaactcaaatgctatcccaaaagtcctttataccactccctaccctggaccctgctttccaacccacctactcccacttcctggtaaatgctacaaagcccattgttttatcccactacgcactttggcatcacaaatgcaagttggaactccatttaaaattctataaagcaatttagggggagatgtagaaattgcaatttctttgaacatagtggagtgtacattgtacaaatacattatgggcagtctagagatttgtatttattatgactttacctttttgctaatgaaacagtttatgaatctgtatttctatcttgtgatcttgcagaatttactagtttggttttccctgttaatgaaccaaaatgtttccatttactccaaggatggcaatatgacccagtatttcctttttttagtgaaacttcatgaagcaggtatactttgtagttggatctatgatattccagttactaaatatgagtacaggtcaggtcctgtaaaggagttggagttgtgacaaaggaaaatcagcctaaggtagattgaaagagttcctactgggaaaatttgtatcatagcagacagacagttaaaaatagccttaacaaaggatgttgcacatgcttttagttaagtatctgggaataatactcataaatggaaagttaacgaggaagtatgtggcaaggttacagtgatctgtagtaactacacactgaaactcaacaaataaggaatttgacatttctttttttttttaaagatttatttatttattatatgtaagtacactgtagttgtcttcagacacaccagaaggttagtatggtagaaatatagttttttttaaaaaggcttgttagtgttggttgatatccctgggaggcctgctcttttctgaaaggaaatggaggacgagtggatctggggtaaaagggtggtggagatggggttgggaggagtgaagagagggaatctgtttactgatatgtgatgtatgagagaaaaatacataaaaaggaatgataacacataaaactcttaatgtttattggactactcttggtattctgctggaaaattgttttcataataagcacacaagtttaaattattaaatatttagtgtatgtgttttaagattttgtgacgggcagtgttgttgcatgcctttaatcccagcacttgggaggcagaggaaagtggatttctgagttcaagtcctgcctggtctacagagtgtgttccacgacagccagggctacacaaagaaactctgtcttgaaaaaaaaaacagattttatttacttttaatacctatggagagtctcagtttcccataatttttcttatttcttcttagctactgaagtggtgactgtgtttgtatttcaagagccatcactgctgtcctcactccaggacaatggactgacagatgtcatgctgcatgcactgctcatcaaagatgtgagttcattctaccactttataaaaaagactactccgtttatttcctgttttctcagatacatcttccacatgctttagaagcaagtttgaaatgttattgtgtgaaaaaatttatgtatgtattgttgaatttattttatacctgtttaacaaattcctcagtgtggtaaccctaactatattttctttgcatttgtatatgacattttttgagttgcattcaaatccttttcgtcttgactaggttcctgctacaagggaagtcctcggttccctcccaaatgtattcagtgcactttgcttgaatgcccgaggtcttcagtcttttgtacaatgtcagccatttgaacgtctcttcaaagttcttctgtctcctgattacctcccagccatgcggaggaggaggagttctgatccccttggtgagttgtgctactatttattttaaaatagaaagttggttttggcaaggaaagttttccttgactacacatcgtttctctggttaggtatgctcagcttaacgggaattatcaccatgtattctaatattacaggtaggaaggaatacgtcatccttagcctctctcttcatagtatttccatgcttctgaatagttcactttactgatgttggtaacaaacaggtatagggaatggtgatttcttttctcctctcctctcctctcctctcctctcctctcctctcctctcctctcctctcctctcctctcctctcctctcctctcctcttctcttttttccccagtggtttattttcaagtctaccatctaatatacaaatttttctgttgtgaacagatttctcatttttttctaaaacagttataaataattatattttcttctcagtgtattttgagtgtatattgctaaggcaaaagagagaaaaatactgtagtttgtaaaagtgtacctgtatattacctaggctgagtctgggcatttgaattcagcctgggcaatatagtgaggggacaacacaacagcattcaccccctacccctcacccccttttcatgaataaatgtattctgtacttccattcaccactgtatcattctagcagtcttcatggagacatcccaagggtcagggtataggggactttggggatagcatttgaaatgtaaatggaggaactatctaattttttaaaaatgccataagaaagtatttcttcttttctactcctttgtctataatagagtagctcagaccttgacagtggcgtttgctaaactgatctctttcctcctcttcctcctcaaccaccaccaccaccaccatcaccatgatttggtggattgaagcttatgtgaattcattcaagcttatgtgttggtagatagtcacaagaagcagttcagtttttttctttctgtcttaaattggcacaaaaatttttggaatcagtaaaaaaaatttttttttttgccttaaggggatactgcatccaacctggggagtgctgttgatgagctcatgagacaccagcctaccctcaaaacagatgcaacaactgccatcatcaaggtagggattgataatggttaggaatttgatcttttacaaagtgtcctagcttaactgggaagggtattttatctgcctaatttctaagccttgcttttttggactgttctttgcaaaaccaaaagttataaccagtagtctttacaagagtggactttatgttgattccatcctttttatttatactgaatcattttctgaattaacacagttcctttgtttagtgtaaatctgtttgtattgctttcttatgagattaacaaatatgcaggggcttcagtttgtatgagcatccttgctagcttcttttcttgaatttttcccttcctcatttctccttcctccatcaggagtggattatttgattctgcatataagataatgatgatttttaaattaggactggcatgtgaccttgtgtgatttttttttttttttttttttttttttttactttttacacttaaattttttctttttaaaaaatggatgtaatggttatgcttcaggagtgttgtgtatattacacatagaaaactctcacaaaatgtcattccttcattataaataagtaatgttttcctctttgacttttagttacttgaagaaatctgtaatcttggaagagatcctaaatacatttgtcagaagccatctattcagaaagcggatggtactgctactgctcctcctccaaggtctaatcatgctgcagaagaggcttccagtgaagatgaggaggaagaggaagtacaggccatgcagagctttaattctgcccagcagaatgaaactgagcctaatcagcagtaagtgttaataggtcagattctctttccttatgatactacttagtatcataatagtttatggtgatggttgtggtggcacttctaattctactatggcccatctctgagtttggaggccagccagggctatagagagagacactggctggagagattggggttgtgggctcaattttttttttttatgatcagcaggatggaactcaagcaaagcaactccataccctttatgtcacttcagtctataaaaaagtaaaaaatacatcagatcattttaaagttctttctggccttttaggtgttttgttccttcctctgtagtgtcagagttctgtgttgtagtagcattggttgcctttgaaaattgctattcttaaaattttagttcatgatgttaaatcagaattcagtattccaagtaatatatgaaacttttatttcaaatgtggaagcaatgtctctagacaggggtcaatatttcagctgtgagtaagaatagttttgatctggtactaaactggcatattggaggtaggaaaatagtctagtagagtatgaataaagcccaggaatagcagaagtaaaaagagttactggaactcagcagtgcacttggtggtgtcagtaattttggaggggagtcattacttaatctccatttgcctgagacagcaggcataaatctctagtgttgtcctcaatctaccattaagatcatgtttctaaaagagggagacattctgacattctgaaattatggcatttctcaatacagtataaagaagttacagtatttattcccaatctccaattgccagtaaccctgcagagctgatttgcttttcctgttcacaaatgaaaaaaagatttgttgaatgtagaatgttgttggtggtgattacaaatcaagttgtgtgtatctgcatatattagatcttagatctaatatattccaaattcaagctgctgttaaagtaaattaacatcttctgaatattactcatttttcatactattttccttacttgagatattgtatatcattatccacatttgttcctcattccagaacatcttccaattgggaaaccaagcttatattttcccatatgctgattcttttctgtattaatctgtttcagtgactcctatctctatttaatagaattatcaaagaactttagatcaagtgcctgtcaactttctcttatctgccctctttccagttcacattacccccccccccccggccctggccctgctcgctccaggccataggtttttttttttttaatttgtttctcattatgagatgactgtgagccaccatgtggttgctgggaattgaactcatgacttctggaagagagtcagtgctcttaaagctgagccatctcaccagccccccagtttacattctcaattggacctacaaattcctgtttctttgcctctatccttcttcaaatgccataggtatatatccaaatgtaatttttatatgtatgttcaaatatttctccatccaaaaatggagctactgatcttacttctattatacatgaaataattttgtatattcaaaaataccctataaatacaatgataatacaaatgtgcatctaatgcatagtttctttaatttggttttacttactgtgttttgggaatttatccatattagtaacatgtctctgtagtcttgagtgcgttgtataactatggttacatttatttagttttcctcttaatgaacttggtttttattttcctgaggctaattcctttttattcttactttttaaagtcatgatggcttatgaatgatagtgaaataatagtttttgttggatgtgtagaataagaacgcttaggtagtttaggtctaaattcttaggtttctaatgtgctattcacaaactaaggtcttgctttgcaggtaagagtagctgggaattcattgtacagtgtcctcaaactcagtcttccctcttcagccttcttttttttttaaacgtattttcctcaatgacatttccaatgctatcccaaaattcccctccaccccccacccccacttccctacccacccattcccattttttggccctggcgttctcctgtacaggggcatataaagtttgcctgtccaatgggcctctctttccagtgatggccgactaggccatcttttgatacatacgcagctagagtcaagagctccggggtactggttagttcatattgttgttccacctatagggttgcagttcccttcagctccttggatactttctctagctcctccattgggcaccctgtgatccatccaataagtgctgaggattatgactctgtttctggccactctatggtctctgaaacaagcctttcaagtcctacaaagaggctttttgattcttgctgcttttcagggcatagtgtggcattctcctacatgacttaggttgataataaacaccatagtttaagtttttcctggtcctaaactgtgaggagaagaggggctggacctggttatccaaccaaggcctgtgttccctaacagtccctgcaagtgcctgtcagtcagttcttcattctaaatgatgggctgggatatggggaatgtagcctgatacctccaggctgttgcaaattttcaagcagcactcaaaattttaaagtacaggctcatgatccttgatattaaggaacttttaaataatatgcataagtctgtggtctgtgcagctctgtagcatttgtttgagagaatagagattgggcagaggagaattggacaattataactcatttacaaaaacagacttttgttgctcagggatgtgactgcttcaaattaggttaaacctaggcttgtaggtagagttccttaggagataactgatcatttttatttttaaatgatgtagtaggaaagaacaatagatacatatatgaatgagtctgttcctggagttatattaagaacaatactgttggtttgtctttttttttttctacagcttcctttttagcaatgaaaggcacacctgggattcatttcgttgcattaacctgtgctctttactagatcatatttgacatatacaaagaggcaagaattccattggagtggtatctgtacttgtagttttagaggtggatctttaggttctttctagggaggtgaggcttagttgaaaaggataattaattgattaataaaatgctgcagttgtgcattatctaggaaatgttcttttcaatcctggcttaaagatttcctttctttgaagggtcttagtcctttgaaggacttaactttctcagagtggtatgaatacttaagctgatactgaaaatcacacagcacagtgcctgataaattgtggggaaaggactatactagtttactattatttcttgtgccttttgttgtcaacaaagggtagttcagagacccagaaagacctaagataaactttgcaatgtaaggattaaaacagcctctcagatttcaccatcatctcattatctaatttggtaatgtggccatttgaagttcctcacaaggccagcactgccaccctgctttgtactctgtccagaaggctctaatgaagtcctcttcctgatttgaacagcactttctgtaggtacaaagggccatttcctttagtgtctctactgcgatttttaataatatacaaagcagggaaaatgaagtggaatccaataaaatccttttattaataaagatcaaacaaaacaaacaaaaagatttccactttttgtacaaaggtctttgcccatgggactagaaaaaaaagctggatttgccgctcttaatgaagacaggacacagtattcattgagttaggcggcttacaaccacttgtatctccagttagcctgcactcacgtgtatactcacatgtaacataaagtaaattttaacaagattcttttgcaagtcccctcccccaattttcttcatttagtgtatatgtgtataatctcatacacacatgtgaaaggtcagaggacaacattcatgagttgattctctgcttccctggatgctgaggactgaactcaaattgtaaggcttgtatggtgagtacttacctgctgtgctatctcttcagcccttttaaaagttgaggatctttataaaatccttaaccctgggctggtgagatggctcaagcgggtaagagctctgactgctcttccaaactcttcatgagttcaaatcccagcaaccacatggtagctcagaatcacccataatgagatctgactccctcttctggtgtgtttgaagacagctacagtgtacttattatacataataataaataaaccttttttaaaagccttggatgtttcattactgaagctattcttaaagcttctttgttctttttcacttttctgctaaatgttttcatggttgtcaatttttataatttgtcagatatgagaactattagcattttatcttgcttgtctcttttactatcttttctctcaacaccactatctctgttcctccattgccacctcttactcagatcccaaggatacatatagcatcatcatatgttgtttcctacttaagttttcttcttttctgtctttatgagttacattttcttttcatctcagtacagtatatatggttgtttccccctctcattttcttgcaaaagacaatttaatctaaagataccttttgccgggcggtggtggtgcactcctttaatcttagcacttgggaggcagaggcaggtggatttctgagttcaaggccagcctggtctacagagtgagttccaggacagccagggatatacagagaaaccctgtcccaaaaaaacaaaaaagaaaaaaatattaagatacctttataaatctataacctaattagcatccagtattgaagaatttgaaaaagctaaaaaacatgataaattgtttcataattcaggaactgtcatcctgcaattacaaattagcagtaaaaggaggccttcgaaaatgactttagctttgactgttcataagtatttgtcagtcttaagcatttttgattttttgagataaggtttctttgtgtaacagcccctgatttttctggaaccgactttgtacactagcctggccctgaaagctcctcctgcccatgcctctgcctctttaagtacgaggattaaaagcatatgccactactcctggctcatagtaaagatatttgaacaaaaccaaaaatccacttctttctcagctcttaatctaacataagattatgactgttttatgtttgcttcattgcctggtccttccctgtaagcacatgtttggtcttttaattcagtttattttcagtatttttataatgttgaatttttttctaacagtaatttctcttagaaaggatgtgtcatttgtggtaagtataaaattgctatatttttatggcctgtttattttatactctgaactctaccttcattattgatttcagctctttttcttcatgtcttagttttaaggttcatatactaaaagagtatatactctaggagcatgacttattaaaagggcttcactttttttcccttacgctggtgctatgaatttctgtgtaactgattcttttctctttaacagggtcgttggtaccgaggaacgtatacctatacccctcatggattacatccttaatgtggtaagattcattgtagagctaaagatgtgtgcttttcaggaaaatacatcaggttgtcatcagagcaagttactttttctcccctaatgcctttagttagtaattatcattttattttctcaacttgaaagtaccttatgtgataacattgtatagcatttaatgtttattttctctagagctattaaagtacagaggaaaaggtgtgcaaaattggaaatatttgttcttgccccattttcagtaaatgaaccagtattctcagcctttttatattttcaactgtctgttcactgttattattgtacatttgaattttaacgagatttagtgtgttaaaccaatattctgtcagaatttacccaacatgtttttcccccattttaccccttcccctgcccctctctgaagtgtatggacgttccctgtatcattaagaaaatgtgaagagcactaaaattttcccagaatttaatatccacttagcatttattctagactattaagcagataatttttcttgtgcttttgtgtacattaatacattttttctatccctcaaagatccctattgttttgattcaaatcctgattcctggagttcattttatttatattataaggatgcgtgggaactgtcctaacaaatggagtgtatatacagttaagacatagacctgtttctgccactaattcagaatgttgctctgaacaaggcatttagcttctctttgctttcaaattgacttctggagtggttaaaaaggtagaatgggaagggttccttattttctggatgagtatgtgctaattatttgtccctgttaattgaagtggtattacagaaaataactgatgtcttgcaaatacgttgtccctatcctgatcctgatgaagtaaaactgaccttttacttccaagtgttagcctctaacttgtttttaaaaaactttcatcacctagatgaaatttgtggaatctattttgagcaacaatacaacagatgaccactgtcaagaatttgtaaaccagaaaggactcttacctttggttaccattttgggtcttcccaatctgcccattgactttcccacatctgctgcctgtcaggctgttgcaggtgtctgcaaatccatattggtaagaaacatctagcgaaatattttacatctctgtatgtattttcattgtgttctcgcttaaggacctctagttaaaaattgataaatttgtgtgttttatattttatactatttcccatagtaaaattatttattttctttgtttttgcatttgcgtgtagttttgccatttgaattcatatgcgtctaaattatttccaggaaagctttctagctttcttcatgttgttatggtactgtttttttgttttaatatgcgcattcactttgcagtgttcgttccttttccccaagctttattagtcataaattgatatgtaatttattgcttaaaatttgccaaaaacagtttctttatttctacaacacctttgatttttgcaagttacttgttcacccctaatgccttcagttagtaattatcattctatttactcaacttgaaagtaccttatgtaatagcattgtatagcatttaagagtgttacagtgacactaaatatttattaattttgtcagtttcctttttaaagctaaatgataaaaaaaaacacaagaaaagctaaatgatattttatgaaatacactctagatcattttgtccgttcctctgttactggacactgaggttgcttttattttagcccctgatgaatactgttataaacttgagtgtataaatagcacttcaagatttgccttttgaatcttttggatatatactttgaagtgacataacttaatcaaatgataattctatttgtgtgtgtgtgtgcttgcatgaaaccttcaaagtacttttccaagattattttccattcctagttagcgccacataaggattgtaatttcaccatttccatgccagatcggtcggtcggtcggtcggtctgtctttctttctttctttctttctttctttctttctttctttctttctttctttctttccttctttccttccttccttccttccttccttccttccttccttccttctttctttctttctttctttctttctttctttctttctttctttctttctgttttcttaaataatagccatccttgaagataaagtagtgcttcgttttcattttgacttgcatttcctaaataattggtggtattgatcataacgtttgatttgtgtacttgagttattgtctatgtgtgcatcctttgctaaacgaatacttgtgttctttattttatatttaatcaaattaagatgtttttctgttcattatcgaatatctctgtatatattgaacaccagcctctttttttcagatacatcacttgcaaatatcctcattttgtcagttgcctgtttgttaccattgacatactaaaggttttgatgctgaccaggcccattttgtcttttgttatcgttgtcatttttgttttttgtgcttttggtgctgatccaagaaatttcagacagtttaattcctatactttaatctagatattatgagtttttaattcttaggtcttgatacatttggagtagagaccgaaaaggttccactttatttatttcatttgtttattttatatttcccccaatatcattcattgaaaagactgtacttttattaaaccatctcctatcaacacatctcttcaaacacaatttaactaaaaaatttggagttttctttctcagcccaattcttttccattgattgtccagtagcacaattttgattaatcaattataactaatcaaaatcaaattggaaatcaggaagtgtgagacctccaaattgagttgtgttctcataccccagaaatattttgtttttttttttgggggggggggttctttgaaaagttgtaaatgaattatgagggaaattttatatctgcctccaacccagaaaaaaaaagattgggggaattttgatagtaattacaataaagctcctttgttggctgttttgtgcagtgataaataattttgagaaactgcaatttaatgttttattttgtttcactctttgcaggtgtaaagtgctttcataagagaacatggggaaaggactgatctaactaccccacctctaagatgctctgtgaggagggatagatttatttcaagccataggaaggcaaataatttctagctttgcataacaagtggtaatctttaattgccagatttttcttccttaacttgaaaagaaatgtaatatttgggtttgtctattaaaataatttgccttcctgatgccaatctcagagtcaccactcttattttggaaagaagacaactttatagctctgaaagtacttcttgatagtttgactagcctcagtagcttttataatagttgctttctcccttatttccttctgcaccatttgtactgctagatatagatacagctgcttaatttatgtaacattgtatgaggttgagtttcacatgccctctcagcctcctccctcaacaatatttaatacaatacttactttattcaattattgatttactcattagaaataaatagaaaacaccattgtaatgtagctcatttttaagatttggaactttgcctaacattgctcctttctaagcaaaatttgaaactaacctcttacacagcagtacaacaaacagtcttgtttgacattttcatgttatgattggctcatcaagcttaaaaataatatgctattacacaaagtagtgaaatatatcattcctggcttcatattttggtactgccatttataaattgagaaatgtaactgactgaaatttcggagagttaagtaatagtcactattactgtaaatgttaagaacataatgtatgtatttcattacgtggagacacattcataattcttgtttcagaccctgtcacatgaacccaaagttcttcaagaaggtctccttcaattagacttgatcctttcctccttggagcctttacatcggccgattgaatcccctgggggctcagtgttactgagagaattggcatgtgcaggcaatgttgctgatgctaccctctcagctcaggccacgcctctgttgcatgcactcactgcagcccatgcttacatcatgatgtttgttcacacttgcagagttggacaggtaagaataatcatggggctatggtttcagcttaaagccaataaaatggcaaggacctatatccatctgctagattactggcttgggaacaaatatacctggagtcatagctgaaagaaatgcattatttttatttagtactgttttttttttctgaacaatatatctggtggtggttgtgggtttatattttaaattgccatggagcttcattctcttattttttattagctgttgtgtaggcatatacatttatcatatgaatagaactttaagaaaaaccataattattattttttattactatctataacaaatgactgtttttgcaggcaaaaattatttgagtggccattgcatcttaccgctatctttttaaaatagcaaatatgaaactcatttcattgcatttatttaacttttgtttacttttgtgtgggcctgataacttgatgggttttgagcataccatatgggatttggggaggccagaggacaactttttgaagtccattcttttatgcttttatgtagattctaagtatcaagctcaggttattgggcttccctggtacctatatttatccctaatccttctcaaaaaaattattatttcctaatctctatataagtacatatagatccaacagtggaatggcaaaaaaaattttttttaccacaaagcgtttagttagcagacagcaacaagaagaaaatgtgtcaaatgctatgtctgcattctgtggtcttgttcataaagaaaactgctgtggagacagggaagcttcctcagtttcaaaataactgctgtgtaaatctgaagacttgagttttcttcttttttttatgtttttttttttaattttttttcagacaggttttatctgtgtagtcccaactgtccttaaattcaatctgtagaacaggctggcctcaaactcagagatctgcctgcctctgcctcccgagtggtagctaggattaaaaggttgtacccccatgtccagcaaagacctgggtttcaatcctcagaaattctgtataaatgcctgacaactttgcacatgcttataatcccaacactgtaaaaaataggtgcatttctggggcttttgggctagccaaaaattgtctcaaaaacttaaggtggtcagcacctgaggaacaggttgttttctagcctccatacgcctagatactcgtacatgtggtaacagaagtacatctcctggctctgtgtttgtgtattcactatttttaccatgtttatgtctcagtaatttattacaaaaagttgttcaacagttccaaaactgggtaagagtacgttttctaccagctacactataatgtagcccagacattgctcgcactcagtatttcttgcctccaaaaatgctgggattataggcagatgatatcgaaccaaacagtaaaggttgatattttaaaaatatagtatttttaaagtataattgtttgtagacagtctcaaatacttatcctttggttgcagagtgaaattcgttctatctcagtaaaccagtggggttcacaattgggtttgagtgttctgagcaagctaagccagttatactgttctctggtgtgggaaagcactgtcctcctctctctatgtacccccaacaggtaagagaatgctcatttctcttaacatctctctttgtttttctaatagacaaagtttgaacagggtggatgagtttgattaaaaaggtccagttttttatccttcctaccttctagcctatggatttaactgacaaattataacatcctctgaatgtttaatatgatttcctggagatagttgtgttagcacaatgcaaacaaatcttgtttgttgcttcttcaagaatcaaaatttttttttattgcacttaggatagcttaggtgctcttagaggtactgcccaagcagtatataagtatatatgcagaatataaattgtaatagcacttaattctgtttgttttggttttttgtttgtttgattatttcccttgttgtagcctaccatctggatgtgaatttggtcaagcggacatgcagaaactagttccaaaggatgagaaggcaggtacgacccagggcggaaaaagatcaggtaactgtaagaaaaataaaatgtaatgactgttacttctaagttatgtccctgtgacttccacaggtcatgtgcttactgtgagacttagctctccatcatccttagtcttcaagttgattttttttattaaatttagtttttgttgtttcttctgtaaaaacatacacatattataaaaaaatactggggtaacaacatattttgccaccaaacatttgagagttatctgcctgatacttttccttagtatatttaagagtctcttagatatatatatctttgttttgtaaatgccaagagttgactattcccagcttatgtgctacttaggaaagtaaaagtctttcatgtagttttttataaatacaagatagtgtcctgacaattatgatacctaaaggtatggtaatattttaatttcatttatgacttctcaacttttagtataaattctctgtaacctgttgggaaaataatttttctcatttttctgaataataatattgatcatactggattaaatgatttgttaatggaaaacttccacctatttttactttttaaaatggatactcaaagttgtatgtatggcttacattctgtttcttttagacagtagtgctttggaattatctttttttttaattgcattgcaagttccataatagtataatcagaaatcacataaaattctctgatcttgatgtagcaaatgtgaaggtgataaaaaaaatttccagagattttaaagacccaagtacctaaaactgaaaaataacgatgacgattctatgtataaagctgtcagatattctttaaaatgaattgaaattactgagaaggaaacctaagcaaccaaaatcaaaatggatatatcttaaaaataagagcttacagcagctgtttgttaggagtcagaataagtatacacagacttctgaggttaattttgaagaaaatgtatatttcaaattttagtccatttcaaatacaactcaataaaatttattaagaactaggaatgaaattaaaatcctgaaagaattgtttctcccaatagtttacactcttgtttgggggcgtgggtagccttggtcagtcttcacatttttaccacctcgtttctagcaatttggttaacactcaagtcacaattccttaaaactattaaagaggaattctgaggtttagaaatacatagtcaaagtccggtaatccttaccattgtggcttaaaggcaaggaggattagcacctctgacttcatactgagtgtggaaccagtttgagaacttgcctctaaagggggtggggctttggttggagagatgtctctttaagaacactttgctacactgtcatgagaatccaagtttgtctttcagtacacatacataattacaataattaaatgctgggaaatactgtcagaatactgtccagaatactgtccagcagtattctataatgttcaattttaatttgaaaaaactataagattctaccaggacttcttcagtgatagcttcaaatatgataccggtgttaagatgcttcatatcctttcatttggagatgccagcaagtatttacttattagagctccagacataaaagcatattggtgtcattcttattgttgttgtgctttggatgtggaagattggtttggtttgagcttcttaagaactaattgaaatttaaatagggataagcaccatagataactattttttgagacccttcaaaaatggatcctggtaagtactagctctgcattatcttattacccccttttacttctaaagatggagaacaggatggaactgctggaagcatggatgcatctgcccagggtttattagaaggaattgaactagatggtgacacactggcacccatggagacagatgaaccttcttcttcagattctaagggcaaatctaaaatcacacctgccatggctgcaagaattaaacaaatcaagccgttgctgtcaggtcagtgactctccatttttagaactccctctttgggcttcagagctctagtattcctcaaacaagttaaattggaaaaaccatattttaaataagtcaatgttgtagaaatgttgtgactctcacatgtactttgttgaatccctattgtgtctcatgctctaaattggttgctaaagatataaaaggagataacttcttcctgatctttatctactcttccttttaaattttacttgtttgttcttcagttattgcaaatggcatctcctattattctgctggaatgtctcccagggtaccttactgctgagtctaccagatacttttttttaaaaataactcttagctttttatatgaccaagcaatcacaattttcaccagtctcattttgctttgattatccagaaacatagtttcttgtgttttattaaagttactttggcagctttcaaggagcctgcattaaagatgtaaaatgattgtgtttgccaccttttgcccctttatatgataccatcattcagaggacctattttgtatatttattaatagttaccatttaggatataagaagaaagccgggcagtggttgtgcacacctttaatcccagcacttgggaagcagaggcaggcagatttctgagttccaggacagccagggctgcacagagaaaccctgtcttgggggaggaaaaaaatatatatatacacatacatacatacatccatatacatacatacacacacatatgaaagtgaaaatctaactcccaaaagcagagaatgaccttcaaatcctaaagattttatcgttgtgcttgttttgatatgaattttactaattatccctgaattgaagtaaagttagatgatgtttgttggtattgtcttagaacattctaaggtttgtggtagatcagaaccatgttttgtctgtttccttgctgatcaggcattttgttttcttacctttgatagatttttgagctgttttgctatctgttcatatgtgagtaatactgagaaacagggcttggttgcattttccttttgacttaaattcatttaagtttttagattctgagtatgccaaaacttccacctaggcagtagcctgttccataattaatattatacaatataaaattatgtagaatagaagatgaataacttttctgtatagatgcataatcttactgttttaagcgtgatctttaagaataaaaaggttctattatttagtaatttacataatttgtattttttatttataacagtgttctgtgtgtgtgtgtgtttgtaaatttaaatatagaaaaggtctagtgaaatgactaaagtgactacagtgtaaatgagagtttaggtctttaacacccagatggaaagtcaggtgtgacaacatatttcctgtaatcccagagctcatgtaaaggtacaaggagagaacagacttcttaatggtgtcctctgacctacagacttactataaaaatgataattatttttaaagtatgaggagcataggtgtgatactgtaaattgtgtgaatactttatagaattatactaccttctgggtttcagcttcttccagattaggccgagcacttgctgagctctttggactccttgttaagctttgtgtgggttctcctgtccgccaaaggaggagccatcatgctgccagtaccaccactgcaccaacacctgctgctagatcaacagcttcagccctcactaagctactcacaaaaggcttatcatggcagcccccaccatatacacccactccccgcttcaggtgagttcctgttttaggtacaggaagtagaaagtggcaataaaaatgatgtatgtttcttcctattctactgaggaaaagtttagaagtctcttgctttctctttatatatattccatatgaagtatttttattgtacttagtatagagcatggaaatttctaaagggtttattgttaaacagtatttaagtaaccttctaattcttaattgggtggcagatatcacaggagtgccaaactaatctttcacctaaatactttgctagcctttcctttagattttttttttcacttaatttcctgttgcttttttgtgtgtatcttaaagatgtttgtcttttctttgttttattttttaggctgacgttcttcatctgttcagttggattcacctctccaatgctctttgatgagagaaagtatccttaccaccttatgctgcagaaatttctctgctctggtggtcacaatgctctttttgagtaaggatcatttgcttcacaaagaatagtttcttgaactttgatctttcctatgtggcttacctgctcacagctttctaagtcatttatcctgtgatgctaggatatataaagagagctattagttgtatcattttgtgttttatgagcaagccatgtatttcctctgaagaaagtctgcatttcagctagagaggtggttgagcagagaagaggacgctgcagctttttcctgggacccatgttctatctccaatacctatttggcatcttactactgcctgtaactcattctagggtatatgattacctcttccttggcaataaacacacacatgtcaacaaacactcataaaagttttttaaaaaaagtacgtgcatgagtgtatataggatctcttgtttttatatttggctttctattcctactactacacatttttttctttgagtacagtaaatttggtttttgtctgttttactttacttggccaaaacattttaagatgaacttaagcagtttgagtggattttttaaagtctttaaagcatatgtaaatggcatgttaaaagtaataagaacttcacatgagcctaacttaatacataaagtattgacctttgtcaagaaaggtttcttctgcagtaagaaagacaatttcagaaaaccacatccactcaaaatgctgagttatggagcctagttctattggatacatatacaaaataactctgtacctaaagctcagggaagattgtagaacaaggggtaggaaaattgtaagagccgggtatcggggactgtgaccataaagtttccccagtgtttcagcctatacatgaattgaacagagaaaacaacagtagatgttccaaagtgtggggagaaggccacaaggactcaaacctatacaaaggtctatacaggctattaaggaatgctcagagtgtgagttttccctagggaagagcgtaaatggtcagccctgaaaaatttgcatacaattaacattatacagattgaacatgttatatttatcaatatatgagtatacatgtatatgcatttatagcaacaaagaaagaggccatgaatttgaaagagtgagtagtagtatatgggtgtagtattggagtgagggggagggaaggagaaagtgatacaattataacctaaaaaacaaaatgtgtacgaagaggataaaagataaggtacaagtgtattagtgatctttcaatgtaaaatactagttaatactctatttacatgttttgtcttatttgaatttagaactttcaactgggctctatccatgggaggaaaagttcctgtttctgagggattggaacattcagatctacctgatggtacaggagaattcctagatgcctggcttatgcttgtagaaaagatggtaaatcccaccacggtgcttgaatctccacattcgttgcctgctaaattgcctggaggagtccagagctttccacaatttagtgcccttcgcttccttgtagtaactcaaaaagtgagtattctacattttaaaaccaaagggggaaaaaaactcttcatgctaggtagttatcactacactctgtccatattaaaatgtgaattttgaaaaacaaatggacttggttttcagattagcttttttttttaacaaaaaacttgaagtacatgcttctgattggttcttcttgttgacttaaatgttcccaccctatcatacccaccatctacatgccagtctaactctttgttgttgttgtaactgactcattgtggaaggggcatgtctgtgagtcttattttccttctgaggatttgaattgatggggaaagtcatcatacacttttcaaatggcttacaggcagcctttacttgtatcaagaacctgtggaaccggaaaccccttaaagtatatgggggaagaatggctgagtctatgctggccattttgtgccacattctccgaggggaacctgtgattcgagaaagactgagcaaagagaaggaaggatctcgaggagaagaagaagcaggccaggaagaaggtggctcacgcagagaacctcaagtcaaccagcaacagctacaacaggtagagtgctcagattctacactttcaccttatatatagactctaatgctcaaaaatttttgatttttaacctcgtctcactgtaggcaagactgacttcaaattctgagagttatttgccactcaacttgcttgtaaattttctaagctttcataccactgctttccttggttcttagtttctcaaagcatttttttcctagtgaggaaaggtaaaaggtatggtcccagtactttgtgcagaaaacatatctatattttcataaacatattaattacattgttttcaggaacctgcaaaaatttttttggtagtactgtcaactactttctggttaaacgataaggcaaactattatagctaaatatattctccagtaaaagacttttgaaaaactattcactaaacctgtatgacgttaaaataataacattttgaaaaataaagaccaaaaaggggaagtttcaaagagcattttaacattatttttcttacttttcttactctttgagaattttacacatgtattttaatcatatagccacccctccaacctccttccctagtttccccaacccatttccctcctaccttcgtgttctatttttctttttttttaaataacccactgagtcccgttaatgctgaccgcatgtatgtaggtatatggccagccactggaacatagaaagcttaacagttgccagaccctgaattactctctcttccccagcagccacaaactatcaatagctcctcagctagaggtggggctttgtgaacccctcaccatccttagttgaatgttcattggcttcatcatgtttcaggtaactacaactcttgtgagttcatgagtgcaagggccatgcatgtccagaaagcagcatttgagaagcattccatttcatttcccatcttaagatctttctgacccccttcccaccatactccccaagcaagcctttggagggtgggtttaatatggactgagcacttgaagttgcttattctcaatacttggagtaaaagtctctgcattaactattgcctacaacaaaaagaaacttcttttaaaggctgaatgcaacactaatctataggtataaatattgaaaagttagcttaagtacatgactttctcagccatgggcttttgaccaggtatatatattggtccctcctgtggaccaatcctcaaatccaatgaggaagcagttagttacctccataataatcatgccaccattgcatggggtctgtattgtagcatgcctggattcacagccgggtaagtctgttaattacttttctccccaagtgacctacatagcagtttctggcactgtgaaagctagccagcatcgaaacataatctagctccattataatttgatttctctgtgtcctgtaaccaaagtgtgttgcatcttcagtgatggggtctgaacaacctagctaatcattggcaaccaaaaacaaaggtaatatcctgtgctgtttaaagggacactgaggcttcttgaattataatacttagtaacatattccatgcctggcactaagatttttatttaatatgatccatgtcttctgggagcaatgttttctactcgtgctaggtacttcctcaaatttttaagtatgaagtttcttttattcaaatctgtcttatatatatatatatgccttgctatgtcttattataaaaataagttcttgtttaggaattttgagactttatactaatatataatagtatatataattgtattcttattcaggaaattagtctattttagttggatgctatggtatagttttttttttaatatacaaactcttataggtatatcttatttcacaatcactttgtgatcattgaaatccttgatcagttttgtagatagattttctgttgttacaagtttctaattcagaatacaggtgccaatttatacttcagtgtatctcaagttatagtaaccatctaccctggcctccattttgagatgatgaaattgagacatattggttcttttcatcaataagcaactttaatgtttggatattatataactaccaaaatgaaaagaacattgatgataaattactgttctgacttataagtactgttagttcacataaacaagttgttacttatttttttttctgtttttgtttgtttgttcgtttgtttgttttatttctctgttaatgtggctctgggctcttggtttttttgttttgtttgttttgtttttaatatagctcatggacatgggtttcacaagagaacatgccatggaggcactgttgaataccagtacgatggaacaagcaacagagtaccttttaacccaccctcctccaatcataggaggagttgttcgggtgagttgacacagaaacatcttaacattttactgtattactttagctgctgagccttttttacccacgtcctttgcctatgctttatgtactaattctgaaagcttcagaagctgctaggatcttctattccctggccatgctgcatttttttttttttttagtgctttgtttgcagaattctttcttacttaattttcattgtaaatttccccattgtccctgtagtggttggaacccacataagccttattttggtttaattagagagagtaatattccagtctcattccctttccttatgagagtttgttttaatttaggttttattattaggggatttgtatatttattggattctctgttgttactttgtaggatcttagcatgtcagaagaggaccagatgatgagagcaattgctatgtctctgggacaggatattccaatggatcaaagggcagagtcacctgaggtaactaaagtctaacattcaaaagtatgttttcccattaatctgtgtatttctgtgaatactattttttgtattctgtaatcactatacaatggtaggaaaagttgggggagtgaatacttattcatctcaacgttttgatatactcagctaacttttatcaaccaaaatgaagctgtcgatgattcaaatgaagtattagtctttgttgtcaataaaacccaaaatggaactagtagtaaccagtcgtccaaacttagctatatgatgttacttaaatttaccacactggaaggaaacattggataggatctaaaaatgagttttcttgagaatagtacatacgatgttataaatttcaactgacaaagtttttgggtgctcttagtctgtttttcctatattgcattaacctctttagctattatgttacattcgttgccatgtccttttgaaatattcaactttttaacaatgtagatgatattcaaagactgaatcaggtacttaattttttattctttacctctggcatatattatcccacttccttttctacctccaggaagttgcttgccggaaggaggaagaagagcgtaaagctcgagaaaaacaagaagaggaagaagctaaatgtctagagaagtttcaagatgctgaccccttggaacaagatgagctccacactttcacagatacaatgttaccaggctgcttccatcttcttgatgagttgcctgatacagtgtaccgtgtttgtgatctgatcatgacagctatcaaacgtaatggagctgactatcgtgatatgattctaaagcaagttgtcaaccaggtaagttctcaaaataccggatttggtagtaaagttgttttactgttatctgtcaacttcatttctgaaaaagtcttgcattctacaccatatgtttatattctggatttgaattcttttgtttgcaatctaactctacttggttgtcttcctcaatttatttatttcacacgaaaaatagtcttcagaaggtaaaagcagagttacgtagaataaaagtcttatgtttgaggtaaattacatttcatattaagaaaatactcatttttttttcccgttgtatgactttctgatggatattcaacccagttttgttactatttttagtgtttgtttcctctctgttctaattattgggttgggataagaaacaaagtatccccaatctacacttcgagaaatatccctgtagcatttatttgtatatctttataaatttgtatcactatatgtatttaagtctttaagattttgttttataaaatcttttcttgggtatcatttaaaagaagaaatctgtggagacaatgaaaacataaggattgtttgttagctttaaaaaaaaaacaaatggaaccaatgtggtaggtgtatcacaggaatatgtgtgaggggttacttacaggagcagaaagagctgaatgacagttatatcactaaagcttaccatggatgatacctcacaaaaattgggaacctggaacacagtgtactacactaggctcaaaattatcttttctaagtcaagcatctgtttttttctagacagctggccaaagcataaatttttaataaatagaaagataatcataaggaaaactagatacacaatcttttagtgaaatgtgtggttacacaaattaaattagtttgagggaggttaaattttaataaagatcagtgatatccctatactaattttaaggaattgaaaatttaataattaaaactatgcttctattctaacattttagtagttatttgaagtaaagattggcagaatcttttggaagtttactatgtataccagaaaagttttttttacattcatgctggtttagaattcaggctttctgtaataaaatttaagaatagctggtttagcaaagtgtaaaagtaattacctgccaagaacccacatggtacacacaaaaaggaaattaaaaaaaggtgtttagaatgattgttaatgattatgtcttcttttgaaacattcactatcataaataggttgttatttctacttttctgcaaatatattgaggttggagggaatatgtttaatattttcacagactgggttactctatatgtacatgacttggctgcttattttgtgtttgtgtgtgtgtgtgtgttgccttttttaggtgtgggaagctgctgatgtattgatcaaagctgctcttcctctaacaacaagtgacacaaaaacagtttcagagtggatcagtcagatggctaccctgccacaggcctccaatttggctactagaatcttgcttttaacactactttttgaggtaacagatcttttgccctgtgtaatccacttattaaagaattacccagcacttagcaatacattgaattggagagaagtacaaaatatggtccttgtatttcatgtgtaccaatagactaaaaatgtacatcatgaggttaggggtagaaggttctgtgttgggaaagtttatatatatcacttatgaatataatgcgagaagaactttttagaacaagtgttaagtcaaaagatgatggtcagtttctgtcattgtagttgagtatgtacatgtgtaaaagccatatacacaccagtcagataccattatagaaggggatttcttcgtatagcattgcctgtctaggaattagccctgtagaccaggctggccttgaactcaaagaaatccacctgcctctgccttccaagcactgggcttaaagatatgtgtcaccactgcccgaaagtaaagaactgcatgtttatgatcctctgtagcattgtaatattttaaaaaaaaggtgattcataggatctcgtttaaaaaaattactaatttttcctttctagtctttttcatttaaataatcatgattgtttccctatatcatatatatacatgttattttttctaaataaccatctattgttacttataatagttttctgttaaaaagcaaaacactttaatagtactgctaagaatcattatttattatcttagttttcttggaatattttaatgcttccttaaaaatcaaaaacaatttaaatgttaaggctgcatagtcactactgagtggtagtggtgatgggaggcagaggcaggcagatctcttgagtttgaggacagcccagttagtctacagggctatatagagaaaccctggcttactaaaaaataaaaaaaacaaaccaaaagagtgtgtagcctaggtgactattatgcctgatgctatgtttaatcattacaatgactgaggaagtagatataacttctcttaactcatgaggaaaccaaaatgtagaacactctgaagttactaatctgagtccacatagctcagctcataggtaataaggaatagaatttgcatttaattagttgtataaatgttaacctttgtttgattgtcttttttaatcaggagttgaagttaccttgtgcctgggtggttgaatcaagtggcattcttaatgtcctaatcaaactcttagaagtggttcaaccctgcctacaggctgccaaagagcaaaaggaagtccagaccccaaagtgagtggctctttatctatcctggtttaacttctgtttctctgagacttggcccttgagtttagggtctgaatcacttttctgaagcatatgtgaaatcctgagatctttatttagacaactataaaatacctgacattttccgaatttgtgtagttttctgccttacactaaataaataatttcttcttaggtggatcaccccagtgttgctccttattgatttttatgaaaagacagccatctcatcaaagagaagagcccaaatgactaaggtatgtgaagcactatgtctttgttttacatggccatttcatttcttgtggcagtagtagacaggaaaaagtaaagatcagaagtgaaaactgtaaaatcatcccacaaaaatacaactcttgagggatttcattagttaagtttctcttttaaatgaacagttcaagttgttgttgttgttgttgttgttgttgttgttgttagcagtagcagcagcaccattgtcagtatttttggaaccatttggtaaaggcctcaagatcttactatgggaattagtatgctctttggctacttgaaaaaaactgcagtctctctagaaatattttcctgaaacaaagattgtagtattccataatatctcagtaagttcttagcagcatttgttccttatatctctcatgatcataattcttttatcaaagataatttaaaacaaaaggaagaataggttgtcaagataggaaattgtcatgggtttttggcttggaaaaagaccaagaaatgaagaaaggcctcttgaaagtatattaaatgcccagtacatttttttcctgcattagttttaagcagctgtctactgatagctgctgattattttgacaataaaagttgcaggaaatatgaagatactttatgcatttgcattttatttagtacctacagtccaacagcaacaactggcgctggtttgatgaccgctctgggcgttggtgtagttacagtgctagcaacaacagcaccattgattctgcctggaaatctggagaaacaagtgtaagattcactgctggccgacgaagatacactgtccagttcactacaatggtgcaggtacatgctcaacttataatgtaaactttattgaaaaggggatagtcctctcaggctaaggagtaggactttgttttttaaggacagctttgttttgtctgaattcttaggttaatgaagaaacaggaaaccgacgccctgtgatgctgactctcctcagggtgccacgactgagtaagaactcaaaaagcagcaatggacaggaactagagaagacactggaagaaagcaaggagaccgatatcaaacataaagaaaataaaggcaatggtatgtgccttacattttgcatttgtttttccttccaagtaagtggttgctcttgctggatatatagctcaagctagtctcattcaaaatccttctacctcaaccacccaagtagttggaattagaggtgtgcactttttgtaccatgcatttatttttaatccttttttttgttttaactctgaaagaatggatttgtttaattgtatttagtacctttggaggccagaagattatatcaagtcccctttaagccggacttagagatagtcatgagctgccccacagtagagctgggaactgaactcagtcttctgtacatgatcttattcacagagccatatctccagccccctcattatgagttatattaacatgatttaaggtagtatggcttattatctgaaactcaaagagacagagagatggtcttttcctaagacctttacatctggtcttagaattaggtgtgtttttcagctcaagtgatggctgattattttggaaggagagagatcgagtgaaatgtcaaattgaaaacactttttttttccaatttgtagatatccccttagctctagagagcacaaacactgaaaaagaggcaagcctggatgaaacaaaaattggggagatcctaatccagggcctgacagaagatatggtgactgttctaatccgtgcctgtgtgagcatgctgggagtccctgtggacccagacactttgcatgccacccttcgtctctgtttaaggctcacccgagaccacaaatatgccatgatgtttgcagaactgaagagtacacgaatgatcttgaatttgacccagagctcaggtttcaatgggtttacccccttagtcacccttctcttaaggcacatcattgaggatccttgtactcttcgtcatactatggaaaaggtcagtatttttgaagtcttgtgcctgtctgtatatttgttttttttttttttctttaatgttcctggtatgttgtgcactgatgggcctttaaccattgtaaaaattagaaaataggttcttatattttagaactaaatgaatatatcagtggaagaaatgaaaaaaattataaaaatatttacattaagtataattaagagataaatatcttaatcagcaaatctttgtacctcctaaagacttttgctgaattcttattcttcttactaaatcattttcagtaatcatataaatattagtaggtttcaccctctttcttggaacattagaattttttattcttccttcaagatggttttgcatcacgtgtccaaaatcacgagacttagagctgtttaaggcagcatatttgaggtcagtgggggaagaaatagttacatatagacagaatttgggctttaaaaaacccaaatgtttaaaatgctaaggtgatgtatatacagaacatgattgaatgaagagaatctttgaaagacttaagtattaaattgaagcagactacaacaggaacaaaagaagataagtagcaaaaggcattattggtaaggctacatcattgtaggacagtttcatggtgcagagtaagagaaccttctagaaatttttttttaaacttactttcttggtggcacatgcctttaatcccagcactcaggaggcagaggcaggcagatttctgagttcaaggccagcctggtctacaaagtgatttccaggacagccagagctatacagagaaaccctgtctcaaaaaatcaaaaacaaacaaaaaaaacctgtgtctccacatgatatagtctaggtttaagaccagtttagctgtttaagctgttgcagtagtttggctaaattacactgcaaggaagcaactgcaccaaatctgaaaatttgttggtatgtatgtacaaaaaagtacagtgccctcaaagtccagtagatctcctggagctggagttatagcctgttataacctgttcatcttgggttctggcaactgaatttagtgtctctgcaactgtacacactctttccattacacatctacataatctatagctaaagatttgcctcatgataaatattggttatacaaaaatacatagaatataatatcaagaaaatacaagtctaatatcaaggagtagacaactgtataaagtataaatcatggctttacatataaagcaaaacttctgtattttaaattaagaaatataactggctagataagccagatcttctaacaattacaatatgctatactagataacatgagtagtttgttaaaatacaatatccccaaaagattatatatttctaaaagtttttaatcgcaggatactatacataaatttgatagctcttttagctgtcatctcaaagtgatgattgactaaataaagcatgaagaaattgttctattatgttaaatataattgaactattatagcttaaaatcacagcatttgcggagtcttagagcctacacttaaatgtggaagctatatagcatgtgtaatcagatgcacctcaataacattcatgtaagaatttagttttgaaaacctttatgacttgtatatgagacttattttaattgtaaagagtcttgaagaacaagcgtatctttcattacttaaattgacaatgctttttactaggttgttcgctcggcagccacaagtggagctggtagtactacatctggtgttgtatctggcagcctcggttctcgggagatcaactatatccttagagtcctaggaccagctgcctgccgcaatccagacatattcacagaagtagccaattgctgtatccgcattgcccttccagcccctcgaggctcaggaactggtcagtttcatttgctactattctttcagaaaattctctttaggcagatattgagacattggttgagcatttgacttagtaaattctgtatgtaattctcagtaatttctcttggcctcttaatacaactcccaaggattcactctagtctttacctacaaagtgttcattttgatgtgacaatagaagttaaattaactgcagttggtttctgtatagtgcgatcattgaaaaacaattgtttgtttgggtgacagaatccaatgaaaagtttacagtgctacctgtattcttaccaaaaagttaatgcctgtatttcattgaggaagtaattacatttatatcaaattatggaaatattttactgaacagctagcctaaacccatggtaaacacgaattgaaaggaaaaattgaagtatctcagcagatgagaacggtcacttctacttggattggattctggatccatttctaggagacttgtaggatatatgaagtttctcagaagttcatacagacatttaaaaaattgtgagattgtttattgaaatataaaaacatttcaccgggcagtggtggcgcatgcctttaatcccagcacttggggaggcagagtcaggtgaatttctgagttcaaggccagcctggcctacagagttagtttcaggacagccagagctacacagagaaaccctgtcttgaaaaacttaaaaaaacaaaacaaaatttgtttatagtttataaaaggtagatttctttactataagacttgaacttaatttttaaagaattatttctcctgctttttatgtactacacaatccttgttctgggtactttcttgttgatagtgaataccagtgttctattgtctgactttactgtttaattttggcctagcttcagatgatgaatttgagaatcttagaattaaaggtcctaatgctgtacagctggtaaagacaacacctttgaagccctcatctctgcctgtcattcctgatactattaaggaagttatctatgatatgctgaatgctttggctgcataccatgctccagaggaaggtatgtatctgcaattggtgttctgaaggctatattatctcgcatgaatcatttcagctagcacatggcttagtaagcattatacccacagtcctggaatcaaaaggtgaatatgatagggatgacataaatggcccagaaggtaagaacacctgccactcttgtagaaaaccaggattcaatttcccagcattcacatcagccaacctcaaccacttgtgactctagattcagaggatccaataccctgggcactgcagtcacctgcacacagatgtgcatgcacaaacacacatacataaaattaaatcattaaaaaacaattatgacaaataatacacacctgaagagacttacttactataaaatacaagaggtgtgagaataatggtgagtccttaagataatgtgtgtaaatctgttctgataatggttcttgaatgatattgatgaagagtttacagagtgtctgttgtttgagaaaataatataccataaacagaaagctgtgaacaaaaagttcttggtatttgttcacacagcattgtgtgatcaaataccaaaaatttttttaaagatatatttttattatatatgtaagtacactgtggctgtcttcaaacactccagaagagggtgtcagatctcattatggatgggtgtgagccaccatgtggttgctgggaattgaactcaggacctctggaagagcagtcagtgctcttaaccactgaaccatctctccggcttcccaaatttttttttattcttttatacccaaaagcaaaaagtatattattagtgtgacatggcttccttttcagacctccatcctaatcctcctttacatgtgaatgattggaaaattatgtttgatttgcttcaaacccaaggttctaatccagccatgcttttaagttttattcaggctataaatagtgaaatgagcagtgatcataataactgtagaacaatgtgagactttcatttggttttattcatctttacaatattctgatcctttcctcctatccccatatcattactccatctacaatgatttagctctaattgatgtacctattgactggcctcatattatacaagccttttgcactaaatatgttcgttgggggcttgatagtgacagtttaaaaatgtaagactaatgaactgctttggtcataagactaattaatgttggaataacaaccatgctctgtcagtaatgataggcatacattttgagaaatgcattaactgatgtgtaaacataaaggtcatttgctcaaaactaacttggtggtataccgtgctataaacataggttatattgtatataccaatagttttgttggttctacaacataattattgcactagtactcttaaatgcagccctatgaacattgtgctaatattgcacaattaaaggaccatattttaatttagatgtttgtttatatttttctagcagacaaatctgatcctaaacctgggggaacgacccaagaggttggccagctcctgcaagacatgggtgacgatgtataccagcagtaccggtcacttactcgtcagagcagtgactttgatacacagtcaggtttttccttaaatgtaagtcaatttcagctgtcctatattttccttctctttccactgctcctactttctcagtatcttgggttatccaaaggaagctttaaaagtataagttttgtcagtatgatggttcgcacctttaattgatcccagcattcaggagacagacgtaagcaggtttttatgaattcaaaaccaccttggattacatactgagaccctgtttttagaaaaagtattaattttaatatatgtgtaaattatttattgcagaaaagtaaggtatattaggcatttttacttttgattttgttttttgtttttgttttttcttttgaacttgactagtctgaaaactgtgatagcttcctatagattatagggagaatgtggttgaaagatcaactaagaagaatctgtagcattctcagacattacttgtaaaaggagtcataacacttgtattcatcacagctcacatgtattctttcagagtcaggtttttgctgcagatggtgcccctgctgaaacttccacaactggaacctcccaaggagagggtaataatttgcctttctttattatttgctgcaaagaacacttaaagaaactggttgtctctgcactagagtagaataataggtgtcagtgtcatatttacatttgtttactcatctaagtgatttctaagggctgtgtctgatcttctgcaggtataggctgctgaagttaatagaactgtaatttgcattaacttgctaatgttgctataatgatgtcctttggttgtattatttgtactagtccatatgtccttttgttcgattcccatgagctggcttgcatagtgtttgtgccattgacatgattatagcaatacactttttgtagttgattcctttaatagagctttaaaaataaaatttaggagacacttcggttaatatactagttccaagagattaaaaggtgagaaagtaagctatcttaccttccacaggacctgagttcagttcttaaaagccacatgtcacttacaatcaaccagtcattgaaataatggcttcctcagaagcttggattgtaatgattaagagctctaacccatatttgttcttgcagagtacccgaattcttttcccaacactatttctggtggctcatagctttttggggcatctttgctcatacacatatccacatacaattaaaaataacatcaataggataattgctaagttattttactggccttactaacagcatattagtcaaagaaaactgtctttgcccttagtatgtggcatgctatattggatgcctacctacagcttaagaattttgtcaaatgagggagacggcaacaattgtaactaatggaatgaacacatacttccatgagatatagagagaccaatatttccatatgtatctagatggcacttgagttgaattgcatagtgtgtagtaggcaaaagaaaggagatggatatttaaagaattactactaattcattatttctaggacatgaaattgcataaacatcaggaaatagtgggtgcctggatgtttggtccaagccttcctactatgtcttatgcatattcatcatctttgtcatttaactacagtggtaattagtgatttgtacaagtggcctaaaatgaagaaatactgtcttcattctacctgtggcttggtttttaatgttattccagtgtaaaattgagtgtttacctgttttctcaggagcttcaactccagaggagactcgagaagggaagaaagataaagaaggggaccgtacatctgaggaaggcaagcagaaaagcaagggcagcaaacctttaatgcctacctctactatccttcgtcttctggcagagttggtgaggtcctatgttggtattgctaccctgattgcaaactacagctataccgtgggccagtctgagctgatcaaagaggtaatatttacagttttttctttctttgatattttggttatatcctagactgtgttggaaactataatactcattgaaaggaaagctagtcttttcaccatgatgtgaagcaatcagagtaactgcaaggaaacagttgatgaaatcttttgtatcttgtttggcttgacaaatttttagattcttctttatttgagtcatttttctgtttgtcactaacactgtagtattgctatgtaaattatacagatgcatatctctttggtgatgtaggcttaagaatattattgctgagctctagaacatgaatttatatagctttaacagatgctacctgaagtttaccagggtgtatattctagtagtttatgagagttctgattgtctcaccttatgccatcacatatttcattttatttgttccagttggtttgttagtagttttgtggttaggatttgcattttcttattggccatattttaatgttttttggttattgaaaaagggttggttggttagtggtgagactcttttgttggccttaaattcctgggcccaatcttaccatcctgagccactctcaagaatagctggaactatgcttgaatgccagttaacacttggcttcaagtgtttcattagattccttatacattgtatatgtgagccctttttgtcatacatacattcaacgtgtatatacttggtttcatatcaaagtttatattcatatgttttattcctaatttatggaacaaaacatttaactataaatgtattcggtatcctgcttataacttacccaaacatattataggtgtggcaaggtggtttataaataacattgatatgacaactccactttagagttattagtagaagtatctccttagagttaagagataagattcagagatacaagtgagggcacactgtatagggccagaatgaaaattgaaacccttgtctttgattctaagctaagtgcttgttgtgtggttacattgaaattcttttcatattgtactatatgacattactaagattcaagaagttttagctttgtatttcattgaggttgagtttgtccagttctccaatctctagagtcctgaagtataccctacttattgatataaatttgacataaaatcattattaaaaagtgtgagttgagtgacatttaaagtgttacacagctattacttcttactcccaaaatctacctgaaaaatagaacctaattcttttcctaaaaatcagagcagaaattatagagtaaaagaagggtccgtcttccttgttagacccttttgcaatttttaggtgattctatatttcattccgctcccagttttcagtacagggtctcaggcacattgcaagtgttaaaaggaattatagaatacaaaaatggatgtttgaatcctctacccttgactaaattcttagtgcaagctacttttctttaggtctcagattattctcctctcaaatggagaaaatgcttgatttacttcagtctattttattggcttgttataatcaactccattaaagtcactcaaatacatgggctggaaagatagctcagtggttaagagcactagctgctcttttagaggttctgagaggtcaattctcagcaaccacatggtggctcacaaccatctgtattgagatcccaatgcctcctctggtgtgtctgaagacagcaacagtgcgctcacataaataaaataaatatttttttgttgttgttacgaatacaatggtgttagctgtctcccggaatcccagtactctagaaagtctaccaagctagcctaggctaggctatatgattcccagcctcagattttttattattaagatatatcaagtattgttacctgtggtggtgtggtggcacatctttaatcctagcactagggagacttagtggccacagtcgtctatataacaagttccaagacgagctaaactgtgtgagaggccacatctcaaagataaaaagtagaaagcaacatgataattccatgactgtctgtgccatgtggtaagaaatagatggaatctggaagctttatacagcctcttaaagatttctaattggttcactacttacctagcttgtaccttggatgacttgaaagaaaaagtttctactttgctattataggtatggtgtggattaattgcacttttgagtaaatgtcataattaatgacttttcaggactgcagtgtgctagcttttgtcctggaccacctcctcccacacacccagaatgcagaagacaaggatacacctgccctggcacgtctattccttgcaagtctggctgctgcggggagtggcacagatgctcaagtggccctagtgaatgaagtgaaagcagccctgggacgggcgcttgctatggctgagagtacagagaagcacgccaggtaaaagcccatgtctggcctagtactgataaacaagaacatcttttactccatggtctaaggagttccttgaacttgaacaagagttgtgttcacaccaacaatgtacatagaatgtctggtacccatggtcaattgaagtagatattgcaacttagaaaaatcgaagggatatttttcgctatattcagacacaaaattgagattttaaattttctgtagtaaacaaagtctactaactagaaaggtaattctctttgtagatattatttccagaagaaaatgcaaaaggcataagagaattatctaaggcattatatatagtaaagacatcttttacaaatgggctgtattcacttgacagaggtatcaaacttctctcccagacttcaggcagtgatgtgtatcatcagtactatcatggaatcctgcccctccacctccagcttctacagtagtgctacagccaagactcagcataatggcatgaacaacatcattcgactgttcctaaagaagggactagtcaatgacctggccagagttcctcacagcctagacctgtccaggtaaagtaatatcctgtggttggtaaggaatcagctgctctcgtaagaaagcatcagatgtaggtgaaaattatgatgtctgtactaaaagtggatagattttagttggttttaatgttattcttgatactttctgaaatgatgactgcttttctacaaaagtcttgccttctagatttggtggagttgctgccttgcagtgtaatttagccaaactactgcaacaacttatacctgtcttaaacccagactatatcatgtggaaacacagggttggttttttgttttttggagacagggtttctctgtatagcccaggctggcctcaaactcagaaatctgcctgcctctgcctcctgagtgcttggattaaaggcatgtgccaccacacccggccacggggcttgtttgtttttttttttttttccacctaccattagtaatccttgttaagactgactactaagctggaacctacaatctcagcagttgttttgtctcagccttcccaccaagtactaaaatttcatgtatacacatatcatgcacagctaacattaaatttttttaattgtctaaattcttcaaactcaggttaagctcaataataacacttattaacagcactccctaacactaccatttttttaagcttccaaactcaagtcatttaatggtataagtctatagttacatcttggtaacacttttgttccatatgtgttttgattttctggagctcagttcttagaaattaattttttaaaacatactatttaactccaaatactaagcaattattcctaaagatgaaacatttatatcctaaaagcttgctatatgatgcttaataatcatattctctctgatctatattcatatgttcccagttattttaattgtcccttcaacagccttgggagtgtgttttgatccaggatccaaatgaagatcatgtatgacattttgttgtcaaaaagcctaggcagcactatatcttcatttgtagatttgatccccaatgttgcataaatcaaggttggtggcaaatagctataactctagcacacagaaggcagaagaaaagggaccaagaattcaaggcccacctggagctgcataaaacagtctcaaacaaaaaaaactattgcttttctttgcacttttgacaatgctgaagaattcagggtaaatgtgttacagatgattgcctgagtctatatgtgatttccccattatgtaaataatacaagttaaacattttaagaaaaaaaaaacaataataatatgatatgtgggtcaactagccttcaatgattaaacaatccttttatatccttatcaccataagttcattcatcactctctcatcagtattcttgttacttaaacagttcatattccttttatttttttgaaaactttctgatataatgatatcccaacctcatttgtgatgtccatgagctttggttcactttagtgttagttggtatcagagattgtggccagatctacaggatccacatgacctctctagtttcagtggtgcccaacttagcctcatgttacatctctacctgcaaatactatgatattttcactgaactctataaatcctacattttgtagacttaaaagtggtcattgtgtttttaaagactaaaataggtgtgtggtagcatatatctataatcccagtacttggaatttgtaaggagaatcagaagttcactgtcttcatagagactttgactagcctgagctgtaactacatgaggctgtcccaaaaaaaacgattaaagacaaaataaaggagtttggagatgtttttgtttggttaattagttggaatgggtctgggtttttttttccttgataatctaagaagtattgatatttgtagtcatccagaatttattctggcttctactcaaggatttctcatgtgcttgtcatagcttcatgaaatatgacatcgacttaacttttgctttactgggttttattcttaaacttaatggaaagttgaaaattctagactttgcgcccttttctctcttagcttccattataagaacctgtatgcttatgagattggcacctattatttctatccttagttcttgtatctttctttatctcagtcccaatatggccaacacagtcaatgctgctctaaaacccttggaaacactttcccggattgtaaatcaacccagtagcctttttggcagcaagagtgcttctagcaagaacaagtctgagcaggatgctcaaggagcttctcaggactccagcagccatcagcaagatccaggtagggaatcagaatgaatggactgcaaaaactggatgggtgggagttgttgcttgtggaattaaactgttctagcttattgttgtttacccgggaacttgctggtcttgcagatatctgtcataatggtgtggaaatctgtcccacaaggaatttcttcacattacagctttgtttggctatcctcacatgaagccaagtctttttcttcatcacacattcatttatatttatactctgagaatttgtaaatttgcctaaagacaaatcactgtgttcatgcttgcctcatgatgcccagcatataaacaccttttgattatttattgtgctggttggttgattgtttcaggcgagcctggggaggcagaagtgcaggaggaggatcatgatgtcactcagacagaggtggcagatggggatatcatggatggggaggctgaaaccgactcagtggtgattgccgggcagcctgaggtgctcagttcacaagagatgcaggtagggaggcagatcattccaacattcttctgttgcggtgctgaaccaaactcccaagtgttgtgggtgggtgagtactttagatcttgcctcaatgtggtcttcagaggagcacagaatgcttaacatgtgtttaaattgttttagttaaaatggggctggggacagagccctttgggtatggtttctttgatttacttggctctgatcattattgaaagttacttagcgctatcttatgccatgccaccagatctcactggagtatttaaataccagtcttctaaggattttaaagaaagcatggtaatttggtagcagtgggtaagaaattgttcctgtatatagcagaggatggccaagtaggccatttatgggaggagaggcccttggtctcgcaaagattatatgccccaatacaggggaatgccagggccaggaagtgggagtaggtgggttggggagcagggcggggggagggtgggtataggggactttcagagaggaaactaggaaaggggatagcatttgaaatgtaaatggaaaaaaatctaataaattgtgcctgtgaaccttagctgctggctctaatgtgatctgcatgtattcctagacagtgttaaaacactaacctggtatttgttgaccaggatacagacagtgtgagtgtggatttattggaagcatgtggtaggctctgtgttaatagcaccaattatgtggtttctgtgtaacatcctatcacatattatagaaacatatgctcccttgctggctttataaaagggtttccgtgctagcacaatgatagacttgttgtgtgcatccatatgtatgttctctttctctccaggttgaaaatgaactggaggacctgatagatgagttgcttgagagggatggcggatctgggaacagtacaattataggtgagagccccagaactgagtaaagcctcttcctttgtctcagtctctcttgggaggaccatttttctcatcatctgcttgctcagctctgcctaagggctcatagccagcctagattgctgcttgtcttgatgttgatgatcttaacagaaaagaaattaacaagttgtttataggcctgtaacaggtctgaagtgttgtgtatgtcgggtggcggtgagggtaacaatcagtatagatgataacatcaggcacaccaaaagtgtttattcatggaggcctagaagaggctgtaggatgagaaaatgcttttctttcagttcttcaatgaaatccaggggctttttgcctttgtgtcttaaaatgtaaaaaagagtggtcattccttaaggatggccccttttaagtctcaaatggaaaatgacaaaggtaaacaaaccagctgccacctcactgtgaaggtgtttatatttttattttactggtcaagaaaaccaaaggattaatggaactaggcatgtattcttaaaagatacaaagctttttcacatccatcgtactctgtgattgcacaattagtgggattggcaagacagatgtgatcgttccattttacagatgaggaaactgagactcagacaggtaaagtgactggccaagctcatctagatagttgacagcagagaatcgaggtattctccctcatcggaaaaagaaaaaggagaaaaatcaaacgtggatatctattaggtgtacatagctacttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccaaaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacgttttactactgcttgcccaaagtttgtcacttcttacttggttcgctttcttctcacccacctgctgtcatcgctccagattccctcttatcaacaggatgcagtcactagcaaaataggactggaaaggcaaggggacaccaacagacttggtcaagccctacatcgtggctcctcaagcacctccctggagccagcttccacatttcagcaaccctgctcagcgtgtcgatgcattaattggcactctcaggaaatttgggctggctcactaagtctgtacaccaccctagatctgattcttcctctcttagagtcagataccccatcgccttcccactcagtctgccggcctgcacagtggcctgttttctagctactcagtatagtcctccaatgtgctccctttgttttagattccatgaatatcctggaccctgaggatgaggaggaacatactcaggaagaggacagcagtggcagtaacgaggatgaggatgatagtcaggatgaagaggaggaggaggaggaagatgaggaagatgatcaggtgaggggggactgtgtttgggttggttcagatgacctcttccatgggagcacagaactacagaaaaacggacaatctgggttactagctagcctcgtcgcctccctccctcatgtgctcatgtggccatgacaccaagcttcagaaaacacttacctccagcaattctccatctcgtattttcccttaaggaggatgatgaaggtgaagaaggagatgaagatgatgacgacgatggttctgagatggaattggatgaggattaccctgatatgaacgcttctcccttggtccgatttgagcgctttgaccgggaggatgatctcatcattgagtttgacaacatgttctccagtgctagtaagatacaggggctcagctgggtttttacctattgattcttatacccttctctagggtaaaccaagcagaactaaagcagccatcaatctgatagaggacaccacttcttttactgtcttgacatcccaggtcaagggatgtctgaatccatctctctggatagcatacatatccttgcaagaaggaatcggaggaggctgctcttactatctccacctcagtaaacagggagctcttagagcctggacaacttgatgttttgcttgattgagaaaatgagaccaagtctgactacatgaggcacctgaatcacactgcagtgacagggcaatcaataatcttttatttgtaacgctggatctcaaaggtttggatggacatcgctgagcctggcattagggagtggattttatatattcactgttcatcatggatggaactgatccggagagaaaatgaatctctccactccttttctatcaacatcaacgttcctttgtagcgacgagttcttagcctcaagctgtcttcatgggacaggtcttacctcaaatcacaagcataatatagctgaaaacacttttaacagttttggtctgttgtcttggccataatcttttacctctgagcctcagtttgtcacctgtaaatgaaaagcatgaagagaaaaacaaaatgagcagtagataattttcaagatatcttctatgatactcttagaatttttgcggttttcgtcaaccttccttttatttgagcctttgtccattcaacaaaatgaatgaatatctgagatgtgcctaccagtccttggtactggggataaggtggtaaagaaaaacaggagtttttaccctctataggaacttatggtctgtaaggaattataagtaagaagacaccacatttagtatgctaatgcacagagtaaaggtatatctaacctgacctgttagactttagaagtaacatcttggactgagaacaaaagaacaggtgaggaagggaagcagagtcttctaggccaaggggccagcatctgaagtgcctagagacatcactgttgtcttgaaagtgggctgggaaaaggtaggattacattgaggtggtggcataacctatggttgtatcagatcctgaattaggtgtgagaatgagggagaaaggaaaaagatcacatttccatgtgagcaaagcccaggagacatggttctacacatgaacagccatggaagaaatttatttttggcactgaccccttttgcatattttccttgcagcagacattcccccatccccaggaaatatccctaccacccacccattgatggtacgtcatgcagatcacagttccctgacactgggcagtggttcttccacaactcgtcttacccagggcatcggtcgcagtcaaaggaccctcagacagctcactgccaatacaggccataccattcatgttcactaccctgggaatcgccagcctaaccctcctcttatactccagaggtgagtttgtgttgaagcagaatcaatgagaagttggattcaatgaagctcttaagaattataactgaacttcaacattgtcttgaccataaggataaacagtccctcataaataaggttgtgtgacccatagtaagtgaaacaattttaaaatgaaagagtgaatataagtgccttataaaggtgtacaacaaaggcattaatacctaacatggtacctagcatatcaaagcttcctagtgttcaaggaactaactaaagaataatatgcagttcaatctcgaagttatcaaactgacatgctaataagaatggtagtaaaggtttaggttcagtatgattaaaatctacccataatcctataagtttactagatgtacatgctcgatctcatggttaacagacttctgtggacttgaaagtgaaagtggtaccttaccattaccctacaggttgcttggtccctctgcagctgctgacattcttcagctgagcagcagccttccattacaaagccgaggccgggcccgcctcctagtgggcaatgatgacgtccatatcatcgccaggtctgatgacgagctgctggatgacttttttcatgaccagagtacagccactagccaagcaggcaagtttattcagtaagagggaggatagagttctttgattcttcttcagtcctaagaagaagagtagtctctttcttggagaaactacattttataggagccaaaaccacttggtgacttagccaaggacaacaactctgttgcctctgggtacctgttatgtagcaaaacttgtggcagaccatgggttcttttaggaaaataatgcagtttttaggtcaatcaacacttcataaagccaagaatttcactttattttgttctcttataggaaccctgtccagcatcccaacagctctaacccgatggacagaggaatgcaaagttcttgatgctgagagtatgcatgactgtgtttcaggtctgtgacaacttgaatatcagggtagtaatgagccttccggctagaatgagtatgcagagagttgtttttgattctctggctattaactctgcctctctacttctcaacctttccaaagtagcctctgatttttacctttttcttgtagtggttaaagtgcccattgtcaatcacctggaattcttgagagatgaggagctagaagagagaagggagaaacgcaggaaacaattggctgaggaagaaacaaaaataatagacaaaggcaaagaagacaaggagaacagagatcagagtgcacaggtgaggtgactccaaaagacttaagagatgcagcattttgtatttattatgattttgccctgctcatagtactaaactactagaaaattctagaacattacgttgaacatgaaagattgttcatttccagattgactatttactcatctggtttttaggcaaaaagaaaaaaaagtcaaacccagaggtaaattatttctccactaccttactggggaaatgtgaaccttatacaatagtcctactttgtaaactctttctgaggcctaaaggtagactctcactcagctcacattcttggttctcacttccatttcacagtggacttccagaaaattttcccacctgaactctattaccaaacaactaatgtatatacataaaagctaatagaaacacaaaaaagaatgaaggctgtagtatgtcccactcattcatctattaggatattgggtaatttttttctttatttgcataccaatcaaagcttcccctccctcctctcctcgcagtccctccctcttctcttatccctttctcctcagaaaacaggaggctgccaatggatatcaacccaccttgctatatcaaattgctgtaggactagatgcatcttctgttgaggctagataaggcagccaaaggcagacaacagagtaaggaacagcccctgcttctcccacaagaccaagctgtatatctgttagatatgtggagggacctagtttcagcccctctgggcccaggttatttgattctgtaggttttcttgtggtatctttgacctatctggctccttattgggtaaattaaaaataaagacatgaggggctagagataaccacagtttcattcccaccaatgtaacagcttaaaactaacttcaatccaggtgtggtggtgcatgcctttaatcccagcacttgggaggcagaggcaggcctggtctccagagtgagttacaggacaaccagggctatacagagaaaccctgtctcgttaaaaaaacctaactccagttccctggagtttctttgttttcagcctaaacaaaacaaaacaaaacaaaaaatcgccacaaataccaggttcagttcagagagctcttaccccaaaataataaggcaaaaaaaaaaaaaaaaaaactaaaatgtactgggattgaatcagtggtaatgtgcttgctctatataagccaaacccacttacttatatgtaggcacatactgctacacatgcaaagaaatgggggggtgcattaatattgagggtatagcttagtgatagggcactcttccagtctgtacaaggtccaggtttgattcctaacatgctaaaattagtgcagacacattgaggtatttgtttataataacaggcttgctctaacaaatacttttatttatataaaactttgccttaaaaccagcaacattgtatatgactaaaaactaaaatggacattggattatagctcagtggcatgtgcatggtttgatccaaagcaataccccaaaacaaagctagagtggaaaaaataataaacccaaagaagggaaataggtggagctaagagtttcctgtctcacaattgtgcttatttctaatgtgttctttttttattctttcattgttcatttcctgctcactcccatacttttgtctttatgtaacctagtgcattctttctagtgtgttgctagagataaaaaactaggacctcacacatggtaaacttttgaactctccagctggcctgtattccccaagtcctctccaaagctgttgaacattagtatagtgtatgtaaaggaattggataatattttgtattctgaaatgcccacatggccaggccactgaattccttgatagtctaggtaagaaataatgactctcatatttgacctttcttgtgtgcttgtctcccattactctctcttctctttgcagtgtactgtaactaagacaaatgactccactgaacagaatgtctcaggtaaccctccctcccttccactcttgctaattaatcagtggattctttctaaatagctggccacatgggctgaagacagacactggtgctctgtgggatgaggtagtagattgtatagttttagggtcataccccatcttggagataactatacagtctactgtctttcccacggtggtacacttcccatccaactagccctgttcaagttcctgttacggttatgctgtgtttcggtctgatatgtacacaagctatttatcttgttcttttcccccacacactcggtatatacatctttgaggtacatacttttgtatggcacttcattagaacacctggtggcagtggttctcagttgccagtcctcaatgaaaattaacacagggaagtctaatatgtgttttagagctagatttgttccattcaaaagtcttttatatttagaagttatattctcctagatcttggataacaaactattgttactaaattattgggggttttttcttacaaaaccaaaagtaatgcctagtttagtccttttcattcttaatctaaaatcttagtggtctatggaatttaaaagttttaagaacattgtcttttaaaagtggggttttggggatcatagctttgtgggatatatatatacacacacatacatacatacatacattacatacatatacttctcattccttctaatcatcttaacaatggtcagtaaccatttttgtcattggtcaatgtggtctcatgcttgcctcatatctattcagaactttcttctgcccttgaattgggagacttgttttaccaaagcctacataatattttaaaagcactgaagagaatagctgtcccagcgctcttaatatctagcaaaagtatatgaaagaaagaatctatgctacaaggtaaagtggccttttgcctactgcccttactagacacatctgcacatgctggggtgaggtagtaagttgtattgttgtggggtagggattttaggccccagtaagaagataactatacaacttactactttccttggtgtgtggcatattcacattaagtcttggcagtattgactccattagagaaaagttgtaaatgtttattcagtaaacaggaatataataaaggaaggtggaagggaacagatgatagagtgaggcaaataatgttaaatgacttgcccatatattagaacattattatgtttattttaccattgagtataaactggacattcttctactctttgattctatgataacttcatttagaatatgaatatgaagaatatgaatggaaactgtaggaatttttttaataagaagcaaggcatgttggttcatacttttgcagttctaaaactttataggcagaggcaagaaaagcaaacattcgaggacagccttggctttagcgtgagctcagtgttagcctaggctgcatgagaccctgtctgtaaacaacagcaggaatgtagaattatgaataaattctgaccatttcttgttccaagtagatcaggaaatgtaaggatctataagcttttaggaggtttttttttttttctgagtagccttgacctatctatggtatgcaactgttcccttctacctggaacatagaaaggattgtactctctagatcattagagtcatatctctggtgttgagatacagatagtattgttatttagccctcattattatgatatgccatccaagaactgtttctgggaacagattgatttgagaaagattttcatgacttttatttgaatgggtccttaccaggctgcatgtgctgattggattcttcccatggtcattcgctaagttccccttaacctcgaatatcattctttccaataaagatgggactcctatgcctgacagctatccaacaaccccctcttcaacggatgcacctacatctgagtccaaggaaacacttggtaccctacaaccctcccagcaacagccagcacttccacccccaccatccttaggagagattcctcaggaactacagtcccctgctgaagaagtggcaaactctacacagctattgatgcctatagagttggaggaattgggtcccacaagaccaagtggagaagcagaaacaactcaaatggaattgtctccagctcccaccataagtgagtagaatgtcatctttaaaagggcataaaaaagaaaagaattgcaatctttgtaacttttctctgctttcttactttaaagaattaggagctcagaatcctcagtttacactccagctttcttagtagaagctcagatttcttctttgtgtcctcagttaattattgttgtatatcttaatgataagtactaagcatgccataatttatctaggcaatactcatttctgaactaactatcatgtcaggtttgttatttaacttctttgaaaataatgtttcagagttggtggtgccttcattcataaactgaaattctatatcattcagttttcctatcatttacatacctactgctcacttatttaaaatagtgcatcaaaattttcaacaaaatacttttttttaacaaggcaaactgaaactgacttcactataccataatttctatgctgtggactggagagattttttttaaagatgccagttttgtttgtttttgtcagggactgtcacaatttcttttcctgttgctgtgataaaataatctgacataattttaagggaagaagggtttattttactcacactttgaggttatattctatcatagcgggaagagtcacagcagaaacttcagggagctggtcacatatcattattcataaaacaatacatgcatgcttctcagtgccccttctccagttaaacagcccagggtccctgggagtgctaattcccaaatgatgttttttcaaaggcccatgtcctaggcaatattagatttggtcaagttgatgatcacaacataaccatcacaagacagtaaccattacaagagcctttttttttttagataactgagaccactagcatgtttgtgtaactggtacctgcaggaaacattagagtaacaaaatccctacttcagatatctagggacattgtagacgtgtgtagaacaaacgtgtggtacatagaaaagtcttaaggaacttaagggcagttgagatggaagagtgggcaatagataatcaagtggtagatgagtctgtattaactgttgcaaaaggaaacaaccctaccaaagactttgcctgtcataaccttgattcaaagtagccatctaatttctcactcttaacttccttctagcctctctttccccagagagagctgaagattcagacgcgttaacagctgtcagcagtcagctggaaggttctcccatggacaccagcagcctggcttcctgtacgttagaagaggctgtgggtgacactccagcagctggcagttctgagcagcccacagcaggtagttccactcctggggatgcgccatcagttgtggcagaagtgcaaggcagacctgatgtatcaagagaatccaaccagccacctgaggacaggtaagtactatatagccaagaggagattaggaatgcattagaagttatttcaagctaaacactatcaggcatgcttgttgcactgtgattgatgtgttctatctgagatgggtattaggaatgtttttgttgtttggtttgtgtttgctttttatggggaaactgtataaagaaggatgatttctttccctagctccccccctgcatcctcggagagttcttccactagagattctgccgtggccatctctggagcagattctcgtggaattctagaagagccactaccttcaacaagcagtgaagaagaagatccccttgctggtaagtttctgtttccaaaaaaatcattgcttggacagacataaccctccaaacactttcctccaggtcggtgtgtgagtcgggggtgggggttgttgaagatagactagcaataagaggatgcaggtgttgcgcgtaatggaatgagttcaggcttagaagtcaggttagccttagctcactcattctctacttttataaaataggaccattatttaatatctctaatcctcattgacaaacactatgttagtcagttttccattgctgaatcaaatgtctgaaatagccaacttttaaaagaaacgataagcttagctcacagttacagagttttcagtctttggtcagttgtttcttggtctctgtagtaagagactactatataatggtggccacacacaatctacatgaaagtctttataaaggttgacttgacagtgtataccactaatgaactttttaaatttatttgagctgttgaactatttgaagcttaggaagatgggttatggctcttctctatatctttgcaagcagtggaaacacaaatggctgattttcctcaacccatgatttgtgtttcttttctctgagtatacctttgaacatccatgaagatgtaagttcctttacatcttacaatctctttaggtatcagtctccctgaaggtgtggatccctcctttctggctgctctccctgatgatatccgtcgggaagtcctacagaaccagctgggcatacgtccaccaacccgaagtgctccctcctcaaatagctcagctcctgcagtagtggggaaccctggtgtaactgaagtgagccctgagttcctggctgccctacctccagctattcaagaggaagtatgtaagcgggaacatggtgagaacagttttagcttgaaaagagctatactcttactgatttcttttcttctataggtgctagcacagcagagagctgaacagcagcgacgggaactggctcagaatgcgagctcagacacccccatggaccctgtgactttcattcagactttgccctcagatctgcgccgtagtgtcctagaggatatggaagacagtgtgttagctgtgatgccacctgacattgcagctgaggctcaagctctaagacgagaacaagaagcccgacagcggcagctcatgcatgagcgtctttttggacacagtagtacttctgcactctctgccattctccgaagcccgggtacacagggaggcaagtgggagggctctggaatatcttgcttggccttgttttttaattagcctcctttactacctgttagttgtttgaacccagtttctcctcagttcaccaaattcagtttcctttttcttttcttgtagcttttaccagtcgcctgagtggcaaccgtggggtccagtatactcgccttgctgtacagaggggtggcaccttccagatggggggtagcagcagccataataggtacccttgtctt

SEQ ID NO: 327 - DNA, 19785 bp, mus musculus
cgcgaggcttactgtacacccggcttgcactgcgctatttcccgcgcgggctaacctcgttcccaggagtaaggcgcggcctttcctacgccagcgccgctgtcatgggtttcctgaaactgattgagatcgagaactttaaatcgtacaagggtcgacagattatcggaccatttcagaggtttaccgccatcattggacccaatggctctggtgagattaaaaccggctgtggccctgcgcgcgtcccggtccggttccccctgcttgtctgcaaagtagtacaacctacccccatgcaacccgagacattgtgaaccctgaaatgttccttgatcctcttggtggggcttggatctgaacttgctttcccttttggcatacactgaactcgagtctcttcccaactgtcagttggcggagttcggcgcagaccccctctggcccgaatggtatgggccgaaccgtgcgtcgccccgcccactacccctcccgccaaaagaggcgttcccgaaatttgctgccagttgtttggcccgcggcttccttccggtctgcattgttccaccttcctaaacttgtttgacacctctgggaaaatttgggaaccgtaactctgctttggcgtccgatcccaagctgtgtactttgtgctctactcagccctccccgcacccgcacctcccgatggaacgctccactctgattcctttccccccccccctctctgctgtggcacttttgaatttctgacccagcgttccgctcagcagcgtgggattgcgatgccccccacccctccgcatgccccccacacgcctaagagattgttgctttgatttgcctttttcctaccagaaaaccgtaaataagcctgaacttgttcgcttgccaaattggtggagggtttggggttttatcagttaagtttatgcggggagagcaaatccgagatcgcgggaaaggagaagcaaagtacaaaataagataacacttaggccattataaatgttttgtagaaaaggggttaggctgataagttagagtgactttgatagtaaccctactttttcatacttaagcctactatttcatatcttagtttttgctgtatagctcgtagtttcctctcacccatctctagaagtattcgttatgaatctttgctgtgttcctccactccagagatattctagtttactcattttctagcctgctaggccacccttaccttgaagtagctcatagcgaataccttcactggactcttgcttgcggttttgttctctgtctagagcattgtttcctaacactagctctttagccacacactttctctgtgcggttggttctgtgcattgtagaatgtttagctgttttcctgacctctctccactaaatgacagcacctccactcccctgaaatgcccatcaaaaatgtgttcggacaatgtcagagtttggagtgcgggtgggggtggtaatgacgggttacttacttcccctactacggtttaagaaccactggcctagagggttgatgctttgagttccactaaatttcttaggattttggtcttgtgactcttgtagaaaatgcttggttgtaccacttgttgaaatcgagttctctcagcgttgttagaattaaaaatccagctgtttggaacaggcctgggttcttacctctctattttttgagggggaggggttgccagacagggcttctctgtgtagtcttgactgtcctggaacttcctctgtagaccaaggtggcctccatcccacagagatccacttgcctctgcctccctagtgctgggattaaaggtgtgtgccaccactgtcccaccttttgtttgtttgtttgttttggagataatttcttatggcctcaaactcttaaatcctcttgcccctacctcccaagtgctagatttatagctgtgttttaccacacctgctttctgcctctgcatacccttcaaagcttggcaccatgaagcattttttgatctctgattcccactttgtaaatttatttttggttacacatttatggtacattttttttcatcttcatcactagtgcatgagtgttctcaagatgccattccttgagatgttttattggtatatagttattgttaacatttgcattagaagaatctttccaacacttaatgactatagtaaaagaggattgtacttgtgagatgtgatccttgaaaatcaagggagaagtccaaagattggaaattggtggttacaagactaattccaatttatgtgatttactagctctgctgcaactggagagagagttgactccagattgaatactgatagatgtgccacttattgagcaccaagtagatcttgggtttttgttgttcgtttgtttttaagataggatctcatatcccagcctggtttcaaatctgactttctgatcttcctgcctccatcttcagagtgctggaattacaagtgtgtacttccacacctggtttacttgagagtttgggtttgagctgaaggtcttgtgcgtgcctggcgagcacactctcagctgggtcaagtccccagccccacgaggtttattttttaaggttttaacaaacgagtagcagaatgaaggactttgggcttgaagcctgatgatacggagactgttttgtcatcctgtcagttgaagtaaaggactcgctgacagttttaacttaaggaatgactaggtttcttccgctttaaagcagaggaaatacctgtttcctaaggcttttggataagctaaattgggtaattaatgagaacctgactcacaaacttgcatgaatcatgtgaggcagtattcttaagaaggtagctgattatgcattggtattttagcaagtataaagagcccagggtgctgtcagacaaaagagaaggctgaggatatagctttgtctgtaaggtgcttgccacatgagcatgaagacctgagttcggatattcagcgcccacttcaaaagctgggtgtggtggtatatatacccataacccagcactggggaggtggaaacaggaggatgcctggggcttgctgattagtcaatgtagtcaagttggtgagcttccaggccaacagatcctgtctcaaaagtaaggtgggcagttatcaaaaaaagatactcagcatcaacctctggcctgcatatacacacaaagaagctgcctatattaaaaatagtatgccagtggtataatcttgataacaaatgttaaaagtttgagaattggtacttgctagttgtgatggcacctataatctcagtactagtgtggctgatggaagaagattgctatgaattccaggccaacctggacagcataatgaggaccagagctgcatagcagaaaaaaataaaaaacttagtattggttttgttactcaagcttgttttcttgttaaatttctttttttttttttttttttggtggtgcggggctttggttttttgagacaggatttctctgtagccctggctgtcctcgaactcactttgtagaccaggctggcctcgaactcagaaaactgcctgcctctgcctcctgagtgctgggattaaaggcgtgcgctaccacgccaggtacttgttaaatttcttttcctccttgtttgatcaagtgagtggaccaagtgacttcaaaaagtacaaaaagttttccaagtatgtgactcaggagtatactaagtttccactttttaattattttaaaaattactctgtgtgtgtgtgtgtgtgtcagaagttggtgttaggtgttttttgtttgcttttgtttttataactctaccttatttatttgtttatttcaagacagtgttttttttgtttttgtttttttttttaatgtagccctggctgtcttggaactcactctgtagaccaggatggcctcgaactcagagttctgcctgcctctgcctcttaagtgctaggaccaaaggtgtgcaccatcagtctggcagctccagcttattttttgagatagtatgtcttaccggcttaaagttctccaactgggctatagtggctagccagcaagccccaagcatcctcctgtccccacttccccaatgcaccaccacatctagcttttaagtggcactaagtccaaactcaggtattcatgcttgtatgacaagcttagtgcatgcatggaggtcagagaacaacttggcaggaatgagttctccccttcttctatgtggatcctaggaatcacactcaggttatcaggcttggtagcaagtaccttaatctgcagagctatctcaccagcctgttcataggttttcttattcttttgcttctccccaagttttgtattatctgagctctagtatagccagtcagtcagtcagtcagtctgtctgtccatccatctctctctttcatgtgtgtgtttaaccatttgaaaatcagacatttcacctttaagtgcttcagcattcatataaaatcattccatcttaccactattaattttctcttgtcatcatttagcttgttttttttttcaagtttctatatacttgctcagtttatctaatatataatcaagtttccctaattgctttgcaaaatgtccatgtttcttggtgggggctgggggacaggagtccaatcagagttatgttctcaacttgggtggtgtgtcacacacttgtaattctagcaattggaggcaagatgcttgtgaatgggaagccagtctggactatgtggatgttttccttctaaaaataaataacctgtaataataacatccatgttctatttgcatatatctcagtactgttctacattcatttaaaacattgcctttatttagcaatggtgatgggacctgaggccttgtgtgtgcttctgaagttctacctcttagctaaattcctggtacagatagtgagggtttgtttgtttgtttgtttgtttgtttgtttaaaagagcaggccatttgtattatagaacatttcacagtcttgttttattttggctcattgtaaagctaagggtggccttgaactctttaaagaaaaatttaatgtgtatgtgtcttgcctgcatgtatgtctgtgcaccatgtgtttgcctggtgctgttggaggcctgaagaggatgtcttattccttgaaactggagtttcagacaggtgtctgctatcatgtaggtactagaaccaaacctggtactctgaagagcagctagtactcttaaccattgagctatctctcccagttccaatcttaaactcttaatcctcctgtttcagtttcctgagtgctgtgttaaagttaggagcatgctaccacactggtttccatatcgtctttccagccttttgaagtgttttaccactatactcagctccacagtttatttttatcttacaatttccttgtattgtttaccaggttggtttagttgctatatatttcctagaaattgaagtgtggttctaatggcttacttagattcaggttaaattttttttttggcaagatatttcatagccaatgttgtatgcttcatattatattataaggaacatgcccttttaaaggcattgtgtttaccaacctaactgttttttttttttttttttttttaaagacttattttattaatatatgtaagtacactgtagctgtcttcagacactccagaagagggagtcagatgttgttgcggatggttgtgagccaccatgtggttgctgggatttgaactctggaccttcggaagagcagtcgggtgctcttacccactgagccatctcaccagccccaacctaactgttttaagtgtactgttttaatagtgttaaaggtattcacatttttgtgcaaaaaaattctaggctcttctgtcttggaatactaaaagtttacagttacttaaaaaagcaactaatttccttctctgtccagcctgcttttatttttttttttagtttacagggtaaaaataatatttgtcagtgttatcatagtaaaggttgtagaagaatccattcaatgaatacctgtttctttatatggggttttagtttatggttactataagtgataactgcaaaggaactatttttcctaagccactgacccaatcttctgacaacagattttattttctctcttgtattatattagtccaagctctaagtgattagaccatgtttctactctcaatatgccctttatttattttcctcttcccttcttcccaatgttccctcttctgctttgactccttctcccttaggtaagtcaaatctcatggatgccatcagctttgtgcttggtgaaaagaccagcaacctgagggtaaagaccctgcgggacctgatacatggagcacctgtgggcaagccggctgccaaccgagcctttgtcagcatggtctactcggaggagggtgctgaggaccgtacctttgcccgagtcattgtaggtgagtgaggctcagaaggctccctgggtccaatgaagcagatagactagttgtcaggataggaggaatacctgatccttgttgactcatttgttgccttgtagggggctcttctgagtacaagatcaacaacaaagttgtccagctacatgaatacagtgaagagttagagaagttgggcattctcatcaaagctcgtaacttcctcgtcttccaggtgagatatataatttttttaaagacgatctcactgtgtagtccctggctgccctggaacttatatgtagcttaggctagccttgaactcagaaacgtctacctgcctctgcttcctgggtgataggattaaaggtatgtactgccatgctcagcaaattactttcatttttatttttatacactatttgcatcatttccacagtccctctccccacttcaattcctatatctcccttaccacctcctcaggaagagatcaggatatatgatctcttctgtattattttcaagatttttattttatatatctgagtgttttgcttctatgtatgtatgtatgggcatcacatgtgtgtctgatgccaggccagaaggcagcatcagaccccctgaaactggagttacagatggttgtcagctaccatttaagtggtgggaattaagtcagagtcctctgcaagagcagcaagtacttttaaccattgagccatctctacaggccccatatttgttttgtttgtttactcacacacctctgttgagtccagttttgtattgggccttatttgtatgtgtttagagctgaggtcttcgtgaggggtggggagcaaatggttcaccctctcttagcaaccatcagtgaccttttgaaagtttcctccatccatattggtatgttcattggtgtagtcttcacatatcttgtgctgagagccatattattgagaattcttgggaacaccatctttgtccaggccagaagaaactatcatacagcagtcatcctgccttccggctccagtaatctttctgtcctctctcctgagatgttgcctgagtcatgatttaggggctgtgttatagatgatgcatttggggctaggcattcttacttttttcctgcattttgacagattttgttgatctgttttctttctgctggaagacaaaaagacgtttcttcaatgagatatgaaacttgtacttatctgtggtaatatggagaaatatttagaagggcattgcaaactatattaatttagtaataggatagaagaagtaggttatcgtctgtggactttttttaaagacaggatttcactgtgtagtcctggctagccagatgtgcctgcttctgcctcctgagtccaggaattaaaggcatgtgccaccatgcccagactgtgggcattttgaaaaaatgattttatggttatgagtgttttacttgtatatatgtgtgtgcaccagggcatgcgatatctatggaagccagaaaaggatgttgggtcctctgggactagagttgtgaactaccatgtgggtggtgggaattgaacctggatcctctggaacaaagagctgctagtgctcttaactggttgttgtctttttttttttagttttttttaattagatattttcttcatttacatttcaaatgctatcccaaaagtcccccattacccccacccactcccctacccacccactcccacttcttggccctggcgttcccctgtactgaggcatatgaagtttgcaagaccaaggggcctctcttcccaatgatggccgaccaggccatcctctgctacatatgcagctagagacacgagctctgggggtactggttagctcatattgttgttccacctatagggttgcagaccccttcagctccttgggtgctttctctagctcctccattgggggccctgtgttccatccaatagatgactgtggtgctcttaactgttgagccacctattcagcccccttgagtgtttaaaaatcattattggctatttgctgtttgttgatgttgcctgtcccaactagagctgcttatctccaagttaatgtgtcttccttagactaatgtgtagcacatgctttagtgggcttcccagttccattctgaccccttcctatttctcccctcagctgggttagtctaataaagacagaagtcttttttttttcctgtcttttcataaagcagttcagtggttccttcttgtctaaggatgattgttcttaaattgttgttgctagaccagcagtattaacaccatatgaggatatgttctaaatgtgcattcttgggccccattccagattatgagctgaagagactctgtggtggggtacagtttgtgttatagcaagctcttaaggctattgtgatgctacctgaagtttgaaaacagttgacttagaatgaacaagcaaatttgcaagcctattgttcataaaacactatgttcaattctttcctgccttagtagctttgtctgccagtcgtctgttcctcagtttcctactctagtccaattaaactaccgcctgtagttctcagattcatttgctgtctttggcatgcaggcctttgcttgttcgtttcccacttgtggaattgtcaaatgaccatttctgtctttgttttacgcatctcccccccacctcactctctcacacacacacttgaggtggtagggattaaacccagtgcctctcatatgctatccccagtctgttgtccttttttcttgtttagttttcccatatattccaaagtcagctgtacctgtataaaaccttcccaaatagaactccctacctgtttcttgcatctcatacttgaattttctgggctgctttagtgattgtacacaatataccattgttacctttgtgttcgtctctttgtgctcagagacagaaaatgtgccactaaagcccaatatggctgacctggtagcaggggcccataccccaactaaagcaagaagattgtaagttcaaagtttgcttgggctacagaggaagttcaagccatgggtagacaacttatcaagattctctgaaaatcagaaaagtaaaggaagagaagagaatgcaattcagtggtggagtacatactgactttcagttctctgtacttaaactctttcctgcccacaaaaaccccttgaaatgtggcactagttgaggaaaggaggatctgtaaactttggaagtgggcagggtgaattgagctagtagacggctaaatggggcagtgttttgaccttttatcagggtgcagtggagtctattgccatgaagaaccccaaggagaggacagctctgtttgaagaaattagtcgctctggggaacttgcacaggagtatgacaagcgaaagaaagaaatggtgaaggctgaagaagacacacagtttaattatcatcgcaagaaaaatattgcagctgaacgaaaggaggccaaacaagaaaaggaagaggttggtggcctggctgccccttagatctgagggaccaagataaaggcagtgccttactgatacaccctgtccccactcttgtttgcttaggcggaccgctatcagcgcctgaaggatgaggtagtacgagcacaggtacagttgcagctctttaaactctaccacaacgaagtggagattgagaagctcaacaaggaactggcctcgaagaacaaggaaattgagaaggacaagaagcggatggacaaggtagaggatgagctgaaggagaagaagaaagagctgggaaaaatgatgcgggaacagcagcagattgagaaggagatcaagtaagaggcatgcccagacctgtaacttgtttaaaactataagcagctgttgctcttctcttgggatcctctgagcctaaagtctactattgtactaatttatcttccccttgaccaggcacatttcttgactttcaattaatactgtagactattcaagcttggggcagtaaggtaactcagccttgacatagctcatctggtaaaagtgcttgagaccaagtctagtgacttgagttaaattactaggatccaatatggtggaaagagagagctgagtcccacaagttgtcctccaatttctgcatgcactaactagttgtgtgtgtgtgtgtgtgtgtgtgtgtacgcacatgccagtgcatgtgtgatacaaataaatgaacaaaaaaagatctgggctcatagttgacaatttagcaagttcagctattgggtgaccaagaggtctatcctagaagagaagcactgtttctcttaagcttaaaggacaggaatttgaatatcagaagaaggtaactcattggggggagtttttaatgagagacctgttgtagggtttgctttcaacattatgggatagtgttttgacttttatcaggatgcagtggaatctgttgccatgaagaaccccaaagagttgtgagggttgaaaagggggtgataattttgtcttttggagtgactaaaatgtgaggctgctgctgtagattccaacaagtacttggactgtacccctctctgttttttgttgttttggggtcttttgcttgtttttgaggaactatagggcatcaggcccttgttctttaaggtgtttccatgaggttggctaggaatacataggtctctcttttagggtaaaaagcccaggatccctgcgttctgcaggactaactggtttcctttctccttggcaaaagggaaaaggactcggaattgaatcagaagaggcctcagtacatcaaagcaaaagagaatacatcccacaaaatcaagaagctcgaagcagccaagaagtctcttcaaaatgctcagaaacattataagaaacgtaaaggtgacatggatgagctggagaaggagatgctgtcagtggagaaggcccgacaggagtttgaagaacggatggaggaagagagtcagagtcagggcagagacttgaccctggaggagaaccaggtaagtcttgaaagggtcctggcaaagagattggtgacttaacatcggctgacttagtgacctgtcctcttttcctgtcttaacacaggtaaagaaataccaccgattgaaagaagaagccagcaagagagcagctactttggctcaggagctggagaagttcaatcgagaccagaaagctgaccaggaccgtctagatctggaagagcggaagaaagtagaaacagaggtaggcaaaaattgaaggatgacgtgtgggagtgtagctcagcagcagtgtgtgcttagcatatttaccctgaattcaattcccagcatcaaccacaacaaaacaatcaggggtgataatccctaaataaggtaataatgatagccttaataacaacagaaatttgtatgtatcaggcagctaccgtgtgctaaacactatgcttaacatatattcacttatttaagttcatctatgattacctttaagggatggttactattatcctcactttcaaaacgaggaaactattccagtggtgaagtaagctggagcttaataataacagcaatcccataattactcagctgcaggtttaggatgaacctgggcagtctgtctctaaagctcacactgttgccaagtatacttcactcactgccattctcctactactattaatgtgtaccctagactaagtacttactacagcttacagatgagacagcaaggtcagagacgtctgtgaagctttactttgcttgggtttgagctttagattgctgaggaaccctggcctgggtacagtactcctgagagattttggagcccttagaagccctaatgtagcagtagactggactttgtttcgccttgtagtaggcctcctgtattagatcatgacagattctgttggactgttggaattttgggtaagtggggtcaatagcggtgtaagtcgagaccacatgaacttgggttaactggttcagcctctaatagtggtatgcatttattatccaggccaagatcaagcaaaaactgcgggagattgaagagaatcagaaacggattgagaagctagaagaatatattaccactagcaagtatgtggctctgcaatcctctctttaccctccacgttcttccatgctcatcctgcccctctttaggcgggtctaccagagccctttagtcacaagtcttatcttaccaggcaggttaactcctgtgcttctttactttgtaggcagtctctagaggagcagaagaagctagagggagaactgacggaagaagtagagatggccaagcgtcgtattgatgagatcaataaggagctgaaccaggtgatggagcaattaggggatgcacgaattgaccgacaggagagtagccgccagcagcgaaaggcagaaataatggaaagcatcaagcgtctctaccctggctctgtggtaagactggaggggactcagatttctgagtatgtattcagactcactgtcaaccttctgtgttctgtggtagatttcctatgcagagacatgatacacacctactcacctgagaaagggaacgtacaatagtcctaagtaatggttgcaacaaagtccagtatagtgaaccgatgagtttttcctggcattactaacaagagtatgagtgagagattacttaagagcaggaacgacttttaaaacgtagatgtatcaccaaaaagcccaccctatggtggatgacagctcacagaagcagcagcgctggagctcttggcagttctcagtcagctcagtggctaagaatctcctatttctctagctgtctgtcagagactcctcctccagtaggtgtttactcctataaagctgaggaacatcttctagaaacttccaagtttccactttcccagacatgaaactaaagtgcctacctcctgagtctcaggagcattctcctcccttctgccagttgggaagagattgctatagaacactctgtgaagacagggtagctattcctacacttatatcagggaaaatggaaactcaactagattatcctgcccaaacagacatagcttgggctggagagatggctcagagttaagagcactgtctactcttctttagggcctgagtttggttcccaacacccacatcttgactcacaatgtctgtgacttcagtttcaggggatctggtaccctcttctggcctgtgaggagacaaatcacacatgggtatacatgtagacaaaacacacatacatataaaataaaaaataaataaatgataaaaagaaaagaaaagcatatgagagaactgttcatgtcctggttttgttttcagtttaaattttctatttactgggagctagagagatgatgcctcaatgattaagagcacttgccctttcagaggacttaatgtaacagttggtttacagctgcctataactacagctccaagggatccagtgcccccagcctttgagggcatggcacatacacacatgcagacactcttacacataattgtaaaaactgtgtatgtgtgtatttgtaaggacatgtaccacatcaagaatggggcttggagaacctgaggtgtgagtccttgttatcaagcttatttgagacaagagtcctgtgttggtttttgacttttttcttcatgtatgtatgtgtaccacatgcatgcctggtgcttgtggagttcagaaatcatcagatctcctggaactagagttatgggtggttgtgagccaccatgtgggtaagtgggagtgctcttaacagctgagaaatctctccagaccctcatgttttcttctgctatgtataccagggtgggtggcccacaagcttcctgagatttttctgcctccacttcccatctccccataggaactagttggattgcagacaatgtgtgctaccatgtccatggattgtatcggttctagggattcacatctaagtcttaactcctacatggtgacaactttactcactgagccatctccatggctgtcatgtgctcttttaattacaattacatctttctgatgcgtttgtcttgctatatccattcctctttgggggatggggacaacaaagaaggttttgggaagaggataggtagactagtaattgctcttcaaaaaagtagctttctgtagttttctatgaattccattggttgttaggggaccctgggctttatcagaacttttgacttctgcacctaattctgagttcccaggtgttatccttctgtactattttgtttctgagtttaacttagtttggttctatacatcacatacacactcatcatgcctgtaagtactattagggaagtggaaatacttacaagttacactcagtatgtactttttaaccccctaagggttcctctatgtagctctggagctatgttgccttggaacttaatctggagaccaggctggtctgaaacacatagaaatccacctgcctcctgagtgctggatcagaggcgtgtgccaccaccgcccagctgaagtgattactcttatctcatcgctcttgagaagctatgcttgattctagggctggaataaggaatctagtaaaagttacctactttattgggtgcttgtcagaatttgagataatgtatttaagatatctgtcagtgcttgctaggtaatggtctatgaaataattaaagacattttgaaaaatgataatagattcagatgtgactgcctgaagctgtcactggctttggagcaagagtagggttttcctatatagtatgaggtctgctctgtgagatgggataaaaccaaagtgttccttctactctcacacagccaataaatacagcatttcatttctaataccagatgtatgtgtgtgtacacacatctgtctgtctgtccctcacagcacatgtgtaaagatcagaggaaaacttgcagaagtcagttctctccttctacagtgtttgttctaggaatgtaagtgcccttacttactgagcctcctcttgaattatctagaagcaccctcaacacagaacacttccttccttccttccttccttcttccctccctcccttgcccctccttctcttcctccctccctctttcccacccttcccttccccttcccctttcccacccttcccttcctctttcccacccttcccttcccctttcccacccttcccttcccctttcccacccttcccttcccctttcccacccttcccttcctctttcccaccctcccctcccctcccctccttcctttcagagacaaggtccctagactaaagtctcctggctggcctagaactcactatgtagagcaagctgtctttgaactcacaaagatctgcctgcctctgcttcctgagtcccaagaataaagatttagatgaccatgctctacatgaacacagaactttcaaggtttctggttggttttgttatctatttagacttattttaattgtaggggtgtgtgtgtgtgtgtgtgtgtgtgtgtgtgtttctgtttgtgagtatatatttgtgagtgaagatcctttggagcaggagttatatgtggttgtgagccacctgacgagaatgctttgaactgagctcaggtcctctgcaagagcagcaagtactctttaacagctgatttcatttctcagtcctgagcttttgagtttttatggagggtttattttataggcatgatagattaagtcattgcctattgctgatgaactcagcttttagtcatcatttctttttaggtgtgggacaggggactagaaggcccaatcctctaatcctgccttggtctctataatgactagctctcgtgaaagttacctaggagtagtcactgatcggtcaactcattatgattttagtttttgaaactgtatcagaaatcatagtcaagctaaatgtatgttttgtaatttcatagtccccccctttcgtctttgaacataaatcttttacatcaaaataactgtaagtcagaagatactggtgtgtttctataatctcatttagctataagttaatgagttaccattctaaagctaggttctttggtgcatgcctttaatatcagcagttggaaggcacaggcaggaatatcatgagtttgaagtcaacctggggtaaccagggagatctaggttagtcccagctaaataatgagaccatgtttcaaaaacagaaaaattagtgtatcgtattcaagaatgttttctgggggaggctgttaagtcttgtggctttttagttaatcttgtctgattccaaaagcaatagtctgtcttaggaaacatatagcttcactttttaagcttctgatataagtgaacatagaggcaatgtgatttcttactcggttctgaggtgctaattgggtcttccatcttttaacatgtttattcagtccttaatcttcctcttagccaaacttctatctttggaaggagcattagaattgactgctgtactagtctaaattgcttgtagccatacaagtctaacaagtccctcccctcgggctgttccccttcctatcttagtggtatcatatagtacaaaagtagaggactgactgcaccaacaagcagcaatgagtgtattcatggtagcttatacagatttttatcttgcccttctttgtaagctagtaattgggattcctaagccttgtgcttcagtttcccttcttcctttatattcagtatggccgcctcattgacctctgccagcctacacaaaagaagtatcagattgctgtgaccaaggttttagggaagaacatggatgctattattgtagactcagagaagacaggtcgggactgtattcagtatatcaaggagcaacgtggagagcctgagaccttcttgcctcttgactacctggaggtaaggcttgtgaaggggtttggggtcaaggcagtgttatgggcccctcaccttggctttatgtattctgttgcttcataagattcttcacacaggtgaaacctactgatgagaaactccgggagctgaagggggccaagctagtgattgatgtaattcgttatgaaccacctcacattaaaaaagctctgcagtatgcttgtggcaatgcccttgtttgtgataatgtggaggatgctcgacgcattgcctttggaggtcaccaacgccacaaggtatgcaccctccccccctttctcaggttggagttggacaggctcagtgtcttagtcagggtttctattcctgcacaaacatcatgaccaagaagcaagttggggaggaaagggtttattcggcttacacttccatactgctgttcatcaccaaggaagtcaggactggaactcaagcaggtcaggaagcaggagctgatgcagagccatggagggtgctctttactggtttgcttcacctgctctcttatagaacccaagactaccagcccagggatggtcccacccacaaggggcctttcccccttgatcgctaattgagaaaatgccttacagttggatctcatggagacatttcctcaactgaagctcctttctctgtgataactccagctgtgtcaagttgacacaaaactagccagtacaattgaccccttgtcaacttgacacacaaacacatcactagtaagcctcaacccttacattcttattcatccccattataaataactttaaaagtcccacagtctttacatattcttaaattttcaatctctttaaaatccaaagtttttttacaattaaaagtgtcttaactgtgcgctccactaaaactgtttcttccttcaagagggaaactatcagggcacagtcacaatcaaaagcaaaaatcaatctctaactgtccaatgtctgggatccaactcacgatcttctgggctcctccaagggcttgggtcacttctccagccatgccctttgtagcacacgcgtcatcctctaggctccagatgactgtactccactgatgctgctgctcttggtggtcatctcatggtactggcatctccaaaacactgcatgaccccttcagtcctgggccttcaattgcaactgaggctgcaccttcaccaatggccttccatggcctctcacagtgccgagcctcagctgttctgcgtgaccccttcatgccttcaaaaccagtaccacctgggtgacccttacatattaccaagtcccgctgcagcaggagtacaaccttggccatctctggaacacagcctctttgtgctttcagaaaacacttcccagaagatgtcacctcaatgatgctggtctcttcttaatcaccgctaatttcttagctccagctaaccagcatcaatagtcccagtaatgcaaagtttttgctttagtagttccggtatcttgttaatcacagctgattctttagccccagctaaccagaactacagaatcttcacaatcaaaacagcaatggccctgaaaagagtctttaattttccctctgaaatttcacaaaccagacctccatcttctgcagtgttctcaacattatcttccaagctcctacacaacatccgacagggctcttaacaatgaatggatcttcaagcccaaagttccaaagtccttccacagtcctccccaaaacatggccaggttgtcacaggaataccccactctgctggtaccaatttgtcttagtcagggtttctattcctgcacaaacatcatgaccaagaagcaagttggggaggaaagggtttattcggcttacacttccatactgctgttcatcaccaaggaagtcaggactggaactcaagcaggtcagagagcaggagctgatgcagaggccatggagggatgctctttactggcttgcttcacctgctctcttatagaacccaagactaccagcccagagatggtcccacccacaaggggcctttcccccttgatcactaattgagaaaatgccttacagttggatctcatggagacatttcctcaactgaagctcctttctctgtgataactccagctgtgtcaagttgacacaaaactagccagtacactcagtattggagattcctatgttcaccttcttctcttctctccctgatgcgtatagacagtggcgttggatggcaccctgttccagaagtcaggagttatctctggtggagccagtgatctcaaggcaaaagcacggcgctgggatgagaaagcagtagacaaactg

SEQ ID NO: 328 - DNA, 46267 bp, mus musculus
cgcgaggcttactgtacacccggcttgcactgcgctatttcccgcgcgggctaacctcgttcccaggagtaaggcgcggcctttcctacgccagcgccgctgtcatgggtttcctgaaactgattgagatcgagaactttaaatcgtacaagggtcgacagattatcggaccatttcagaggtttaccgccatcattggacccaatggctctggtgagattaaaaccggctgtggccctgcgcgcgtcccggtccggttccccctgcttgtctgcaaagtagtacaacctacccccatgcaacccgagacattgtgaaccctgaaatgttccttgatcctcttggtggggcttggatctgaacttgctttcccttttggcatacactgaactcgagtctcttcccaactgtcagttggcggagttcggcgcagaccccctctggcccgaatggtatgggccgaaccgtgcgtcgccccgcccactacccctcccgccaaaagaggcgttcccgaaatttgctgccagttgtttggcccgcggcttccttccggtctgcattgttccaccttcctaaacttgtttgacacctctgggaaaatttgggaaccgtaactctgctttggcgtccgatcccaagctgtgtactttgtgctctactcagccctccccgcacccgcacctcccgatggaacgctccactctgattcctttccccccccccctctctgctgtggcacttttgaatttctgacccagcgttccgctcagcagcgtgggattgcgatgccccccacccctccgcatgccccccacacgcctaagagattgttgctttgatttgcctttttcctaccagaaaaccgtaaataagcctgaacttgttcgcttgccaaattggtggagggtttggggttttatcagttaagtttatgcggggagagcaaatccgagatcgcgggaaaggagaagcaaagtacaaaataagataacacttaggccattataaatgttttgtagaaaaggggttaggctgataagttagagtgactttgatagtaaccctactttttcatacttaagcctactatttcatatcttagtttttgctgtatagctcgtagtttcctctcacccatctctagaagtattcgttatgaatctttgctgtgttcctccactccagagatattctagtttactcattttctagcctgctaggccacccttaccttgaagtagctcatagcgaataccttcactggactcttgcttgcggttttgttctctgtctagagcattgtttcctaacactagctctttagccacacactttctctgtgcggttggttctgtgcattgtagaatgtttagctgttttcctgacctctctccactaaatgacagcacctccactcccctgaaatgcccatcaaaaatgtgttcggacaatgtcagagtttggagtgcgggtgggggtggtaatgacgggttacttacttcccctactacggtttaagaaccactggcctagagggttgatgctttgagttccactaaatttcttaggattttggtcttgtgactcttgtagaaaatgcttggttgtaccacttgttgaaatcgagttctctcagcgttgttagaattaaaaatccagctgtttggaacaggcctgggttcttacctctctattttttgagggggaggggttgccagacagggcttctctgtgtagtcttgactgtcctggaacttcctctgtagaccaaggtggcctccatcccacagagatccacttgcctctgcctccctagtgctgggattaaaggtgtgtgccaccactgtcccaccttttgtttgtttgtttgttttggagataatttcttatggcctcaaactcttaaatcctcttgcccctacctcccaagtgctagatttatagctgtgttttaccacacctgctttctgcctctgcatacccttcaaagcttggcaccatgaagcattttttgatctctgattcccactttgtaaatttatttttggttacacatttatggtacattttttttcatcttcatcactagtgcatgagtgttctcaagatgccattccttgagatgttttattggtatatagttattgttaacatttgcattagaagaatctttccaacacttaatgactatagtaaaagaggattgtacttgtgagatgtgatccttgaaaatcaagggagaagtccaaagattggaaattggtggttacaagactaattccaatttatgtgatttactagctctgctgcaactggagagagagttgactccagattgaatactgatagatgtgccacttattgagcaccaagtagatcttgggtttttgttgttcgtttgtttttaagataggatctcatatcccagcctggtttcaaatctgactttctgatcttcctgcctccatcttcagagtgctggaattacaagtgtgtacttccacacctggtttacttgagagtttgggtttgagctgaaggtcttgtgcgtgcctggcgagcacactctcagctgggtcaagtccccagccccacgaggtttattttttaaggttttaacaaacgagtagcagaatgaaggactttgggcttgaagcctgatgatacggagactgttttgtcatcctgtcagttgaagtaaaggactcgctgacagttttaacttaaggaatgactaggtttcttccgctttaaagcagaggaaatacctgtttcctaaggcttttggataagctaaattgggtaattaatgagaacctgactcacaaacttgcatgaatcatgtgaggcagtattcttaagaaggtagctgattatgcattggtattttagcaagtataaagagcccagggtgctgtcagacaaaagagaaggctgaggatatagctttgtctgtaaggtgcttgccacatgagcatgaagacctgagttcggatattcagcgcccacttcaaaagctgggtgtggtggtatatatacccataacccagcactggggaggtggaaacaggaggatgcctggggcttgctgattagtcaatgtagtcaagttggtgagcttccaggccaacagatcctgtctcaaaagtaaggtgggcagttatcaaaaaaagatactcagcatcaacctctggcctgcatatacacacaaagaagctgcctatattaaaaatagtatgccagtggtataatcttgataacaaatgttaaaagtttgagaattggtacttgctagttgtgatggcacctataatctcagtactagtgtggctgatggaagaagattgctatgaattccaggccaacctggacagcataatgaggaccagagctgcatagcagaaaaaaataaaaaacttagtattggttttgttactcaagcttgttttcttgttaaatttctttttttttttttttttttggtggtgcggggctttggttttttgagacaggatttctctgtagccctggctgtcctcgaactcactttgtagaccaggctggcctcgaactcagaaaactgcctgcctctgcctcctgagtgctgggattaaaggcgtgcgctaccacgccaggtacttgttaaatttcttttcctccttgtttgatcaagtgagtggaccaagtgacttcaaaaagtacaaaaagttttccaagtatgtgactcaggagtatactaagtttccactttttaattattttaaaaattactctgtgtgtgtgtgtgtgtgtcagaagttggtgttaggtgttttttgtttgcttttgtttttataactctaccttatttatttgtttatttcaagacagtgttttttttgtttttgtttttttttttaatgtagccctggctgtcttggaactcactctgtagaccaggatggcctcgaactcagagttctgcctgcctctgcctcttaagtgctaggaccaaaggtgtgcaccatcagtctggcagctccagcttattttttgagatagtatgtcttaccggcttaaagttctccaactgggctatagtggctagccagcaagccccaagcatcctcctgtccccacttccccaatgcaccaccacatctagcttttaagtggcactaagtccaaactcaggtattcatgcttgtatgacaagcttagtgcatgcatggaggtcagagaacaacttggcaggaatgagttctccccttcttctatgtggatcctaggaatcacactcaggttatcaggcttggtagcaagtaccttaatctgcagagctatctcaccagcctgttcataggttttcttattcttttgcttctccccaagttttgtattatctgagctctagtatagccagtcagtcagtcagtcagtctgtctgtccatccatctctctctttcatgtgtgtgtttaaccatttgaaaatcagacatttcacctttaagtgcttcagcattcatataaaatcattccatcttaccactattaattttctcttgtcatcatttagcttgttttttttttcaagtttctatatacttgctcagtttatctaatatataatcaagtttccctaattgctttgcaaaatgtccatgtttcttggtgggggctgggggacaggagtccaatcagagttatgttctcaacttgggtggtgtgtcacacacttgtaattctagcaattggaggcaagatgcttgtgaatgggaagccagtctggactatgtggatgttttccttctaaaaataaataacctgtaataataacatccatgttctatttgcatatatctcagtactgttctacattcatttaaaacattgcctttatttagcaatggtgatgggacctgaggccttgtgtgtgcttctgaagttctacctcttagctaaattcctggtacagatagtgagggtttgtttgtttgtttgtttgtttgtttgtttaaaagagcaggccatttgtattatagaacatttcacagtcttgttttattttggctcattgtaaagctaagggtggccttgaactctttaaagaaaaatttaatgtgtatgtgtcttgcctgcatgtatgtctgtgcaccatgtgtttgcctggtgctgttggaggcctgaagaggatgtcttattccttgaaactggagtttcagacaggtgtctgctatcatgtaggtactagaaccaaacctggtactctgaagagcagctagtactcttaaccattgagctatctctcccagttccaatcttaaactcttaatcctcctgtttcagtttcctgagtgctgtgttaaagttaggagcatgctaccacactggtttccatatcgtctttccagccttttgaagtgttttaccactatactcagctccacagtttatttttatcttacaatttccttgtattgtttaccaggttggtttagttgctatatatttcctagaaattgaagtgtggttctaatggcttacttagattcaggttaaattttttttttggcaagatatttcatagccaatgttgtatgcttcatattatattataaggaacatgcccttttaaaggcattgtgtttaccaacctaactgttttttttttttttttttttttaaagacttattttattaatatatgtaagtacactgtagctgtcttcagacactccagaagagggagtcagatgttgttgcggatggttgtgagccaccatgtggttgctgggatttgaactctggaccttcggaagagcagtcgggtgctcttacccactgagccatctcaccagccccaacctaactgttttaagtgtactgttttaatagtgttaaaggtattcacatttttgtgcaaaaaaattctaggctcttctgtcttggaatactaaaagtttacagttacttaaaaaagcaactaatttccttctctgtccagcctgcttttatttttttttttagtttacagggtaaaaataatatttgtcagtgttatcatagtaaaggttgtagaagaatccattcaatgaatacctgtttctttatatggggttttagtttatggttactataagtgataactgcaaaggaactatttttcctaagccactgacccaatcttctgacaacagattttattttctctcttgtattatattagtccaagctctaagtgattagaccatgtttctactctcaatatgccctttatttattttcctcttcccttcttcccaatgttccctcttctgctttgactccttctcccttaggtaagtcaaatctcatggatgccatcagctttgtgcttggtgaaaagaccagcaacctgagggtaaagaccctgcgggacctgatacatggagcacctgtgggcaagccggctgccaaccgagcctttgtcagcatggtctactcggaggagggtgctgaggaccgtacctttgcccgagtcattgtaggtgagtgaggctcagaaggctccctgggtccaatgaagcagatagactagttgtcaggataggaggaatacctgatccttgttgactcatttgttgccttgtagggggctcttctgagtacaagatcaacaacaaagttgtccagctacatgaatacagtgaagagttagagaagttgggcattctcatcaaagctcgtaacttcctcgtcttccaggtgagatatataatttttttaaagacgatctcactgtgtagtccctggctgccctggaacttatatgtagcttaggctagccttgaactcagaaacgtctacctgcctctgcttcctgggtgataggattaaaggtatgtactgccatgctcagcaaattactttcatttttatttttatacactatttgcatcatttccacagtccctctccccacttcaattcctatatctcccttaccacctcctcaggaagagatcaggatatatgatctcttctgtattattttcaagatttttattttatatatctgagtgttttgcttctatgtatgtatgtatgggcatcacatgtgtgtctgatgccaggccagaaggcagcatcagaccccctgaaactggagttacagatggttgtcagctaccatttaagtggtgggaattaagtcagagtcctctgcaagagcagcaagtacttttaaccattgagccatctctacaggccccatatttgttttgtttgtttactcacacacctctgttgagtccagttttgtattgggccttatttgtatgtgtttagagctgaggtcttcgtgaggggtggggagcaaatggttcaccctctcttagcaaccatcagtgaccttttgaaagtttcctccatccatattggtatgttcattggtgtagtcttcacatatcttgtgctgagagccatattattgagaattcttgggaacaccatctttgtccaggccagaagaaactatcatacagcagtcatcctgccttccggctccagtaatctttctgtcctctctcctgagatgttgcctgagtcatgatttaggggctgtgttatagatgatgcatttggggctaggcattcttacttttttcctgcattttgacagattttgttgatctgttttctttctgctggaagacaaaaagacgtttcttcaatgagatatgaaacttgtacttatctgtggtaatatggagaaatatttagaagggcattgcaaactatattaatttagtaataggatagaagaagtaggttatcgtctgtggactttttttaaagacaggatttcactgtgtagtcctggctagccagatgtgcctgcttctgcctcctgagtccaggaattaaaggcatgtgccaccatgcccagactgtgggcattttgaaaaaatgattttatggttatgagtgttttacttgtatatatgtgtgtgcaccagggcatgcgatatctatggaagccagaaaaggatgttgggtcctctgggactagagttgtgaactaccatgtgggtggtgggaattgaacctggatcctctggaacaaagagctgctagtgctcttaactggttgttgtctttttttttttagttttttttaattagatattttcttcatttacatttcaaatgctatcccaaaagtcccccattacccccacccactcccctacccacccactcccacttcttggccctggcgttcccctgtactgaggcatatgaagtttgcaagaccaaggggcctctcttcccaatgatggccgaccaggccatcctctgctacatatgcagctagagacacgagctctgggggtactggttagctcatattgttgttccacctatagggttgcagaccccttcagctccttgggtgctttctctagctcctccattgggggccctgtgttccatccaatagatgactgtggtgctcttaactgttgagccacctattcagcccccttgagtgtttaaaaatcattattggctatttgctgtttgttgatgttgcctgtcccaactagagctgcttatctccaagttaatgtgtcttccttagactaatgtgtagcacatgctttagtgggcttcccagttccattctgaccccttcctatttctcccctcagctgggttagtctaataaagacagaagtcttttttttttcctgtcttttcataaagcagttcagtggttccttcttgtctaaggatgattgttcttaaattgttgttgctagaccagcagtattaacaccatatgaggatatgttctaaatgtgcattcttgggccccattccagattatgagctgaagagactctgtggtggggtacagtttgtgttatagcaagctcttaaggctattgtgatgctacctgaagtttgaaaacagttgacttagaatgaacaagcaaatttgcaagcctattgttcataaaacactatgttcaattctttcctgccttagtagctttgtctgccagtcgtctgttcctcagtttcctactctagtccaattaaactaccgcctgtagttctcagattcatttgctgtctttggcatgcaggcctttgcttgttcgtttcccacttgtggaattgtcaaatgaccatttctgtctttgttttacgcatctcccccccacctcactctctcacacacacacttgaggtggtagggattaaacccagtgcctctcatatgctatccccagtctgttgtccttttttcttgtttagttttcccatatattccaaagtcagctgtacctgtataaaaccttcccaaatagaactccctacctgtttcttgcatctcatacttgaattttctgggctgctttagtgattgtacacaatataccattgttacctttgtgttcgtctctttgtgctcagagacagaaaatgtgccactaaagcccaatatggctgacctggtagcaggggcccataccccaactaaagcaagaagattgtaagttcaaagtttgcttgggctacagaggaagttcaagccatgggtagacaacttatcaagattctctgaaaatcagaaaagtaaaggaagagaagagaatgcaattcagtggtggagtacatactgactttcagttctctgtacttaaactctttcctgcccacaaaaaccccttgaaatgtggcactagttgaggaaaggaggatctgtaaactttggaagtgggcagggtgaattgagctagtagacggctaaatggggcagtgttttgaccttttatcagggtgcagtggagtctattgccatgaagaaccccaaggagaggacagctctgtttgaagaaattagtcgctctggggaacttgcacaggagtatgacaagcgaaagaaagaaatggtgaaggctgaagaagacacacagtttaattatcatcgcaagaaaaatattgcagctgaacgaaaggaggccaaacaagaaaaggaagaggttggtggcctggctgccccttagatctgagggaccaagataaaggcagtgccttactgatacaccctgtccccactcttgtttgcttaggcggaccgctatcagcgcctgaaggatgaggtagtacgagcacaggtacagttgcagctctttaaactctaccacaacgaagtggagattgagaagctcaacaaggaactggcctcgaagaacaaggaaattgagaaggacaagaagcggatggacaaggtagaggatgagctgaaggagaagaagaaagagctgggaaaaatgatgcgggaacagcagcagattgagaaggagatcaagtaagaggcatgcccagacctgtaacttgtttaaaactataagcagctgttgctcttctcttgggatcctctgagcctaaagtctactattgtactaatttatcttccccttgaccaggcacatttcttgactttcaattaatactgtagactattcaagcttggggcagtaaggtaactcagccttgacatagctcatctggtaaaagtgcttgagaccaagtctagtgacttgagttaaattactaggatccaatatggtggaaagagagagctgagtcccacaagttgtcctccaatttctgcatgcactaactagttgtgtgtgtgtgtgtgtgtgtgtgtgtacgcacatgccagtgcatgtgtgatacaaataaatgaacaaaaaaagatctgggctcatagttgacaatttagcaagttcagctattgggtgaccaagaggtctatcctagaagagaagcactgtttctcttaagcttaaaggacaggaatttgaatatcagaagaaggtaactcattggggggagtttttaatgagagacctgttgtagggtttgctttcaacattatgggatagtgttttgacttttatcaggatgcagtggaatctgttgccatgaagaaccccaaagagttgtgagggttgaaaagggggtgataattttgtcttttggagtgactaaaatgtgaggctgctgctgtagattccaacaagtacttggactgtacccctctctgttttttgttgttttggggtcttttgcttgtttttgaggaactatagggcatcaggcccttgttctttaaggtgtttccatgaggttggctaggaatacataggtctctcttttagggtaaaaagcccaggatccctgcgttctgcaggactaactggtttcctttctccttggcaaaagggaaaaggactcggaattgaatcagaagaggcctcagtacatcaaagcaaaagagaatacatcccacaaaatcaagaagctcgaagcagccaagaagtctcttcaaaatgctcagaaacattataagaaacgtaaaggtgacatggatgagctggagaaggagatgctgtcagtggagaaggcccgacaggagtttgaagaacggatggaggaagagagtcagagtcagggcagagacttgaccctggaggagaaccaggtaagtcttgaaagggtcctggcaaagagattggtgacttaacatcggctgacttagtgacctgtcctcttttcctgtcttaacacaggtaaagaaataccaccgattgaaagaagaagccagcaagagagcagctactttggctcaggagctggagaagttcaatcgagaccagaaagctgaccaggaccgtctagatctggaagagcggaagaaagtagaaacagaggtaggcaaaaattgaaggatgacgtgtgggagtgtagctcagcagcagtgtgtgcttagcatatttaccctgaattcaattcccagcatcaaccacaacaaaacaatcaggggtgataatccctaaataaggtaataatgatagccttaataacaacagaaatttgtatgtatcaggcagctaccgtgtgctaaacactatgcttaacatatattcacttatttaagttcatctatgattacctttaagggatggttactattatcctcactttcaaaacgaggaaactattccagtggtgaagtaagctggagcttaataataacagcaatcccataattactcagctgcaggtttaggatgaacctgggcagtctgtctctaaagctcacactgttgccaagtatacttcactcactgccattctcctactactattaatgtgtaccctagactaagtacttactacagcttacagatgagacagcaaggtcagagacgtctgtgaagctttactttgcttgggtttgagctttagattgctgaggaaccctggcctgggtacagtactcctgagagattttggagcccttagaagccctaatgtagcagtagactggactttgtttcgccttgtagtaggcctcctgtattagatcatgacagattctgttggactgttggaattttgggtaagtggggtcaatagcggtgtaagtcgagaccacatgaacttgggttaactggttcagcctctaatagtggtatgcatttattatccaggccaagatcaagcaaaaactgcgggagattgaagagaatcagaaacggattgagaagctagaagaatatattaccactagcaagtatgtggctctgcaatcctctctttaccctccacgttcttccatgctcatcctgcccctctttaggcgggtctaccagagccctttagtcacaagtcttatcttaccaggcaggttaactcctgtgcttctttactttgtaggcagtctctagaggagcagaagaagctagagggagaactgacggaagaagtagagatggccaagcgtcgtattgatgagatcaataaggagctgaaccaggtgatggagcaattaggggatgcacgaattgaccgacaggagagtagccgccagcagcgaaaggcagaaataatggaaagcatcaagcgtctctaccctggctctgtggtaagactggaggggactcagatttctgagtatgtattcagactcactgtcaaccttctgtgttctgtggtagatttcctatgcagagacatgatacacacctactcacctgagaaagggaacgtacaatagtcctaagtaatggttgcaacaaagtccagtatagtgaaccgatgagtttttcctggcattactaacaagagtatgagtgagagattacttaagagcaggaacgacttttaaaacgtagatgtatcaccaaaaagcccaccctatggtggatgacagctcacagaagcagcagcgctggagctcttggcagttctcagtcagctcagtggctaagaatctcctatttctctagctgtctgtcagagactcctcctccagtaggtgtttactcctataaagctgaggaacatcttctagaaacttccaagtttccactttcccagacatgaaactaaagtgcctacctcctgagtctcaggagcattctcctcccttctgccagttgggaagagattgctatagaacactctgtgaagacagggtagctattcctacacttatatcagggaaaatggaaactcaactagattatcctgcccaaacagacatagcttgggctggagagatggctcagagttaagagcactgtctactcttctttagggcctgagtttggttcccaacacccacatcttgactcacaatgtctgtgacttcagtttcaggggatctggtaccctcttctggcctgtgaggagacaaatcacacatgggtatacatgtagacaaaacacacatacatataaaataaaaaataaataaatgataaaaagaaaagaaaagcatatgagagaactgttcatgtcctggttttgttttcagtttaaattttctatttactgggagctagagagatgatgcctcaatgattaagagcacttgccctttcagaggacttaatgtaacagttggtttacagctgcctataactacagctccaagggatccagtgcccccagcctttgagggcatggcacatacacacatgcagacactcttacacataattgtaaaaactgtgtatgtgtgtatttgtaaggacatgtaccacatcaagaatggggcttggagaacctgaggtgtgagtccttgttatcaagcttatttgagacaagagtcctgtgttggtttttgacttttttcttcatgtatgtatgtgtaccacatgcatgcctggtgcttgtggagttcagaaatcatcagatctcctggaactagagttatgggtggttgtgagccaccatgtgggtaagtgggagtgctcttaacagctgagaaatctctccagaccctcatgttttcttctgctatgtataccagggtgggtggcccacaagcttcctgagatttttctgcctccacttcccatctccccataggaactagttggattgcagacaatgtgtgctaccatgtccatggattgtatcggttctagggattcacatctaagtcttaactcctacatggtgacaactttactcactgagccatctccatggctgtcatgtgctcttttaattacaattacatctttctgatgcgtttgtcttgctatatccattcctctttgggggatggggacaacaaagaaggttttgggaagaggataggtagactagtaattgctcttcaaaaaagtagctttctgtagttttctatgaattccattggttgttaggggaccctgggctttatcagaacttttgacttctgcacctaattctgagttcccaggtgttatccttctgtactattttgtttctgagtttaacttagtttggttctatacatcacatacacactcatcatgcctgtaagtactattagggaagtggaaatacttacaagttacactcagtatgtactttttaaccccctaagggttcctctatgtagctctggagctatgttgccttggaacttaatctggagaccaggctggtctgaaacacatagaaatccacctgcctcctgagtgctggatcagaggcgtgtgccaccaccgcccagctgaagtgattactcttatctcatcgctcttgagaagctatgcttgattctagggctggaataaggaatctagtaaaagttacctactttattgggtgcttgtcagaatttgagataatgtatttaagatatctgtcagtgcttgctaggtaatggtctatgaaataattaaagacattttgaaaaatgataatagattcagatgtgactgcctgaagctgtcactggctttggagcaagagtagggttttcctatatagtatgaggtctgctctgtgagatgggataaaaccaaagtgttccttctactctcacacagccaataaatacagcatttcatttctaataccagatgtatgtgtgtgtacacacatctgtctgtctgtccctcacagcacatgtgtaaagatcagaggaaaacttgcagaagtcagttctctccttctacagtgtttgttctaggaatgtaagtgcccttacttactgagcctcctcttgaattatctagaagcaccctcaacacagaacacttccttccttccttccttccttcttccctccctcccttgcccctccttctcttcctccctccctctttcccacccttcccttccccttcccctttcccacccttcccttcctctttcccacccttcccttcccctttcccacccttcccttcccctttcccacccttcccttcccctttcccacccttcccttcctctttcccaccctcccctcccctcccctccttcctttcagagacaaggtccctagactaaagtctcctggctggcctagaactcactatgtagagcaagctgtctttgaactcacaaagatctgcctgcctctgcttcctgagtcccaagaataaagatttagatgaccatgctctacatgaacacagaactttcaaggtttctggttggttttgttatctatttagacttattttaattgtaggggtgtgtgtgtgtgtgtgtgtgtgtgtgtgtgtttctgtttgtgagtatatatttgtgagtgaagatcctttggagcaggagttatatgtggttgtgagccacctgacgagaatgctttgaactgagctcaggtcctctgcaagagcagcaagtactctttaacagctgatttcatttctcagtcctgagcttttgagtttttatggagggtttattttataggcatgatagattaagtcattgcctattgctgatgaactcagcttttagtcatcatttctttttaggtgtgggacaggggactagaaggcccaatcctctaatcctgccttggtctctataatgactagctctcgtgaaagttacctaggagtagtcactgatcggtcaactcattatgattttagtttttgaaactgtatcagaaatcatagtcaagctaaatgtatgttttgtaatttcatagtccccccctttcgtctttgaacataaatcttttacatcaaaataactgtaagtcagaagatactggtgtgtttctataatctcatttagctataagttaatgagttaccattctaaagctaggttctttggtgcatgcctttaatatcagcagttggaaggcacaggcaggaatatcatgagtttgaagtcaacctggggtaaccagggagatctaggttagtcccagctaaataatgagaccatgtttcaaaaacagaaaaattagtgtatcgtattcaagaatgttttctgggggaggctgttaagtcttgtggctttttagttaatcttgtctgattccaaaagcaatagtctgtcttaggaaacatatagcttcactttttaagcttctgatataagtgaacatagaggcaatgtgatttcttactcggttctgaggtgctaattgggtcttccatcttttaacatgtttattcagtccttaatcttcctcttagccaaacttctatctttggaaggagcattagaattgactgctgtactagtctaaattgcttgtagccatacaagtctaacaagtccctcccctcgggctgttccccttcctatcttagtggtatcatatagtacaaaagtagaggactgactgcaccaacaagcagcaatgagtgtattcatggtagcttatacagatttttatcttgcccttctttgtaagctagtaattgggattcctaagccttgtgcttcagtttcccttcttcctttatattcagtatggccgcctcattgacctctgccagcctacacaaaagaagtatcagattgctgtgaccaaggttttagggaagaacatggatgctattattgtagactcagagaagacaggtcgggactgtattcagtatatcaaggagcaacgtggagagcctgagaccttcttgcctcttgactacctggaggtaaggcttgtgaaggggtttggggtcaaggcagtgttatgggcccctcaccttggctttatgtattctgttgcttcataagattcttcacacaggtgaaacctactgatgagaaactccgggagctgaagggggccaagctagtgattgatgtaattcgttatgaaccacctcacattaaaaaagctctgcagtatgcttgtggcaatgcccttgtttgtgataatgtggaggatgctcgacgcattgcctttggaggtcaccaacgccacaaggtatgcaccctccccccctttctcaggttggagttggacaggctcagtgtcttagtcagggtttctattcctgcacaaacatcatgaccaagaagcaagttggggaggaaagggtttattcggcttacacttccatactgctgttcatcaccaaggaagtcaggactggaactcaagcaggtcaggaagcaggagctgatgcagagccatggagggtgctctttactggtttgcttcacctgctctcttatagaacccaagactaccagcccagggatggtcccacccacaaggggcctttcccccttgatcgctaattgagaaaatgccttacagttggatctcatggagacatttcctcaactgaagctcctttctctgtgataactccagctgtgtcaagttgacacaaaactagccagtacaattgaccccttgtcaacttgacacacaaacacatcactagtaagcctcaacccttacattcttattcatccccattataaataactttaaaagtcccacagtctttacatattcttaaattttcaatctctttaaaatccaaagtttttttacaattaaaagtgtcttaactgtgcgctccactaaaactgtttcttccttcaagagggaaactatcagggcacagtcacaatcaaaagcaaaaatcaatctctaactgtccaatgtctgggatccaactcacgatcttctgggctcctccaagggcttgggtcacttctccagccatgccctttgtagcacacgcgtcatcctctaggctccagatgactgtactccactgatgctgctgctcttggtggtcatctcatggtactggcatctccaaaacactgcatgaccccttcagtcctgggccttcaattgcaactgaggctgcaccttcaccaatggccttccatggcctctcacagtgccgagcctcagctgttctgcgtgaccccttcatgccttcaaaaccagtaccacctgggtgacccttacatattaccaagtcccgctgcagcaggagtacaaccttggccatctctggaacacagcctctttgtgctttcagaaaacacttcccagaagatgtcacctcaatgatgctggtctcttcttaatcaccgctaatttcttagctccagctaaccagcatcaatagtcccagtaatgcaaagtttttgctttagtagttccggtatcttgttaatcacagctgattctttagccccagctaaccagaactacagaatcttcacaatcaaaacagcaatggccctgaaaagagtctttaattttccctctgaaatttcacaaaccagacctccatcttctgcagtgttctcaacattatcttccaagctcctacacaacatccgacagggctcttaacaatgaatggatcttcaagcccaaagttccaaagtccttccacagtcctccccaaaacatggccaggttgtcacaggaataccccactctgctggtaccaatttgtcttagtcagggtttctattcctgcacaaacatcatgaccaagaagcaagttggggaggaaagggtttattcggcttacacttccatactgctgttcatcaccaaggaagtcaggactggaactcaagcaggtcagagagcaggagctgatgcagaggccatggagggatgctctttactggcttgcttcacctgctctcttatagaacccaagactaccagcccagagatggtcccacccacaaggggcctttcccccttgatcactaattgagaaaatgccttacagttggatctcatggagacatttcctcaactgaagctcctttctctgtgataactccagctgtgtcaagttgacacaaaactagccagtacactcagtattggagattcctatgttcaccttcttctcttctctccctgatgcgtatagacagtggcgttggatggcaccctgttccagaagtcaggagttatctctggtggagccagtgatctcaaggcaaaagcacggcgctgggatgagaaagcagtagacaaactgaaagaaaaaaaagaacgtttgacagaggagctgaaagtaaggcacaagtaaccctgacccttaggagtagggttcctgagctcaggttggccacttagcacatggtccttttttcttttcttctttaggagcagatgaaggcaaaacggaaagaggcagaactgcgtcaagtgcagtctcaggcccacgggcttcaaatgcggctgaagtactcacagagtgacctagaacagactaagacaaggcatcttgccctgaatctccaggtaggggctggccttcagcctggcctcccatatcatcctaggtttcactgggactggggaattatccacttttcttccatttcgttcaggatagcatagcagagtatagtcaggcactgggacggggtggaggtgtctagatcttctgtcccctgtgtttattccattaaacaacttacttcttattgtcagttttatcttcttgatctaacaaatggaaagtattgtctattttgtgtggctattgcaaagatcgaatgaattaatacctataaagttcttagaacagttgacattaaataaatgttagggactgttattagcacattcagtcactaaatattgggacttctaaaagtcaattgagagtgaacaacagggccagtgtagtggcctatacctgtggtcccaggacattggagagaagattggagcattcaaggccgccctgagctgtatagtgggatcacatctcaagggaaaacacacacacacacacacacacacaatgatctacaggcatttcactgtctgtaggttgtgtactgttacagcttactcaaactagaattgttacataatacctagacttaccttcttgtgaaaaacagtccaacttctaaaacttatttggcccaggggttatcaataagggattaatggacctataactattactgtacgtacacccatccgtatagattgaaggtggctgaactgggaacgggggaaaatatgagagttctaacaagagatttttggagatgtgacttgggcattggtactaagtcaggctttctcagtgtttgctgaccatggggctagtactgacaagaaaattctttttcttcacaaagcctggtgtcttatttttcaacctattgactataggaaaagtctaagctggagagtgaactagccaacttcgggcctcgcattaatgatatcaagagaatcatacagagccgagagagggaaatgaaagacttgaaggagaagatgaaccaggttagtagggggtgggcatgccaacatatgtatcaggacaagactagatttgtaagtaggagtttagccagtaatacctctgccttccctgactgttccctcaggtggaagatgaggtgtttgaagagttttgtcgggaaattggtgtgcgtaacatccgagaatttgaggaagaaaaggtgaagcggcagaatgaaattgccaagaaacggtgagtgagcgtgtctttatgagataatgggatgtatgcctgcactctgccgtccttgatagtcatgtgtgtcctagggcagcaaccaattcttagaaccataggaacttattgtagggtcctgaaagaacagagaagtcttgaataatagtttttataaaataagacagtgatgcctatcttgtggcattatgaagaagatgagatgaaataacctttgtgaattattcaacataatgaagagcacctaccaagaacaataaacatcccctactaacattatcaggagttccacaagaacatcaagccacataaccataacatatgcagaggacctagttagctcagacccttacaggctccttgattgtctcttcagtctctgagagcacgtaccagtgctgctcagtcaacctgtgggccatgcacttatggtgtccttgagccctctagctcctacagcccttccttcctctcttccttagggttccctgagctgtgggtctctgcatctgctcccttcaattgctggatgaagcctctctgatgatgattgggctaataagctcaggtctctgagtgtcttagtcagggtttctattcctggacaaaacatcatgaccaagatgcaagttggagaggaaagggtttattcgtcttacacttccatactgctgttcatcaccaaggaagtcaggactggaactcaagcaggtcagggggcaggagctgatgcagaagccatggagggatgttctttactggcttgcttcccctggcttgctcagcttcctctcttatagaaccaagactaccagcccatagatggtcccacccacaaggggcctttcccccttgatcactaattgagaaaatgcctgacagttgtatctcatggaggcattttctcaattgaagctcctttctctgtgataactccagctgtgtcaagttgacacaaaactagccagtacactgagtatagcagaatatcattaggaatcatctcattgacctttttatttctttgccagtcgtgtttggtgttctatcctagatctctgggttatccagcctgtggttccttcctggctccaggcagtgtcaggaggtatgggcctcatgttgggccagtcattggttgggcactcccaagttctcctccaccattactccaagatatgttgcaggcaggacaaattgtagctcaaagggtttgtggctaggttaatgtcctagtcccacccctggaactcttgcttggttcaggctctgtatcccccattactaggagtctcactagggtcacccttatagattccaggaagttttccattgtactaagtttcctcatcacacctggaacgtgccccaattccagtcccctcttccagtactctccatccccaccggttcaccccgagtctacctgcaaaatctattctattacctttttcctgggagatctgtgcatccccccctccctctttgtgctcttcttgttatttagcttctctgggtctgtggattgtagcatggttatcatttacttaacagctaatacccacttataagtaagtacatactatgtttgtcgggtaatctcattcaggataattttttctagttacatccatttgcctgtaaatttcatgattattttttttttaacaactgagcagtattccattgtgtaaaatgtaccacattttcttttccattctttggttgagaaacatcgagtttgtttccaatttctggctatttatgaataaagctgctatgagcataggtgaactgttgtctttgtggtaggatggagtatcctttggtgggtatatattcaagagtggtatagttgggtcttgaggtaaattgatttccaattctctgagaaaccgccatattgatttccatagcagttgtacaagtttgcactcccttcagcaatggaggaatattcccccttgctccacatctctccagaataagctgtttcatgtaagatagtgacattttgtaagaatgtacatttttaaagacttatctttatttctttgagtgtgtgtcgaggggggagattgccatgtgtgtgctagtgctcacaaaagccagaagactgtcagcttccctggaactggcattagaggtggttgtgggatacttggtttgggttctgggaacccaggtcctctgaaagagcaaagagcttttaaccactgagctgtctctctagctcaggatgtgtgtcactttgaagtatatttacagtaagaggagataatgggatagaaatgtagggttgaataaagaagataaggaaagggttttgcatagagagcaatgacacatctgttatcaactgccatattgactagtgcaactcatctgaaattgaaaaaggaaggaaacttagaatctgccctgaactatcagaaaaggcattaaaacaacaaggagtaatgaattagagatctgaagaatgagtgggatttagccagccaagcagggacagaaaggagttccagccagtaagaacagcatgcttagaggtgtgacagggtatgccttgttctgaatactaagtagttttgaatgcctggaacataaaaacagggtcaggaggaaagcaggggaggtggaaaggtcagcaggggccggatcatggagggagggctttatgagtcatacttagattggcctaaacattacatatacctcaaaattgtagagttaattacattccatttggattatagtgactaataagtttaagctgctagcatgacatctggcagcatctatcacagtatattgaggattggtggagcagttggaagctagctctgcttggctgctagttcctatatgctgttaatgtactttgagtttctgaagaggtaagggaaagggcaatagcaaaatagcagaaattcattgttttctttatgttcttacaccaccaaatctctgccccttaggagcttctaaagtcttggggcacagcttaagatgctagaaagaactgaagcccttgggtaaaaataagctgactacagccaatatcccttgcattgatgatgatagctagcatgtactgaatgctttctttatatataatattaactcaagaaaagctacatgtaactgaaattacactacttctaagttgaagaattgggatatttgttatattagcctctactacagtgatgatatataacaaagagcctaggttctggtgttagacttggattccagtctcatatgatatttgttaccattagctgtgtggctttgggcaaagttttttttttaaactcttaccataagtttcctgtgtaaaatatggatattaatgcctagttataggaattttgagtaaagaaatagagataatctgcataaagtatataaagcttgaagagacggctaactggtttcaggtgagcttttttaaatgtctcctagaaaattgggaaggtgctggagtttcaatgtttagaagcctgtcttaggcttttgggcacactttggtgtccatgtgagtggatgaggccatttaactgagactcagcagtgaccaagaggtcccgagcactaagtctacttcccctttcgttctgcagcttggaatttgagaatcagaagactcgcttgggcatccaattggattttgaaaagaatcagttgaaggaggaccaggataaagtacacatgtgggaacagacggtgaaaaaggatgaaaatgagatagaaaagcttaagaaggtaaggaaggagaaaggtaaaagacaggaggaagctggaatagatattatgcacaccaatatagtacccatcattaatacagtttttatttaaggaaaaccactaagaccttaataggggagaagtggttaagcggcgcagaacatttcaaaagattgaagtagctcacaaacataaataacttagcttttccaggaatcaaagaaataccgatgaaagcagcaattgagtctactttaattttctctaagttaaagatttgaggaattttggtttttggtggggagttgatgggctctgattaatagtctgtgttgggtatatgcacatgaatgcaggtgcccatgaaggtcagaagcctcagataccctggagctggaattataagcaagtgggatctgggaatcaaacttggctcctcttcaagagtagtatgcactcttaactgttgagccatctctcttgccctacattatctaaaaagcttttattttacattgcattatgtgcctttgtggttatatgtgcatgtgtgtcagggtatggtatatatgtgtgtgctgctgccctcaaaagtcaaagattttggatccccttggagctagagttacagatagtttttttgagtcacctgatgtggatgctgagaattgaactcgggtcttcttaagagcagtacgcccccttaaccactgagtcatctttccagcctcacattatttaaaaattaaaaacaaaaacaaaatatttcttagtacctcatatggtgcaggagaccagtattcttacataacattccaacatccatcaaaaagcttcagaatgcgtttatgccctctaactcagtagtacccgcagaggtaatccagagtgctggcaaagccttgtgcaaacacactgatgtttattaccaacattatttatagttccaaggtggagactaggcagtgcccttggaaagtaggaatttagaaaaattatgctgcattcaatacttatataatttagtggtctttacacttttgtaacagatctcgtttaaagcaaaaagtattttctaagatagccagagctgcttacattctgttattactttaatataaaaatcaatgtttgtactaggtatgtggaacatgactttgatcctaggcagaggcaggaggatctctgtgagttcaaaaccagcctggtctatagaggcagttcctagacagccggactatgtagagagatctgtctccaaaaaaaaaaaaaaaaaaagaggaaaaaaattgtgtctttaatgcctaaccagaagccaagacaaacttaataatgaaatactagcaaactgaataaaatttggacctttaaaaaggaaaccttgtaattttttttttagaacatctgaattttttaatccttctttacaggttatctagaccacttttgattaagaaaactgtagaaagttagtaactgccacaagcggatgccagttggtggcacatgtcaatttccagagtcctgctttgcgcggtgtctgaaatgcactgctcggggtctctgctcaaacttgctggaatcactcatggcagattttagtccacaggtcgcttttccccatatttctttgtaaactcttcagcattcttacagaattttttatggtccttagagtattcttcagctaggtcagcccggagtgggtgctcaggctgggggtcattcaccagtgctatgagggactggattacttggtcagtcttggtggctggcttccagttttcagcactaatgactgtcagacagacccgccccttctcatcgatgttagggtggtagatctttgttttaaatgtgatcttgggtggtttgaatggatactctgctggaaagttgatttcaattctgaaggctcccttatcatatggagggttgtcaggaacaataagcccttgccaagtcaataaatgagctggatgttacggaagtttttcattccacatttgcggcatttgcggatctcttcaagctccttcatcagcctcctgctggccgccatcttggatcttaccttgtacttttaatagatgttagagaaaaatgatgtagagatcagtatgtttcagcctttaatctgttagaagcccggtcctgaaaaccttgaggaactgagttgtctgattattttttgatcaacatatgttctcatcaactagttgagtgagccatagggtatttttgttatttcatgtatgtagtatttgataaaaacaagagattagatcagtataggttgtctggctggtaactagatctcatctcttaaaattcatttttttttcttaagctcttctacttttaagcttttatagcattttctttacaagttctaccaattcccgcttagcctttgaggtctagtgacctgagtctttcatattgatattgcccactgctctgtagtggctgtgcgtgaacagtatttcatcatctgctcaattcatcctgaagcgcctcctttctcacacttagcctgaaacatgttggtgggatttgaaggatttctgggagcccacaaagaaggtgggagcaggaagcagcagtgaaagaacaggctggcaagtactattagaggaatagctccaagtgtcctgaccctaaattcagattagccacataaaatcagtgcaacagatgatgttttactgacacacagccatttcatggtatgactgtgctcgtgcctgctacaatcaggctgttaagcatgcctgtgtcgctgtcgtgactttccttatattcttcctcttgaaatgactgtgaagcctttattgcctatagcattccttcctgaggtggtttggttctcttggtttgaacatatccctcggcttttgtttctgcctgtatttgctgcttgtgtattttcttcattaacacttagccatcttgaatagtgttactggaatcttacatgcgcttgcagaataggtagtaaaatactgggacagggctaaatttactttaggatgctccaagatagtatatttataatgactttaaaatttcattttgagtaacaattagttagcagaaagatgtcagaatagtacagcattctttgatactcacaggcgattgaactgcctccctagcaccaaaatgtcagtcccttgtataaaatggacattctttgtctgttaaatatgcatatcctctctcatactttaaattgtctctttattatatctaatacaatgtaagtgcttgttatactttatgatttagaaaatgataaaaaaaatctaaacattcagtacattttaaaaacaaaaaaaaaagcatctcactgtgttgccttggatggtcagaactctatataaataaaccaggctatcttcaaacttagagaaatccacttgcctctgccttctcagtgttgtgcgccacacctagcagagtacagttttttgccaaattctgatgttcttttgaacccatggatacaaactttgtatatacggaaggctgactgactgttaaagcactctaatccatgaaaaattatcagttatcattgtgttgtcataatttcctttagcattctatgtttattatttttataatttatttgagaattatattcagatgtattttcattttctatttatttattcattcatttactcattcatttattgtgataaggtctcatgtagcccatgctggtctcagtctcattatgtgacctccacatggtgggattgtaggcatgtagaatcacttggttttatgcagtgctagggatcaaatcaatggctttgtgcatatgagacaagcactcttgccaactgattcacatcaccagtctgacagtttcccttaatgtgattttaagggaataataaaataataaaatggaagaacaaaaacaattttccttgaaaaagttcaaatgtgggctggggagatggctcagcacttcagagcgtggtgtactgctctccccgttggcccaggtggctcacatctatctaactccagctctagggagctctgacaccctcttctgctctctgacggtacctacacacatataacatgcagtcacacgaacaagtaacattttataaaaacaactttaaattagaacattatacgtaaggctgtaattcttggtttgttgaccactctcctagtcctcttggttttttctagtgataatcccagattaatatctattcacaaaatatactatattgcttgtataagtttaaatacacaaatgttacagactagggaagtgatcatttggtaaagagcttgctacacaagcctgagttcggattcccagcacttacgtaaaaagctgagtataatcccagtgcttgggaggcagagacaggatcatccctggacttgttagaagaattggtgagtaccaggttcaatgagagacctggtctttaaaaatagggtagaaaggcttgaaagatggcttggtagttaaaagtgcatactgcttttagaggccttaaatttggttcctggcacctgggttatggctccagctgcgtaactctagcttcaaaacatctaatgtctctggccttcttgagtacctgcattcacatgtacacactcacacatatactcataactaaaataaattttaaaaaatagattgtggaagacacttgatatatccctatagtatatgcatgcatacgattgagcacgtacacatacacacaccatatatacaaaaggaaaataaatacaaatattatactttatataaccaaagttttggtttggaaaagtgcttaaaactagaacattgattatgatacaaaattaaaaaactaatttcaaccctaagtgttgaaatgtaaattatgcaaggagaaaatatgctagaatgttagttatttatttctgactggtggggttgcaagtgaaccttcacaccttctcccttatttttctatagtttgaactcttctataacagacaatttacataattgtagttggaggaagcaaccagatgatttaggaaaggataaaagaagtctgaggggttgtatgaaagcagaaatcattgacacatactccaacaaactgcctgttgggaaggatagtgcaaaaggagaaaattccaaggggaaatcttcattcttgccctattcccctgctgggaccaggaggaacaaagacacatgaagataatagatgaaaccatggctcagcttcaagaccttaagaatcagcacctggccaaaaagtcagaagtaaacgacaagaatcatgagatggaagagattcgcaagaagcttgggggtgccaacaagtgagtggattcctgcttggatggtggaagcaggtaaagcaggctcccttccagattttggtcttacctaagctacttggactttttagggaaatgactcatttacagaaggaagtgacagccattgagaccaaacttgaacagaagcgcagtgaccgccacaacctgctacaggcctgtaagatgcaggacatcaaactgccactgtcaaagggcaccatggatgatattagtcaggaagaagtgagtattatggtgggtggtaggagtcatctatgaatatttaaccagtaatgggagattacagatggccaggaagggcaggcaacagataggaccacatagagttgtgaggggcataaagatggatgcagaagaaatgtggcaaggtggaagtagtgaagtcaggctttggtatgagagagacattgatttgagaggagagctgcaagccagtgagtactcagaaagaccaagaatgggtcattaatcttaaggatttgagctcttagctgcagcagatactgggcatgggtaggagtgagaattgaggagcagaggaagatgggaaactggagaacctaaggagactgatagcttagctgcagtaagggaggttggccagaagagggttgggtaggggactcagcaaggcagaactaaggaagcttaggtggaggggaaggaacaacatctgagcaactaaagcactctatcaactggaagtgcaagatggtagtgaggggtggacaggtgtaactgagtaactctttgtaggtagcctttcagtttaattcagtaaaatattttgaacactagtattccagatactggtaggccatgacttaaccattcctaatgttaatctcagctgtgctagctgagcttgtgttcacattagacatgaagaaacttagtaaaaggtagagcccagttttcggtttggaccttcctgttggcctctgcttccgtgccatctagcaaaggagttcctaatctctagagggatacaaatgactagtctgctccatctgcctcttccaacattgcagggtagctcccagggagaagagtcagtgagtggttcccagagaacatccagtatctatgctcgagaggccctcattgagattgactacggtgacctgtgtgaagatctgaaggtaagaactgtgggtgggaggcatcagcatcttctcagctggcccaagaaaagttaagtccaggtatacacagagaggaaaaatgacaaactcctctgtagtaaacagaccaggccttaggtacttgtcagggctctgtcacaggtcctatcctccttccttggcattcttatcatctccttcactgtgctcactttagctgctatctctacaattggtcccacaggttacttcaaactctagctctccttcacctctagtgcttctcacatgttcaaaaacaaaactgaagcttcattcttgactctttccctctcttactctgtctaattactaattactgtgttgtgtcaattttgcctcgtaaatacattaggcattctctcttgcttgtttgattgcttactgttgctatatcatatccgtagtgcagacacacaagttcctataggaactaatctccaaaatattttctactttgtagtatattctttatcattatgtccagggagatctgatttttttttaatttataaataatttcaaatatatatagaagtaaggaaaatgatgtaatgaatgtcaggcacctaccacccatcttcagcacttagttacgtatagtcaatcttgttttttataatccccaccatgggactatcgtaaagcagatttgaagcattgttctgttcataattaccttaatatatatctacagaatatgaggttcttacaaataaacaagcattactttgttctatctagtatgcagtaagtgtttttgcattgtctatatcaaagtcagtattcaagtgtgttttcgtttgcttttttattgctgtgataaaacactgatcaaaaacgtcttgggaagaaaagggtttgtttggctgtgtcctagtaccagtccatcattgagagaagcccaggaaggaactcaaagaagagcaggcacctggaggcaggagctgatgcagagccatggagggctgctgcttactgccttgttctcatggcttgctctgcctgctttcttagagagcctagcaccacatgcccagaggtggcactgcttgaagtgtgctggaccttcccacatcagatacctacaggcaatctaatggagaaattttctcaattgaggttcttcttccaagataactctagcttgggccaagttggtaaaagactgaccaggacaaaatattaaggtccacatattaagatcggtttctgctaatctataacttttcttctctctctgtttctttttttgtttgtttccttctatttgtggaagaaaccatagcattggtcctataggattttctgccttctagatttgactaattatatctctgtgatattacttaattatgttcttcattccccgtatttcctataaactggtatatagagagagtttgaatttgagttctttcttggttttggtagtaagaatgtaggagtgtgtggtaggtacatcactgcatcatgtcaatagctatttgctgtcatgacacagttccttgcacatgctcactgctctcagagtagttctaggaacccctcctctagactcaagtcctttatataaaaatgctctagcattcctatgtaacttaaacagattcttcctcatgctttatttatcattcatttagttattcattgagacaggatctcactggatagccctggatgcctagaaactctctatgtagaccaggctggccttaaactctcagagatccatctgtctctgcctcccaagtgctagcattaaaggcatgcaccaccacacttggcttcctgatacttcacatcatctctagcttagttataatgcataatgcaatgtaaatagttactatactgtattgagggaataataacaagaaaaaactacacatttagtaacaggaataacttttttagactgtatttattttatgtccttgtatgtatgtgtaccatgttcatgtgcactgactatggaggtcagaagaggtcattggatcccgtcagactagagttaccggcagttgtaagacaccatataggtgctgagaagcaaacccaggtcctctgcaagagcaacaaatgatcttaaactggtgagccatctctccagcctctactaataatatttttaaaaagatattttcagttcagtttgggaaaccacagacctgattgtgtgagaaacactgatgccaaagcaaccaataaagtaaagcacagatgcagctgcccaagtgtagtctgtgggaacctttctttcttcttatctttttcattttatttgagacagggtctcatcttttgcttaggctggcctcaaactcctgggcacaatcagttttcctatctcagtctcctgagcagctggatgggggcgggggtggtgggagggcgggtttcaaagggcaaaagaggactagagatatttctcagtgatagagtacttacatacagtgcccttggcttaatccctagtagagcaaagaaaatatcattgggtacagaccaagaaaccagtcagtccaaaatgtgtgcataaacccactgcagagaaacgggatagagaaaacacttagaggggggaattcagaagttgcaccttatttgaattcagctttgtaaagcctttgagaaataatttataaaacaagaattcaatattgagttttgatgttagaattaatgttaatattttgagctgtaggaatggtaggtggttttattttccaaaagtccttattgtgtacagcagtggttctcaatgtagggtgggtgttgtgcttcccaggggcagtatatatacttcagggaatctgtagggtctccttatgagatctccacctaggaatatatcatttcattggtcccaattggaagatggacatcttagcctttaatttttttttattagccaaaatagagaagtttcatcttgttacttggtaaccctgaggtccagttacataggaaaggcagcttaactctcctttcattgtcacttctgcacacaattctgggttgctttcttggcattctcagcactctcagtcattgtgagtgtatgggtttaagtacatatgcagtgttcagtctgttgtaattcttggtgctctgtctttagctggggcgggaggtggggtgcattcaccctttgtagtctttgttcatctctctaagttcctgatatgactaggctcatcttctggatttctcaccccaaggaggaatgagaagctcttgactcttgttcagtggaaaacactactatttaataatgtatttatttaatatgagcatttgactgctcaagatagctgactggttagtgtttctagaactcctcagtagatttgggccaccaaatacattttattttttttaatttatttttattttgagggaaaaagaaaattattacagagttcatattgatacctctgattaaaatcgaaattttcagtttaacatcattgtacttacatttgagactcttatttttaccagaaatcttatttcctaacaattttttgaaataaggtttatgtgtgtatatgatgtgtgtgtgaataccatagtatgagtgtacaagtcatatatggagccaattctcttcttccactgtgtgaatcctgaggatcaaacttgagttgtcagtctgagccaacttgctaacccaattttaccatctttgctttctctcatctctcttctctccctctccttctctctctattacacgtacactttctttttctttctttttttttccctgagccttgtaaaaaacacagacagtaaggtagttcaactctaaagccaggagtgagggcacacacctgtagttatagcccttgggatgcagaagcagtatgtttatattgtatttcaccatgaagttcatcttatcattattaactaatgatgctgtttaagtgtcaattgccaggctcctcattgctaagcatacacttttgttttgccattaattagcaaagaattttcagagtggttgctttgtcatcttgtgaacatcttgttccccaataatttttttaacctaacctttctcatatgtctgtttagttttgttttataaccaagcagcatcataaggttctaaaatcaaaagtataaagcagggtacatgaagagagttttggcttctatttctgtttccttctcttcatcagtaggtcactctttaattagtttttacattgcccttttgttgcggttttaaaacacaaatatgtttacgtgcaataacattcatattctccttttagataatagtaaactattcttacttttcattttcatttgaaagcctattctacagactattccataacaatttgtagtgttcttcaaacagagcttgctttctttcttcctttctttcttccttcccttcccttccttccttccttccttccttccttccttccttccttccttccttccttccttccttccttcctttctttctttctttctttctttctttctttctttctttctttctttctttctttcttcctaagttctttcttaagttctttattgttaaatgtctgtgacttttcagtgtagttttttttttccattatggcatttctctaacaaaatttggggtgtctttctctcccgcccctgttctctccgtctccttcctcctttgtgccctcccaccctcactttgatatcacattacacccccacccctgcatgagcttcttttctcaataccttttgtggtctcctatctagttttacagtctacactacttccccaaaccttattaacacatgtataaacactgaaaatgagagaaaacatggaatctttgtctgagattgggctccacttccatccattttcctgaaaatttcccaatttcgtttttcataacagctgaataaaactctattattgatgcattcaacattttcattatccgttcttctgcttaaggacgtctagtctggttccattcccctgcagttgtgaatagtgcaacagtgagcatgagtgtgtcaggatctagagtccttggaatgtatgcccaagagtttgggtcatatgttagctctatatttatgtttttgtttattttgagggggtgatggattgagatagtctctatgtagccctggatttcttacagctcattatgtagaccaagctggcctcaaactcatggatatcttctcccatctgcctcccaagtactagaattaaaggtgcacctcaccatgcccagatagctttaattttttgaggggccataacgatttctttaatggcagtaattactttcctagtagcagtgaataaagtgctttttcccacagcctcaccagcatttgttatttgttttcttgatcataatctatttattatgtttgttttttattatatgtgcatacactgatgtgtggaggtcggaagacaacctcctagagttagttctctcctttaccttgtaggctctggactttgaactccagtttggtgacaagtgcccctattgactgagcatctgctgggccttttgaaatattttctggccattgtgtttcttcttttgagaattatctgtttattgcattaactcttttattgactggtagttttgtggctcggggtttttactttttgtaattatatattctagatctcaatcccctgtctggggcttaactggcaaagattttctcccgttctgtatgtaggctgtttcttctgctgttggtttctctggctgtgcagaaggtttttagtttcatgtcccatttgttgattcttaggactatattctgttatttcactcctgtatagaaagttcttgcttatatctgtaacttcaagcatgttctttgtatcttcctgtaatgtcttcagagtttggggttttaaagtaagtcttttcatatgatttgaaatgatttttgtttaggatgagagatacatttttcggtatatatttttgatgcttttgtcaaaattaggtgaccatagaagtgagtttatttctgggtcttctgtcttggctcttttgggctacctgtttgttttgtgccaacatgtagtttgtttttattgcccagtgatatcccttttttcttaattctttgaaaaatgtatgtagaatgttttaggtcatattcacccctctcctcagtcttctcaggtcccaccttctttccctacccaccaaacttggtgtcaccttcttcttcttcttcttcctctttttataaccccagcaagtaaagtcagtgctgcctagatgttcttggatttgtggccttttactacagtatgatcagcctactaggggccacacccttagagaaaactgactccctctctcccagcagctatcaactgctccttaactagtgaactacgattgtaagtcatacatttaataccttcagcagtgttccttccactaaggactgcttaggctgtatgttgtcttttgtgcttttatattgatttttagatttttttctagttctgtgaagaatgccattggaattttgatgggaattgcattgaatctgtagattacttttagtaataaaagccatttttgcacataaattctgcttgtcgacgcttagaaagtctctctgttgttttgtgtcttctttaagtaccttactcttttcatgcctaggtctttacatccttagtccggagtactttattttgggggtagttattgtgcatggaatggttttcctaatttctgtctcagaaagcttgttgttggtatgtatatatgagagctactaatttttgaatgttgattttgtatcttgtaacattactaaaagtgtttattgaatgtaaaagttttctggtagaatatatgcagttaataacttattctggttataataataacaagatcatattttctgcaaatattgagtaatttcacttgtttgctttttttaaaatcctttttatagctttctcttaccttactgttctagcaagactttctgcacaacattgggtaagaatgttgagagctgacttccatgtctcacggcaaaatttagaggaaatatttttaggttttcattatttattatgatgtggccatatgtttgtcatatatattatttattgttttgaggtatgtttcatttgtttatttctccaggacttttatcttgaggtcatgttgaactgtggtcaataccttttctgtatctatatagtatatagagatggccacgtatttctgtccttaagattgtttatatagatgactagaaggatggatggttcagcaatgcttactgttcttgcaggaggacagagtgtggtttccagcacctgcgttggatggcttaagagtctaatttcagctgcagggagatctggcacgtttagccttcctgggttcctgcattcacatgcacatgcatacaaggccatgcacatgcatatgcacacacggtgcctgtggttctgtataactgcaaggcagtcaattttctagcatggtcaaaagcagctactgctcatgctgaggacccgacttttcattcctggcacccatctcaggcagcttctaactatctataataccagctcctggggatccgacatctttgtcctccacttggcaccagcattcttgtgtacaaactcatacacaggtgcatacacataatttttaaaacggcaaaacaaaatccagcatgaaattggagggcacactgaggagccctcacacctagctgaagagctaatagggttgataaattctgaggaagtttcctttaagcataaatttgacaggtagatcattactcagacttattagtgtatgagagttgggtggataggaagaagttgggggagggaaaagagtatgaataaaatatattgtatgaaagaatttaaatgaatttacagaagaagtcaggaagttgagggatgaaggaatggaagtagatctaggacagtggttctcaactttcctaatgctacaaccctttaatacagttcctcgtgttgtagtgacccccgactataaaattatttttgctgctattttgtaactgtaattttgctattgctatgaaatgtgtgtttttcactggtcttaagtgacccctgtgaaagtgttgttcaatccccaaagaggatgtgacccacaggctcagatctaggaggaattagaaggcgggggtgaatatgatcaagatacatggtatgcatgtatgagattctcaaagaattaataaaatatctaaaagtaagtcaaaaacattactttggcaaattacatttattggtttgcatgttttagttattcatgggttttagtaaataaatgttatcttacaattcattacaagtacataatgtatacttatcactcacaccctctcccatctctactgcctctgttctacccagcccacttctacttgtttcgtgacttagtgtttttaactgaggttatccagatgaacacagatttggggctacctgttggagctttgtggtctcagccctgggtacatactggagcaggtgatttcgcctgtcagaaattcagtaagcagtaagtggaatgaccaagcatctttttcttccatcactttttgacagggactgtcttacatacgtggctctgtgcagataatcatagttgtgagttcgctattacatctttgggatgaaacccacttggtcatgatatgcgatcatgatgtgttcttgaattagtattttccagaaattttctgtttctgtgttcattgggaacactaggtctatagcttccttttgtcatcatgtctttaactgatttggacattagggtaatgctggcttcaaagagtggaattggttatgttactttcctttttatttcatggaacagtttaacaaatattgatattagattttcctttaaagtttgccaggcatggtggtgttttaattccagaatttgggaggcagaggcaggtggatctctgtgaattcaaggacagccagggctgttagacaaagatatcttgttttgggatggatggatagatggatggatgaatggatggatgggtgggtggatgaagtttgatagaacctcagtgttgagttcagctggtcctgggcttgtcaatgtagacttttagttattgtgttagtcttgttgttcattatggattgtgtgcatgtgtgtatagatagatagaagtttgatagaactcagtgttgagttcatctgatcctgggcttgtctctgtggactttcagttattgtgttagtctcattgttcattatggattgtgtgcatgtgtaggtaggtagaaagaggggggagggagaaagaaggaaggaaaggaaaggaaaggaaaggaaaggaaaggaaaggaaaggaaaggaaaggaaaggaaaggaaaggaaaggaaaggaaaggaaagggagtaagttagtttgatagaactcagtgttgagttcatctggtcctgggcttttctctctgtggactttatttattgtgttagtctcattcttcgttatggatcatgtgcatttagaaatgaaccacttcatttagattttatagcgtattagagtgcttgcagtagacccaggttcagttgctaacacccacatgatggatcacagctatctaatctttggttctaagacagttactgctgtcttctagcctccagggataccaagggtcttctctatttccaaaagggttttctaaaatataagtatatctgtgtccttgctctttaaatcatattggtctccgttgagataaaaatttatgtttgtagggccttttgtactctgtcctttgcttgtctatctagtttcttctctttgtgctttccccagcatatttctgtgaaatcatgaacatgatcatgtaggcacacacattgttagtagttccatattgattttttaaaaaaggttttttgacttctaaagttgattattccggaattacttctcattcagtgactaacttatgaggaacctccaccccagcttttgcctgtgatgttattggtcatgtataaaactacatctcctctttcctcttctactgttcatcctgtagcctttagcttgcacacacgcccagaagctttccctcaccacagtctgagtcaggtttccttcttgtgtgctgattcaacactgcttgtcactgtcttcacattcatcttgcattattctgattatttacttagctgtgtttctatgttagtgtcctgaattctgtgaatacaggaactactcttgatggatattcagttaagttaaaagtggcagtgaggcttaagttcaaacatgcatttacagtagctataaggagccctaaaccaaaactgagtggaatttgctcaaatacaatgatttgagagaaaagcttgtattgccttagttatcgtggatctgtaagtggaagccagagcaatttgtgtagggctttaggttaccgtggggtgatgctggctcatggcttgggctaaaagccaaagagggccactatcagctgttcctccggagacacataggttggcgggatctgaaggaagaactataggtgacaaagccacattcacctacagtttccagtgacagttgtgaaagatgccaagctggagaagaattggccttctgcataggagcagacccccaagcaccattcatctctcaggtggcctggactcgggctcaggggctccttactattgctgggtgtggggttacaggatgcacaggcggaggaagaaatcaagcaagaaatgaacacactccagcaaaagctgaatgagcagcagagtgtgcttcagcggattgctgcccctaacatgaaggccatggaaaagctggagagtgtccgagacaagttccaggagacctcagatggtaagcctggcatttctttctgagcctcagatgagaacagaagactgaaggtatgataagggtatactgctatatcataccagctcctgtttttacttataattttatacttaaaattgttagatgccctaaacagtgggggttatctacttgcttgctacagagcaaatgatggtgtcaagaaagctggtagctggtagaacccatggaggaatctatgtttgtgtgcctagactacatggtagccaactcaccgaatactgatccttgtaaggccctcttcaggcatttctctccctttgtaggatatcactagaaattttatttacaggatttacaggtcattcttggcaggtgtggttgtcaaccctggcagaacccagggcactgagagattatcatctgctctttttttctggcagagtttgaagcagcacgaaagcgagcaaagaaggccaagcaggcatttgaacagataaagaaggagcgcttcgaccgattcaatgcttgctttgaatctgtggctaccaacattgatgagatctataaggctctgtcccgtaacagcagtgcccaggtagactgaaactccttatgccaccagctcctaccattcttagttgctcttccctcttcccataaccatgctcattcatgcttgcgggtcctcaccctactctatcttcccctaggcattcttgggccctgagaatcctgaagagccctatttggatggcatcaactacaactgtgtagctcctggcaaacgtttccggcctatggacaatttgtcaggcggggagaagacagttgcagctctggccttgctttttgccatccataggtaaggctttgcctcataatgtggagagacagctgaggcaagccgaggctctggggcccagggatattccgagacctgcataagtgaaggtggtttagttctagatacccttttccctagctactacagcatatcactcttggccttggggtttgtcttggaggcctttttctccatgtgccctcatccattcagcctatcctcatccctgcatgtatttagttccacttctaggcttttcctcacatggttgctggctagtaagctctttgtatacataccagcttgacacacctcttcattctccttccttcccttcctctgggaaaccctctttgacctctggcataccttgacaacctctgccctaggccagtagtgcttagatatgactccctacaacttaacgtttgattataaagcattagttcatgagcatttcttgagtacttctttgtacagaccctattgggagcttagggacagatgagtcagacatggtctctggtcaaaggagcccacggactagaggaagccagacacatacccagacagtagtgcggagggtgtgcatacataaaagagagccacctaacctagtgtatgatgggcaggaaaaaaagcatgagtagtgatggggacgggagaggtggctcagtggttaagaagagtacttgttgctcttgtaaagaacttgggcttggttcccagcacccagatgctagctcagaaacatccataactttagtttcagggggtacagtgccctcttctgacttctgtaggcatcagacatgcacatggtgcacatgtatacattcaagaaaagtactcatacacataaaatattttttaaaagaaaagtttgccaagaaacccagtaagcattctatgctgaacctgtagcatgtctgaagtcaaggaggcgtgtcatcatgacgtatgatgggacatagtagaccctcggatcacttgcttattaagaacagttcctgtaaaaacaaacaaacaaaaaaccctatttttcatggtcttagggggatagtggtacccagaaccagatgcaaatgagggaattcagagacctgggttacttaggctctgaatgtatttggcctattccgactgtggggatggcctactcttcttgctgtcctcatttctcaatattagctcacttatttattgcctcccagctacaagccagcccccttcttcgtcctggatgagattgacgctgccttggataacaccaacattggcaaggtaggttcaagaaaggtgaagcctggaagggaagaccccaagttgggactgggtttcaaggagtcattcctgattgtgccctagctattactgctgcctattctatgtaccaggaggattgggtcaccctcctttgataatcagtagccttttcctagtctctcttactccccactcccacctacttacttagactagaaaatgttaagtgttgaatcttgagccacgataaatactcctcccacaggtggcaaattacatcaaggaacagtcaacttgcaacttccaggccattgttatctctctcaaggaggaattctacaccaaggctgagagcctcattggagtctatcctgaggtacaatgggttgggctacagtggaggggcaaagggtagaggggtgtagaggaccaggttctgagcagtcatctgggcttgttggagcctgccctgaatgtttagccagcccatcctggaagagacagccagtccgtgaagacggggaaaaagtgcaaagaaagaaggcacatgagattgaatgctttctctcatccagaaagaaccattgtctggcctttgagcagatatgtagggaagtcgtttttcagcccctagtcctgggctgtatacctttcttaattctctcctgaccggttttttgtttttctctttccttcagcaaggggactgtgtgatcagcaaagtcctgactttcgacctcaccaagtacccagatgccaaccccaaccccaatgaacaatagcaggaactctatcttcttgtctggatccctcatctgcccttgtgtccatcttctctcctggatatcattaccccctatcatggatcgcctgacaccatgccccttatgcttgtgtgcatgttagattgtttgcaaaataaatattggagattggttttaaaggagcctaatctaaatttgattccaagggaatacaggatagctgtacatcagatgagcaaaagtactcataggagtggcagtcactaaactgccctcatttactctgtcatgtactcattcatctgtgtgttcatcagacacgtaatggacaccttttatttgtctggctctacgtttaaatgctgagtttagtcagggaccatgtctttctggtaaggaaatgggctcggtttgtaaattaccctgattagccagatgtcacaaataccttgataagaggattatcattttcatgctttgtgggaaaactcacatttgagcagaccttgaaaatttggtaagatttagtcagggactaagagtagaggatgctctggggagaggcagttacagatctggttttacttaacacttaatggtttgttgctgaacaaaccatttgacctttctttgtcttagttccctcatttataagatggagctaacatttgccttcctcataggatttaatgatatcatgctctccttaaaaacttatctatgtatggagcactactcgatgctagccctttaaatacaagtcttgttcctgggtctggaagggcttctgacccttgcaagggacagaaggattggccacctctgggagttgctggatgttttggttgctgggaaagagccgggacacagatagggtttatctaataaatagagcctgaggaa

SEQ ID NO: 329 - DNA, 628 bp, mus musculus
aagatggcggccagcaggaggctgatgaaggagcttgaagagatccgcaaatgccgcaaatgtggaatgaaaaacttccgtaacatccagctcatttattgacttggcaagggcttattgttcctgacaaccctccatatgataagggagccttcagaattgaaatcaactttccagcagagtatccattcaaaccacccaagatcacatttaaaacaaagatctaccaccctaacatcgatgagaaggggcgggtctgtctgacagtcattagtgctgaaaactggaagccagccaccaagactgaccaagtaatccagtccctcatagcactggtgaatgacccccagcctgagcacccactccgggctgacctagctgaagaatactctaaggaccataaaaaattctgtaagaatgctgaagagtttacaaagaaatatggggaaaagcgacctgtggactaaaatctgccatgagtgattccagcaagtttgagcagagaccccgagcagtgcatttcagacaccgcgcaaagcaggactctggaaattgacatgtgccaccaactggcatccgcttgtggcagttactaactttctacagttttcttaatcaaaagtggtct

SEQ ID NO: 330 - DNA, 464 bp, mus musculus
atggcggccagcaggaggctgatgaaggagcttgaagagatccgcaaatgccgcaaatgtggaatgaaaaacttccgtaacatccagctcatttattgacttggcaagggcttattgttcctgacaaccctccatatgataagggagccttcagaattgaaatcaactttccagcagagtatccattcaaaccacccaagatcacatttaaaacaaagatctaccaccctaacatcgatgagaaggggcgggtctgtctgacagtcattagtgctgaaaactggaagccagccaccaagactgaccaagtaatccagtccctcatagcactggtgaatgacccccagcctgagcacccactccgggctgacctagctgaagaatactctaaggaccataaaaaattctgtaagaatgctgaagagtttacaaagaaatatggggaaaagcgacctgtggactaa

SEQ ID NO: 331 - DNA, 464 bp, mus musculus; identical to SEQ ID NO: 330

SEQ ID NO: 332 - DNA, 60411 bp, mus musculus; identical to SEQ ID NO: 112

SEQ ID NO: 333 - DNA, 60411 bp, mus musculus; identical to SEQ ID NO: 112

SEQ ID NO: 334 - DNA, 5574 bp, mus musculus
agagctggtcgcgtgaggtgtggcggctccgcttcaagtgtgactggtggctacggccttgtctgagagccgcagagccagtgttgtgagtgcggtcaccatggaccgcccggacgaggggcctccggccaagaccccccgcctgagcagctcggaaccccgtcagcgcgacctgccgcccccgccacccccaccgctccagcgactgcccctgcctccaccccagcagcgtccgagaccccaggaagaaaccgaggctgcacaggtgctggctgacatgaggggggtgggccccacgctgcccccaccactgccctatgtcattcttgaggaaggggggatccgcgcgtatttcaccctgagtgctgagagtcccggatgggatcacgcaatggagtcagggttcggggaggccccttccacagggatcatggaaacgctcccatcttcagaaatctctgggggaagcctggcaattgactttcaggttgcagagcccagcagcctcggagagaaggccctagaaacctgtagcttaggagggtgggggccccagatgttagttggtccgaagaggaaggaggaggctatcataatagtggaagatgaggatgaggatgacaaggagagtgtgaggaggcggcagcgtcggaggaggaggagaaggaagcagaggaaggcgaaggagagccgagagaggagtgcccagaggatggagagcatactgcaggccctggagagcattcaaatggacctggaggcggtgaacatcaaggcaggcaaggccttcttgcgtctcaagcgcaaattcatccagatgcgaaggccctttttggagcgcagagacctcatcatccagcatatcccaggcttctgggtcaaagcagtatccttctcatcagtatgcatgggccagaagcccatgactgaaggggagatgtgtggaagagagagaagaggtgtgggggagggtcagagatgaggatgatgaatccccattagaagattctagaaggcgtggaagagggatggcaagagggcaaaatcgcatctaaaactagactgcagaagggaaaaagagtagcattgcaacatttaaaaagaaaatggatcccagacaataaaagagggaggggtaacggaaaaggcacacagcccataaacggagcaacagatagagaaaggaggagaggaggggggagtacaggtgatgaactgactaaggagggagggcgcataagctcttcgggaagcgtgctcaaaccacacaaggctccataaacctgggtctctgcttagatacctagaaatcccaaatctgtctaccatcctctccattagaggggagagagtagaaatgggatggaaccctgaagaatcaggagaaagaccacttggttgtgaggctcaagtggttaaatgaagggaaaggtacaacaggaagaatccaatccactattggtgactgttgagctcattcccagggaaacacgtatgcaacatttgaaatgcacacattttagtagaatttatatagatataaacacttggcccatgattaaaaagtgtcacatgatcataggctctcgggagtcaggcacagggtatcaagtagatacagatacataacttccatatctagacatgaggcaactgggcctaagcacacagacttctagaggcattcatccattatgtggacactgagcatcaacacctatacatgtaacatttaaatgcaggtcctcggtaaccaaatgtatctgtacttagacttgggcttttagctcccagacatacagtattctgtgaacataagcacaagaatcacatggacatggtcagagacccttagcatctagacctacagcaaatatgaaccatggcaaggctccctgatgctgaggtttaacattgcataagcactcacctactcctcagacatcactcaaacacagaaggaccccccttgcttcagcctgttttgctctgccctccctggcattgaacagtaaatccttgacctaaactgctccactcatcagttcctcaaccaccccagaatttcaatcttgatcaaccaacgtgacagagacattttccgctacttgaccaatcttcaggtcaggccaaagaagaaagccaaggaatctggtctttggaggtgagggggtgggtgggaagggccctgggagggatagataccactattaccccaccctgagcaggtacaggacctcagacatatctccatgggctacaaaatgaagctgtacttccagacaaacccatactttacaaacatggtgatcgtcaaggagttccagcgcaaccgctcaggtaagtgatagtcccaggataaacctatggcccctatactatcatttccccttccttctgtatctcttcctcttctaggccggttggtgtctcattctaccccaatacgttggcaccggggccaggaaccccaggcctataatcgcaggagccatgacaccagagaaagcttcttcaactggttttccaatcacagcctcccagaagctgacagaattgctgaggtgaggcccctcctggcattgccagggaaagcctttcaagacttgtccctgggtgcctgagaaattgtgagtgggttctaggacttaaactccttgaactccttttcactctccccctccccacccctcaacagatcatcaagaacgacctgtgggttaacccagtacgctactatatgagacgaggtggctacagatcaagcagaaagaagcaacacggaaaggaaaggtgatgagagaaatggtgcctgagaggttggggggttgtttttaaatagggcagagactaacctagtgttgcacaggacttatagagacacaggggaccactgaggtaatccaatgaataccttgtttacaaatgagcaatgatccccagaagtggcaatgggactttcccccattcttagaaatcctagtaccttactcccaataacattatactaagttctaaacttgcccacagtagagccaagaatcaatatgaaatggtgatcatggaagatgctcatgaccattatgcaattgaagacattctcagtgacatctcagaaattgatgagatcactgacaatgagaccattcacgacatcaagatctctgacttcatggagaccaccgactacttcgagactactgataatgaggtgaccgatgccaatgagaacctgtgcgacagtgagaatcctgaccacagtgaaggctacaacaccaagatcactgacaacaaagggagcgttgccgcaaatccagatgacaacagtgatgacccagaggaaaagaatacctatgacagtgaggattccaacagcgagaaagctgatggtgataacacaaccctacgtgacaaccagcaggttactaatatccaggacagcagtgatagtgacaatggagatgagggcagtgatgatgaagatgatgatggtaatgagggggacaatgagggcagtgatgatgatgatgatgacaatgagggcagtgatgatgatgacagggacattagatactataagaatggccctgaagtctttgacaaggctctggataaccgcaccaaccagaatgactatgaggaggaggtagaactcatctctgaagactcagttgaagaagaggaagagaccagtgaggaaggtgagatataggcccctcccccttcctttctcttctgagaacacccaggtttctttaggcaactggtggtgaggtaaacactgtgtgttctctccggtcagaggacagggcagttaattttacctcaaggagtgggaaaggagagggagagctaggggaaggaggtaccattattgtcgagccttctccatggcatggattagcgacacaatgtttggcaaggcttccaagattatcagaggacccttcactcattcattgttgatcaaatgtgttaggcaaataatacataaatatcctctacacattctaagaatcctgcctttaaaacccctatttcactttgcagagctccacatttcccagacctcttgaccacaaaacatgttctttgtccaacactgtatacatttgggaaactgcttaggaaagactgcacatggaagtctgagggctaatgcaatatttaaattgactcccaggtttagttctgatctggaagactgggaaaagaactcatttgaacctggctgtgggcagacaaaggagaggtgaaccccaggggtaggtggcagagataggaaaaccagccacgtctgaaggtttaagcaaggcactaagggtgaaagtgtgcagaagggaggatccacagacacacattttggggtaggctggggaaactaagggaattgtcagtcctctttgcctcccatctgacaccatctcttttctccaaaaattggaggcagagctgcctagctctggagtggagtggggatggggaacaagactgaagaaggcagactacagcctatgtttgggtcacactaggtgcaaaaagtaataagtaaaaagccaaggcctcactcagaaacagaagcactttgaggagtgtgggagcaggagaaaggggaatgtatcagttttgatctgacaaagatgaatgccctgctgtcttgcctccctccctccctccctcttctaaccttggatatgagcacaatctcaatggcactttatctccccttcctccctgtcccaaacagaggcactggtgactagtggtccccagccctcaaaagccacagccattttgttctgttcacttttcaaggggtatccaactaccttcccctgtgtcctcctctctccttcacagccagccagctaagtgaggacagctatgaagatgagcgaatctatggggaggaaagaagtgaggtgaactccgaagattctgatattcaggaagtgctgccggtcccaaaagcttgggccagcctggggaagaaagggaaaatcggataaacatcttgccctctaggggctctctatatatacccctatgccctctcccatttgccctcctcttcagctagggctgtgcggccccatattgcacttctggggggagacagacttattacacgggtttaaagtttatttttatggtttagtaattgcagagttcttatttggaggagggaccacgctccccttcggccctcctccactgcaggcttctgtgtgctgctaatcttatttattgtgatgccttggtcagggcccctctagcccccttctcgtgagcttaggcccaagcccctctctccgtgctgcgtggacatcctatctctaagcgagaagggccgctgtgaccttcgtcacaattgcactgtggcctcagactctgctaccccttctccagagttactctgcaactcctttcttcccttcaacagccctgactgctagcccgcctcagtgtctttgcaaggcagcttcgcctttgtgggattcctgctccccagaagccccgcccctttccccgtgaccctcaacgagcctaataaaactgagcaaattcaaagtg

SEQ ID NO: 335 - DNA, 5625 bp, mus musculus
tgggagtggggcaggcgctgtgggaggggacgtcagagcgaggtggtgagcagagctggtcgcgtgaggtgtggcggctccgcttcaagtgtgactggtggctacggccttgtctgagagccgcagagccagtgttgtgagtgcggtcaccatggaccgcccggacgaggggcctccggccaagaccccccgcctgagcagctcggaaccccgtcagcgcgacctgccgcccccgccacccccaccgctccagcgactgcccctgcctccaccccagcagcgtccgagaccccaggaagaaaccgaggctgcacaggtgctggctgacatgaggggggtgggccccacgctgcccccaccactgccctatgtcattcttgaggaaggggggatccgcgcgtatttcaccctgagtgctgagagtcccggatgggatcacgcaatggagtcagggttcggggaggccccttccacagggatcatggaaacgctcccatcttcagaaatctctgggggaagcctggcaattgactttcaggttgcagagcccagcagcctcggagagaaggccctagaaacctgtagcttaggagggtgggggccccagatgttagttggtccgaagaggaaggaggaggctatcataatagtggaagatgaggatgaggatgacaaggagagtgtgaggaggcggcagcgtcggaggaggaggagaaggaagcagaggaaggcgaaggagagccgagagaggagtgcccagaggatggagagcatactgcaggccctggagagcattcaaatggacctggaggcggtgaacatcaaggcaggcaaggccttcttgcgtctcaagcgcaaattcatccagatgcgaaggccctttttggagcgcagagacctcatcatccagcatatcccaggcttctgggtcaaagcagtatccttctcatcagtatgcatgggccagaagcccatgactgaaggggagatgtgtggaagagagagaagaggtgtgggggagggtcagagatgaggatgatgaatccccattagaagattctagaaggcgtggaagagggatggcaagagggcaaaatcgcatctaaaactagactgcagaagggaaaaagagtagcattgcaacatttaaaaagaaaatggatcccagacaataaaagagggaggggtaacggaaaaggcacacagcccataaacggagcaacagatagagaaaggaggagaggaggggggagtacaggtgatgaactgactaaggagggagggcgcataagctcttcgggaagcgtgctcaaaccacacaaggctccataaacctgggtctctgcttagatacctagaaatcccaaatctgtctaccatcctctccattagaggggagagagtagaaatgggatggaaccctgaagaatcaggagaaagaccacttggttgtgaggctcaagtggttaaatgaagggaaaggtacaacaggaagaatccaatccactattggtgactgttgagctcattcccagggaaacacgtatgcaacatttgaaatgcacacattttagtagaatttatatagatataaacacttggcccatgattaaaaagtgtcacatgatcataggctctcgggagtcaggcacagggtatcaagtagatacagatacataacttccatatctagacatgaggcaactgggcctaagcacacagacttctagaggcattcatccattatgtggacactgagcatcaacacctatacatgtaacatttaaatgcaggtcctcggtaaccaaatgtatctgtacttagacttgggcttttagctcccagacatacagtattctgtgaacataagcacaagaatcacatggacatggtcagagacccttagcatctagacctacagcaaatatgaaccatggcaaggctccctgatgctgaggtttaacattgcataagcactcacctactcctcagacatcactcaaacacagaaggaccccccttgcttcagcctgttttgctctgccctccctggcattgaacagtaaatccttgacctaaactgctccactcatcagttcctcaaccaccccagaatttcaatcttgatcaaccaacgtgacagagacattttccgctacttgaccaatcttcaggtcaggccaaagaagaaagccaaggaatctggtctttggaggtgagggggtgggtgggaagggccctgggagggatagataccactattaccccaccctgagcaggtacaggacctcagacatatctccatgggctacaaaatgaagctgtacttccagacaaacccatactttacaaacatggtgatcgtcaaggagttccagcgcaaccgctcaggtaagtgatagtcccaggataaacctatggcccctatactatcatttccccttccttctgtatctcttcctcttctaggccggttggtgtctcattctaccccaatacgttggcaccggggccaggaaccccaggcctataatcgcaggagccatgacaccagagaaagcttcttcaactggttttccaatcacagcctcccagaagctgacagaattgctgaggtgaggcccctcctggcattgccagggaaagcctttcaagacttgtccctgggtgcctgagaaattgtgagtgggttctaggacttaaactccttgaactccttttcactctccccctccccacccctcaacagatcatcaagaacgacctgtgggttaacccagtacgctactatatgagacgaggtggctacagatcaagcagaaagaagcaacacggaaaggaaaggtgatgagagaaatggtgcctgagaggttggggggttgtttttaaatagggcagagactaacctagtgttgcacaggacttatagagacacaggggaccactgaggtaatccaatgaataccttgtttacaaatgagcaatgatccccagaagtggcaatgggactttcccccattcttagaaatcctagtaccttactcccaataacattatactaagttctaaacttgcccacagtagagccaagaatcaatatgaaatggtgatcatggaagatgctcatgaccattatgcaattgaagacattctcagtgacatctcagaaattgatgagatcactgacaatgagaccattcacgacatcaagatctctgacttcatggagaccaccgactacttcgagactactgataatgaggtgaccgatgccaatgagaacctgtgcgacagtgagaatcctgaccacagtgaaggctacaacaccaagatcactgacaacaaagggagcgttgccgcaaatccagatgacaacagtgatgacccagaggaaaagaatacctatgacagtgaggattccaacagcgagaaagctgatggtgataacacaaccctacgtgacaaccagcaggttactaatatccaggacagcagtgatagtgacaatggagatgagggcagtgatgatgaagatgatgatggtaatgagggggacaatgagggcagtgatgatgatgatgatgacaatgagggcagtgatgatgatgacagggacattagatactataagaatggccctgaagtctttgacaaggctctggataaccgcaccaaccagaatgactatgaggaggaggtagaactcatctctgaagactcagttgaagaagaggaagagaccagtgaggaaggtgagatataggcccctcccccttcctttctcttctgagaacacccaggtttctttaggcaactggtggtgaggtaaacactgtgtgttctctccggtcagaggacagggcagttaattttacctcaaggagtgggaaaggagagggagagctaggggaaggaggtaccattattgtcgagccttctccatggcatggattagcgacacaatgtttggcaaggcttccaagattatcagaggacccttcactcattcattgttgatcaaatgtgttaggcaaataatacataaatatcctctacacattctaagaatcctgcctttaaaacccctatttcactttgcagagctccacatttcccagacctcttgaccacaaaacatgttctttgtccaacactgtatacatttgggaaactgcttaggaaagactgcacatggaagtctgagggctaatgcaatatttaaattgactcccaggtttagttctgatctggaagactgggaaaagaactcatttgaacctggctgtgggcagacaaaggagaggtgaaccccaggggtaggtggcagagataggaaaaccagccacgtctgaaggtttaagcaaggcactaagggtgaaagtgtgcagaagggaggatccacagacacacattttggggtaggctggggaaactaagggaattgtcagtcctctttgcctcccatctgacaccatctcttttctccaaaaattggaggcagagctgcctagctctggagtggagtggggatggggaacaagactgaagaaggcagactacagcctatgtttgggtcacactaggtgcaaaaagtaataagtaaaaagccaaggcctcactcagaaacagaagcactttgaggagtgtgggagcaggagaaaggggaatgtatcagttttgatctgacaaagatgaatgccctgctgtcttgcctccctccctccctccctcttctaaccttggatatgagcacaatctcaatggcactttatctccccttcctccctgtcccaaacagaggcactggtgactagtggtccccagccctcaaaagccacagccattttgttctgttcacttttcaaggggtatccaactaccttcccctgtgtcctcctctctccttcacagccagccagctaagtgaggacagctatgaagatgagcgaatctatggggaggaaagaagtgaggtgaactccgaagattctgatattcaggaagtgctgccggtcccaaaagcttgggccagcctggggaagaaagggaaaatcggataaacatcttgccctctaggggctctctatatatacccctatgccctctcccatttgccctcctcttcagctagggctgtgcggccccatattgcacttctggggggagacagacttattacacgggtttaaagtttatttttatggtttagtaattgcagagttcttatttggaggagggaccacgctccccttcggccctcctccactgcaggcttctgtgtgctgctaatcttatttattgtgatgccttggtcagggcccctctagcccccttctcgtgagcttaggcccaagcccctctctccgtgctgcgtggacatcctatctctaagcgagaagggccgctgtgaccttcgtcacaattgcactgtggcctcagactctgctaccccttctccagagttactctgcaactcctttcttcccttcaacagccctgactgctagcccgcctcagtgtctttgcaaggcagcttcgcctttgtgggattcctgctccccagaagccccgcccctttccccgtgaccctcaacgagcctaataaaactgagcaaattcaaagtg

SEQ ID NO: 336 - DNA, 5625 bp, mus musculus; identical to SEQ ID NO: 335

SEQ ID NO: 337 - DNA, 903 bp, mus musculus
atggctaccagtcgatatgaacctgtggctgaaattggtgtcagtgcctatgagacagtgtacaaagcccgagattcctacagtggccactttgtggccctcaagagtgtgagagttcctaatgaaggagcagctggctggggccttcccataagcacagttcgtgtggtggacttatgaaggaggctggagaccttggacatcccaatgttgtacgctggtggatgtctgtgctactttccaaactgatcaggacatcaaggtcaccctagtgtttgagcaccctagtgttagaccaggacctaaggacatatctggacaaagcacctccgccaggcttgccagttgagaccattaaggatctgatgtgtccatttctaagcggcctagattttcttcatgcaacctgcattgttcaccaggacctgaagccagagaacattctagtgacaagcaatgggacggtcaagctggctgactttggcctagccagaatctacagctaccagatggcctcacgcccatggctgttaggctctggtacccagctcctgaattcttctgctgtctgcatacgcaacccctgtggatgtgtggcgcgttagctgtatcttcacagcgatgcttcgctggatgcctctcttctgtggaaactctgaagctgaccagttgggatctcattggtttcctccagaagacgactggcctccagaggtgtctctacctcacagagcctttgcccccagagggcctcggtcagtgcaatcagtggtgccagagatggaggaatcagtagcgcaacttctgctgggaatgctgacctttaacccacatgagcaaatctctgccttctgagccctgcagcactcctttctgaacaaggaggaaagtgacatggagtga

SEQ ID NO: 338 - DNA, 3222 bp, mus musculus
catagagaagactggcagaggagcgcctggacagcagcagcagctgactttctagatgaagcgcgccttggggccccaggtaacaaacccagacctttttacaaatccgcgggcttggggagctgcggtggttgcggggagggagcatgcactttgggggtcgcgtactgtggatgggggtggtcacgcgtgaagggagtctgaattctgggggaaaccctaggaaatgagaggacaggagcaagaaacggggtgtgagggcacaggcacgaaagagcaagagagggcgctcgagcgtggcacacagcaagcgcgcttaggagtagaggctggaagcataggtaagaaaggaggcaggggacactttcgtccactgagtcagttttttttcaaagataacctcctttcagccatatttaacatacattgttgactcgaggggtttaaagatgcaaggaaagaacgtagaaaaaggtgcgccaaagcgaggctgcacagagcgccgaaaagacagcgggttatgcctttttaaaagagttgccatccttttcaccctaaagctcaggacagtccccttcccccctccttccccggtaccagcagttctggcggcctttggagcaggtagccgcgggctcgggctcggcacgccacgcgagcccccggtgcaggggcggagccgcggccgcgcgcggggctcgcggcagggggaggggctgaggctaacggcaccgcggccatgacgccgggctggccgtccacacgagttcctgtctccctccacccatagtcatagctcattcccagacgcgtttcttcccaggcttgggagtgagccgatggcccacgttcgagaagcgtcccggtcctcccgctctgtcgcctgttggagttcgggaggtggtcgaggagcctgtctggagcaggcagctgagagtgcatcgagatgcggggtacacagggagcccaggagatgaagccggagctgtggccggagcccaagcccacgtcggagaacttaacaagtaggggcagtggcagctatgagaaggtgctcccttctatcccggctgcttgtcacaccagctccagctcggtttgcccgcgccgcaagccccgccctcggccccagcccaggtcccgctccaggggagggcgtgggctcaaggccccacccccgcctcccgccaaacctccgcctcccccgccagcgccgccacctccacccctgcccaagcagcggtcggtggcctggcgcaattccagacgtagatccaggcctggacccagaccccaaacacggaaaagctactctagtgaccatggctcctctagggattcagatggctcagagaacagtttactggaggtagggtctaataagggtcccacaggctgctgtcatgtagagagctttaaagtagctaaaaactggcagagaaacctgcggatgatctatcagcgtttcatttggagtggaaccccggagactaggaaacgtaaggcaaagtcatgcatctgtcaaatatgtagtactcacaagaacagactccactcttgtctgtcctgtgtattttttggatgctttactgacaaacatattcacattcatgccgaaacaacgcaacacaatttagcagtagacctctgtcatggggttatatattgctttatgtgtagggattatgtatatgacaaagatatagaaaagatcgccaaagaaacaaaagaaaaaattctgggactgttatcatcccctacaggagatgcatcttatcagcagttgatggcatctgaggtggaagaaaaccaattaacctgcgagtcaaaagatcaggagaccagtttggtaaaacccaagaaaaagaggaggaaaaagacaatgtattatactgtaggcttcagaggattaattaatcttggtaatacttgctttatgaattgtattgtccaagtacttactcacattccgctactgaaagagttcttcctttcaaataagcacaaatgtatgatgacaagccccagcttgtgtttagtctgcgagatgtctttactttttcaagctatgtactcggggaaccaaagtcctcatattccctataaattactacacctgatatggatccatgcagagcatctagcaggctacagacaacaggatgctcaggagtttcttattgccatattggatgtgttgcatagacacagcagagatgatggtatcgaccaggaaggtaactccaactgctgtaattgcatcatagatcacatctttacaggtagtctgcagtcagatttaacatgtcaagtttgtcatggtgtctctactaccatagacccatgctgggacattagcttggatttgcctgggccttatactccagggagggctagtagtagcacatcgagtagggatggccagaagccacgagtcatctcacttacagattgcctgaagtggtttacaaggcccgaagacctgggtagcagtgccaaaatcaaatgcagtcaatgccaaagctaccaggaatctaccaaacagctcacaatgaagaaattaccgattgtggcctgctttcacctgaaaagatttgaacatttaggcaaacagagacgaaagattaatagttttatctcgtttcctttggagctggacatgaccccgttcttggcttctactaaagaaagcataatgaaaggccagccattaacagagtgtgtacccagtgagaataagtattctttgtttgcagtaattaaccaccatggaactttggaaagtggccattacaccagttttgtccgacaggaaaaagaccagtggttcagctgtgatgatgctgtagtcaccaaggctacaatggaagaattactcaatagtgaagggtatctactgttctatcataggcaagatatagagaaagaataatctcatccagaatgatttccagaccaaaaaaaatttaaaaagtgaaaaagaagagaaaacaaaaaagaaaaagacaaagagacaacacaagcctaccaggatggacaattgtaatgccattacaacaacaagcacctcttaaaagaaacacaaaaatctacctggagtggacaatgaccatatatgacaagtggcactttggcataaaggaactattttaccctgtcccataagtctatgggaggaagacattgaattttcaatcggtgaccattagccttaagaactgg

SEQ ID NO: 339 - DNA, 274 bp, mus musculus
gggagacaagccaggttggcagcagattggatccagctttattcggcattactatcagtgatttgataacggcagaacccagctaggcgcaatttacattgattgagtcatcatgccttaagtgggaaggacagcagtcccaggggaaagctgccgtggaggagaagctatctagcctcccgttccagaaaattcagcatagtgtcaacagcgcaggaccaccagcctacaccagagagctgcatcatcagcatggttgtaggccagctcaagg

SEQ ID NO: 340 - DNA, 2020 bp, mus musculus
caggaagctacgctaggaaaagagggaggagactgcagtggcagcagcgactgctggaagctcttaagtggcccaggtactgccgcctctgacactcgggaataaggtgagagaaagcccagagcggggacttcctggatgctcccttcttttgccccgcggctttcctagacaggcgcttggccttagactcctggctctgctctcacaggcgctcatttggctgcttgccggctgatcatccttcgctccaggctcgcagcggaggcaacagtcttctgtccgatttgggcacgtgagtgctgcaaacccagacagtgagcaggtgagcatcggactaggtgctggaaaattggaatgggttcctgcttgtcaggaaaattggagggagtgctaagatttgagctgagggaaactcggaaccgagatttggggggcggggcacggagcaagaaacccggggaatcttatacaaaggtggccagtgcatgaaacagattcgtggtgctgagctcaaagggaaacggggatgatttggaagacacatgaagaagtgagcacagagcaagcatgggtatgggcagtgagggcggaatgaaaaggagggggagagtgggtaagagacatagaaatttcacggagggatatagagatatggtattggggttataaatagggatggtggtgcggggcagctgggatgactacggaactagcagagaaccggctgtttctttgcttggctctcaagcgctacaacttccacagcgatctcttcactaactctgttgtgtaaccaaacaagcctggaaagaggcttatgcaggcaggcatttaaacacattttgatatagaatactgctactggacacatgtatatcatgcacagggacttcctaatccacagaaaaataaccttaatatttgcatagaatgtttttccctagattctctcctcctcttacaggtatgaagacccctcacaaaaaaggtgcagcaaaagagcaaatgggagaaggcgtaggtcaccacattggctctacaaccatcaagaagaaaaaagcttctcagaagaggcagaggagcagatcttcatcccgtaggagcatcgtgggctgtagaatttctcacgggtggaaggaaggagatgagccgatcacacagtggaaagggactgtgctggatcaggtgcctatcaacccctctctctacctggtgaaatatgatgggattgactgtgtctatggactggaacttcacagagatgaaaggattttaaagcttaaaatccttcctgataaggtgtcgttctctggagtcagcgatgtgcgccttgctaataccataattggcaaagcagtggaacacatgtttgagggtgagcatggctctaaggatgaatggagggggatggtcctggctcaagcgcctatcatgaacgcctggttttacattacttatgagagagatcccgttttgtacatgtatcagcttctggatgattataaagagggtgacctccgtatcatgccagagtccagtgcatctcctccagcagacagggagccagaaggagttgtagatggcctgataggtaaacatgtggaatacaccaaagaagatggctccaagaggacaggcaaggtcattcaccaagttaaagccaagccttctgtgtacttcatcaagtttgacgatgatttccatatctatgtctatgacttggtgaaaaagaactcttagggtaaaatttgcatagtgtggggaaacaaatgtgtacgttgtagatgtgcaaaaaacattaatttttcagtgtattaaaagcttgagagtttctgataacccagaaactttgccagcaatgctgttgtttttgttctggaaactaccagtctgtggacatgacctgttaaatgtaaaaacacattgtcttgtgtaagagatgagtatgtttggtgaatgggatatgaagaaacagctgtcaaattaacctgtgaataaagtaccattattattataa

SEQ ID NO: 341 - DNA, 34495 bp, mus musculus; identical to SEQ ID NO: 116

SEQ ID NO: 342 - DNA, 450 bp, mus musculus; identical to SEQ ID NO: 117

SEQ ID NO: 343 - DNA, 1140 bp, mus musculus; identical to SEQ ID NO: 118

SEQ ID NO: 344 - DNA, 1551 bp, mus musculus; identical to SEQ ID NO: 119

SEQ ID NO: 345 - DNA, 1084 bp, mus musculus
atgctctacccatacccagaactgaccccggagcagaaggagctgtctgacatcgctcactgaattgtggatctgggcaagggcatcctggctgcagatgagtccactggaagcattggcaagcgcctgcagtcctttggcaccgagaacaccaaggagaacaggcaattctaccgccagttgctgctgactgctggtgaccttgtgaattcctgcattggggttgtgatccttttgcatgagacactgtacgggaaggcagatgatggacgtccttttccccaagttatcaaatccaagggtggtgttgtgggcattaaggtagataagggtgtggtgcccctggcaggaaccaatggtgagactactacccaagggctggatgggctgtctgaacgctgtgcccagtataacaaggatggagctgactttggtaagtggtgctgtgtgctagagattgggaaacatactccctcagcccttaccatcatggaaaatgccaatgttctggcccattatgccagcatctaccagcagcatggtattgtacccattgtagagcctgaaattctccctgatggggaccatggcttgaagtgttgccagtatgtaactgagaaggtactggcagctgtctacaaggtgctgagtgaccaccatgtctatctggaaggcacattgttgaagcccaacatggtcacccttggtcatacttgcacccagaaattttccagtgaggagattgccatggcaacagtcacatcactttgtcgcacagtgccccctgctatctctggggtcattttcctgtctggagggcagactgaggaagaggcatccatcaacctcaacgctatcaagtgtcccctgctgaagtcatgggactttctcctatgaccgagccttgcaggcctctgctctaaaggcctggggtgggaaggaggagaacttgaaggcagcccaggaggagtacatcaagagagccctggacaacagcctcgcttgtcaaggaaagtatacactaagtggccagactggagccacagccagtgaatttctcttcatctctaaccatgcctactaa

SEQ ID NO: 346 - DNA, 1084 bp, mus musculus; identical to SEQ ID NO: 345

SEQ ID NO: 347 - DNA, 99 bp, mus musculus
tgcgccgccgccaggcaccagggctcgcccctttcttcctctcctccttccgccgcccggactacggctccgccccccgcctcccctccccgccgcttc

SEQ ID NO: 348 - DNA, 90368 bp, mus musculus
accaccgtgtggttgctgggatttgaactcaggaccttcagaagagcagtcagtgttcttacctgctgagctatctcaccagcccaaaataatattcatcattctctctctctctctctctctctctctctctctccccctttcttccccctccctccccctccctccccctccctccctctctccctctctctccccgcccctctctctgtaatgtgcatgcagtgcctgcagaagcaggaggagactttggataccctagagttagagatccaggcagttttgagccatcagatgtgggttctgggaactgaactaaagtcctctagaagagctacacgttgggctggtgagatggctcagtgggtaagagcacccgactgttcttccgaaggtcagtgagatggctcagtgggtaagagcacccgactgttcttccgaaggtcaggagttcaaatcccagcaaccacatggtggctcacaaccatccgtaatgagatctgactccctcttctggagtgtctgaggacagctacagtgtacttacatataataaataaataaataaataaataaataaataaatcttaaaaaaaaaaaaagctacacgtgcccttaaccactgagcaatctcttcattgtatggatactatttcatgaaggttcattcattcattcatttattcattcatgtgtatggatatctgtggatgagtatacatacctacgtgtatggggatgttgtatccacgcacacacacggaggctagaaaaaagtatcgaatagcctcttctattgtattcttcctaatcctttgcggcagatctctccttgaacctcctttcctcagataagctggaagccagctagacttaggatctctgtggctctgctccccatgccatcttggtttcttgagtgtgcccatccagtgtgttatgtgaacactctaggatttgtagactaatcctcacctttgcacagcaaggactcttaactgctgagccatctctgtagcacctgaatagcatttttaaaaatcctaaattcatgagtgatatttactggtgtgattcattgatatttgatgtaatgttattaaaatgtcaattctagtctgtcattatggttattgtctttaatcccaacacaccataggtagatctctgtgagtttgaggccagcctggtctgcataatgagtccaggccagtcaaatatacatagaggatcgttcctcttgtttttttaaaatttatttatttatttatttatttatttatttattttggtttttcgagacaaggtttctctttatagctctggctgtcctagagctcactttgtagaccaggctggcctcgaactcagaaatccgcctgcctctgcctcccgagtgctggaattaaaggcgtgtgccaccatgcccggctttaatttaatttttaaatcattctaggagctgatgagatggcttatatagatgttttgttcctaacatctatataatgattcacggccatctgtaactccagtcacagaggatctatggcactcttttggcatcaattttaaattaatcttcaatttacatataactgtaactaatattccagtagggtttgaggataggagattttaaaacattgcaaaacgaattaatgtaggaagtgctaatttgtaagacaatttgaaagaaatgtgcagaactgagaagtagctcggggttcaaacacatacttactgaagccctgagttcagtcctcagcaccacagaaagaaagtaataaatgtaccaaaaggcattaagctgaaacacaagacaatgtaataaaaaataagctctagactggtacaaaagcatccaagacctcaaaagtaaatccacagatcagaatttgatgtgggattaaaatggcttcaaaagtctttggagggagcccgggctaccttgccagcagagtcttgcccaacacccgcaagggcccacacgggactccccacgggatcctaagacctctggtgagtggaacacagcgcctgccccaatccaatcgcgcggaacctgagactgcggtacatagggaagcaggctacccgggcttgatctggggcacaaaccccttccgctccactcgagccccgggctaccttgccagcggagtcgcctgacacccgcaaggcccacacaggattccacacgagatcctaagacctctagtgagtggaacacaacttctgccaggagtctggttcgaacaccagatatctgggtacctgccctgcaagaagagagcttgcctgcagagaatactctgcccactgaaactaaggagagtgctaccctccaggtctgcttatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacagccaaacaggtagaaatcattaaagaaaaacaggaaaacacatccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaaagagatgcccatgatcatacaagaagcctacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctacaatacccggccaaactctcaattaccatagatggagaaaccaaagtattccacgacaaaaccaaattcacacaatatctttccacgaatccagcccttcaaaggataataacagaaaagaagcaatacaaggacggaaatcacgccctagaacaaccaagaaagtaatcattcaacaaaacaaaaataagacagccacaagaacagaatgccaactctaacaacaaaaataaaaggaagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaatgttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcatggaaacagaaactaaacagggacacagtgaaactaacagaagttatgaaacaaatggacctgtcagatatctacagaacattttatcctaaaacaaaaggatataccttcttctcggcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagctctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaaaaagaactattcaaagaattaaccaaacgaggagttggttctttgagaaaatcaacaagatagataaacccttagctagactcactaaaaggcacagggacaaaatcctaattaacaagatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgatcatctaaacagtcccatatcacctaaagaaatagaagcagttattaatagtctcccaaccaaaaaaagaccaggaccagatgggtttagtgcagagttctatcagaccttcaaagaagatctaattccagttctgcacaaactatttcacaaaatacaagtagaaggtactctacccaactcattttatgaagccacttttactctgatacctaaaccacagaaagacccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacatgatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgaaagatctgtatgataaaaaattcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagaaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacacgtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaatgcaaaagacaccgtcaataagacaaaaagacctccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggtgtggatgtggagaaagaggaacactcctccattgttggtgggagtgcaggcttgtacaaccactctggaaatcagtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtactcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcatagggctcccaatggaggagctagagaaagtagccaaggagctaaagggatctgcaaccctataggtggaacaacattatgaactaaccagtaccccggagctcttgactctagctgcatatgtatcaaaagatggcctagtcggccatcactggaaagagaggcccattggacttgcaaactttatatgccccagtacaggggaacaccagggccaaaaagggggagtgggtgggcaggggagtgggggtgggtggatatgggggacttttggtatagcattggaaatgtaaatgagctaaatacctaataaaaaatggggaaaaaaaagtctttggagagctgactgtgttggtggatgcctctaatcccagtacatgagaggtggagacagaaggatcaacactctaaagccagtttggactacataacagcctaattcaagaaaactattaccaccaccaccaccactactgggatgtctgttgaggaggaaggtcagctgagtgctctctcagcctctctgagatagcggcattcatcctagcctctgcctcctgagtcttcatttggtaaaatcaaatgattggtattatgttgttaaaaacaacatatatgccgggcagtggtggcgcacgcctttaatcccagcacttgggaggcagaggcaggcggatttctgagttcaaggccagcctggtctacaaagtgagttccaggacagccagggctatacagagaaaccctgtctcgaaaaaccaaaaaccgaaaccaaaccaaaccaaaacaaacccaccatatatatctattgttgttgttgttaagcttatgtttaggcagcaatgttgacgagactttatggatgtagcttctgacatttctaggcggcacagagtcatagcaaactccctgtccccctggctcttagaatccttctggccaatcttttgcaatgttcactgagctttaggtacaggagttctgtagtagattaatcagttgggactggcctccacaactttgtattttgatcatttgttcctttctgtaatggtctcccatctgtttcaagaagaagtcttgatgagggataagtaggtacaaagccaactatttagaatgtaattagggactacattgggagagaaagaaagaaatatggaaggcatgaggagggtaaaataacagtaagaatgtctgggaaagtcccaaggagtcacactattaactattttttttaaaaatcctataatacacataaaatttgtgtataaatacacatagtgtaaatgaaattcgctcatctgggctaacaatgctttccccaaagagccacagatcatttaacaaaaaccccaacaggagccatgagttgctgatgagggctgtccaagagattcctgaaacacacaccctgtcactgttaaacttgctagaattttgctataaagattttaaaaaacaggtttgagtgacacatgcctttaatcccatcactcagtgcagagacaagcagatcaatgtgagttcaaatccatcctggtgtacctcgcaagttccaggccagctaaagctgcataatgagaccctgtctaaagacaaaacaaaacaaaacaaaacaaaacaaaacaaaaaacaaacaaaaaaaaacggtgaagaaaaatattaaggaaaatcttgtaaatattagaaagaattagttgaccaggtaaaatatttgtagcactcaaactcaatgtatcatctagaatgcaaaaactcccagcaaccaaaaggggttggatcaaacagttaagtgaaaagatagccaaagattaaacaggcactttacagggtaaaacagtatggctgacttttgcaatacattagtacccagctgcaatggcgagattatgaaaatttgattccaaacaaaggaagcagactaatagccgtgacacaataccatttacatgaagtatacaggtgcccatatcctcacaacatgacgtgacatttctaaaatgcagttatgaaaacatcagaggacctgtttttggtggcatactcctgcaaacccagcatcctagatgctcaggcaggagtttcaaaagtgagtttcaagctagtctgagttatatagcaccagactccatatttaatttttttttttcaagacagggtttctctgtatagtcctggctgtcctggaactcactctgtagaccaggctggcctcgaactcagagatctgcctgcctctgcctcccaagtgctgggattaaaggcgtgcgctaccacgcccggctccatatttaaattaatagcagcaaacgtgagagtaactagttgtggggactattcttggttgccaagctgactatatgtgaagtgaactacagattggtttgaagcaagggaatccactcctagtccaggcctttgaggtgggaagacacactttgatctgaatcttgaggtgggaagaaataggcctttgatacagatcttaaggcggaaagctcgggcctctaattcagatcttggcagtaagacacacctttaacagtaccttctactggaagcctatataaggacataggaaagggaaaccttggcctccttgcccttgcctcactagcaagtccatttcttcactggcattggaagctacattgggattccagcagacacaaaagtccagctgagacatccagccttgtgggactgagcaacttcttttttttttttaaagatttatttatttattatatgtaagtacactgtagctgtcttcagacgcaccagaagagggagtcagatcttgttatagatggttgtgagccaccatgtggttgctgggatttgaacttcggaccttcggaagagcagtcgggtgctcttacccactgagccatctcaccagcccccgagcaactacttcttaagactaccttccattcatgctacccattgttggattagtgtactgtagtcattctaatcaattcaatatctataaatatacatctgtatatctatatgtatacacacatatcatacacacacacatagagagggggagggagggagggagggagattcatttcataagttctgtgactctagagaaccctaacacactctttatgcctgaagaacagaatgatagtaagaacacaaaataaaaggattggggcatggtgtcataagcctgtgatcagagtgcctgagagacagcagaaggataaaagcatgttttagacctgtctgttgtaaatagcaagttctaggccagtaagagcttcataacaaggttctgcctcaaataaaaaagtctatagctcttttcagtggcaagaacattactaccccaagcagactgacaaccctcgtccacctctctgtgcatttgtatatcatgtaacttggggtagccacagaaaccaagaaagtaaagagggaccatggaaatgggtgggaggatctctagagaacagcacaattgggcaatattgagatgaggggtgaaggcaaaaccagggaggctttaattgaagaaagggaaggaggagggataaataacactatctaaaagtacatatacaaagctaaagagatagctcagcagttgagaccattggctgcagacaacaactgtctgtaactccagttccaggggctctgacccctgtcttctggtgttctagggcacacaagtggtacacacatatgcaggcaaaacatctagtatttgttgtgtaagtcaggctggccttgaattcatagagctacctttcacattagatcacacagagatctaccatatacacaaaataaaatattttttattttaaaaattgcatatataaggaatgagttccctaattggttatcatatactaaatggtcagccctaaagatgtatgcatacaagcaatgtcaaatgacccagagggtcatagttaggtatttattcacatatatatgtaacaataataattaaagaaaaagagaccgtagatttgagagggaattggtgggtggggtaggcatggagaaagtattatgggttggagcatggaggaggaaatgtcatactctaataaaaataaatatataaaatacatttaaaaagttcaaaatagggagctgatgagatagctcagtggttaagagcactggttgctctttcagaggacctgggtttgattcccagcaaccacatggtgtctcagaatgatccatagtgccagttctaggggacctaatgtcttcttcttacccctgtgggcacatcacccttgtggtgtgtatgcatactcatacacataaataaatgtaaacaattcaaaatacgcatataagaggaaaagcattgtaatactcgagaaggatgctacccagacaatcatcaaaggtagtcaactttgcagacatgacacttaagaggataaagtgggggctggaaagatgactcagtggttaagagcactgactgctcttccgaaggtcctgagttcaaatcctagcaaccacatggtggctcacaaccatccataataagatctgatgccctcttctggagtgtctgaagacagctacagtgtacttacatataataaataaataaatctaaaaaaaaaaaagaggataaagtggtaacgacacaacaatgctctccacacatttatcagctaggctttatcttgctagcttagaaacaggatttcattacagcgccattgcattttcatatactctcagcctcctccagccataccttgggctgtcaagaacacactgatcactaaagcatttgtcccacaaaggaactgtttctaagttttatttttatttctgttttttttttcctacctttcccccaataactaaatgccaggtcctgatttcaacttctttttgtggttgttctctttttttcctttatttttaaaaatatttctttccttttattggcccttcaagacagggtttctcttcatagctctggctgacctggacctcattctgtagaccaggctggccttgaattcaggggctacaattgccgctgcctcctgggattaaagattgtcttcatttatgttttgagacagggtcttctgtagctcagaccgacctcaaacttcatatgtagcttaggctgtccttgaacttctgatcaacaacaacagcaaaaatggtgacccaaagtatcatcagaaatggagataaacatcatgcttataaacttagaacttgggaggtgggggcaggaaatccagaagttcaaagtaatctttactacacagtaatgagttcaaagcaaacctaagtcacctgattttctgctttaagaaaactatggggggcgggcgtggagccggtgagatggcacggtggttaagagctgctcttccaagcaaccacatggtggctcacaaccatctataaaaggatctggtgccctcttctggcctgaggatgtatactcagcagagcactcagacattaaataaataaataaaattaaaaacaacaacaaaacaaaacaaagaaacaaaaaaaaacccaaagaaaaccatgaaatgcattaattaaaaacaaatatcagagcatggcatggtggcccacacttttaatcaggaagcagaggcagtcagatatctgtgagttcgaggccattcactctacgaagtgagctttgggacagccaacgctacacagaaactctgtcttgaaaaaccaaaccgaacaaacataaaaccccaaaccaaaaaccaaatttcatgtgtttaaggtgttttatctcaatggatttagtgtatatacaattgtgcaattttcttatttcctttgtttgtttgaggcaggattccaagtatcccttgctggccttgaacttgctatttagaataagatgactgaatttataatcccctgatctccacttaccagattttggaattacagttgtgtgcctatcacatctgagtcttgcagtgttggggaatcaaatctaaggctagctggcttgttttctttctttctttctttctttctttctttctttctttctttctttctttctttctttctttcttgtgactgtatgtccaagccttcttgttcacctgtgattgagtttactgtagagaaaagtaacagaaattgattggataaagaaaagagttggacacagaactaatgctccccaatgcctcagcagcccagccacgggtctgcaccgttcttttgcatcgagaaattaatctttcgagccatttccatgttgtagatcctctggtatgtttcatagctctcccgctggccacggcagcaaggcttctcttagtacagtcgtcgctttatgacttcagtacacccatcagtggtgagggttctgttcagggtcctgtaggcaccttccacattcccctcctgaaccatcaaagtcctggcaatgaatttcagatgtttagccatggctttgtatttaaatcttcattcttcagggcctggggcctccaaattcggactcccatctaaggctttcttgatgctaggcaatcattctaccaagttacctcctcagcctgaattctagaacattctcatcacccagaaagaaaacttctgctcattcctcagtcttcccttctgttcccttctcttctgtttccttctcttctgttcccttctcttctgttcccttctcttctcttctcttctcttctcttctcttctcttctcttctcttctcttctcttctcttctcttctcttctcttctcttctcttcttgccctgccctgccctgccctgccctgccctgccctcttccctccccacttccactcccctcctctcctctttccctctctttccattcatcttggacaactctggcttgtgtcaagttaacaaaactatacagtacaagcttcactttcttttaaatttttacacaagtatgtctgcttatgtagccatgttcacatataagttggtgtgtatttgtgagggaatatgtggaggccagaagtttacgtcaggcatcctcctggatggctccctatattctgaaacagagttgagctagtttagcttgtcagcttgccctgtggattccctgtctcgcctccagagcactgtgtttacagatgggccatcacacctaccaggcatttgcatgtatactggtgataaaatctctggtcctcatggtctgtgcgttctccactgaggcttttccaggtcccccggtttctttcttaatcaagtgtttctttctctgccagactgggaataacaatctcaaggctcccaacagaaaaatatgtagcctgagctacttgtggaaaggtgagcacattgtaggctatgccttcctaaaccctggaagtttaggcagaccatgcaatgatagtttgttttgtcttcccttttctctcttctgtctctgtctctttctttctctcctctccttcacaccctcctctttcccttctctctttctttgctctttagcccaggctggcccacattttctactagctcaggctagcctcaaacttaatctcttgcctcaggctcccaagtgttgggattatagctgtgagccaatgttaaaaattaatgatgtttttcaaaatggttgtttttcttaattttttgaaacaggggtttgggtgtgggaagccacatgtgccgttgcagagtggcgctggctactgctggccaccacgcataagtttggacaaacaaccaatgtgtacatatgcagtaaagctttttgccaagtcactgtctggcccgggcatgttaatgaggtactgagaatataaccaatcagatgtgagacatgcaaatgaggtatgttaatgaggttctgtgaggtactgagagagagtagccaatcagatgaggaacatgcaaatgaggcatagtgcataaccaatccgggtgtgagacacacctctcctaggcctatataagcagcaccagttctgggcttgcagcgtctttcttgctggtcgagtcgggcgcgtgcaagatttggggttcccactaggtatccctgactggcctggaattcactgtgtagaacagggtggccttgaactcacagaacttcaccttcctttgcctctttattgatgggatttaatcataatccaccaggcctgtccaccatggttgtttttattgttttctctcttaggaatcaaccctggggcctatacacatcacacatgcaggtaagcagtctactactgagttatacctctcgccccttcagtatgtttttgaaaccataataaatgttcatggctagagaaaaggaaataatatctcataatcttctttgaccccctactccagaggcaagagccaagcttggtggctcacaactataaatccagaatttcaaagccaaagtgaggaggattccaaatcagcctaggaaatactgcgcaatctagaacaaccctacaattacccagtgtcaaaaacaaaacaaaacaaaaactaacaaaagaattgataaacgggatcaaaggaaatcacaaagctctttacagcaggatttgttaagggaaaaataagtcgggtttcacatgcacagggagagcttggtaaagtgtgtgaccggtacaatttgtgcttgatgagaccccagggaggtgggagatccgcaaacaaaattacttagctattacatatcactccagtcagagcaaatatcaagaaagaaagatgaaatggcgaggacatggggaccaatatcctttacacatcacaggtaggagtgttaataagagactacactccaaatgttagcaacaagggtcttctaaagctaaaagtacaactaccatacgacccagctataccactgctaggtatgtacccacaggatcaaagtgggcatgcaataaagttacttgaacacttatgtttactgtggcacttatatttactgtgagttatttataataactcgtagaataaatggttataaaaaagatggtataaatacataattgagtctaattcagccataaagaagaaaaattaggttatttgttggaaaatgtatgaaaatggagatcgtgttgagcaaagtaagtcagactcagaaagaaaaaaaaatgtagccaagcatagtagtgaaggccttgaatctcagaattcaggaggctggagcagaaggtctcttttacatagtgagttcaaggccagcctaggctacatgggatcatttcctcttcatccctaaaacaaacaaacaaacaaataaacaaaaagacaaatctaagtccagcatggttctttatttttctaattctagcactctggaggctggggcatcagacttgattgcctccagagcttgagagctatcaatctaatttcataccagcctaagctacagaatgagactgcacaaatcaaaacgaacataggacacgcagaatctacattttaaaattgtatttaaagctcacacgtatatgatggggaaatagaaaggagatttttagggaagaggaaagggtctggcgagagagaggagaggacaaaagagggtgatgagagtgacaatatgatcaaagggcaggataaggttggctgtggtaactcatgcctgtaatcccaagacttgagagactgagacaggatggttgtcatgagttagaggccagaccaggcctgggatgtactataaggccctgtctcaaaatcactccccactagctctgcagtggtggcacatgcctttaatcccagcattcaggagccacagccaggagatctctgagttcgaggccagcctgttctacagagtgagttccaggacctccagggctacacagagaaaccctgtcttgaaaaacaaaacataaaacagacaaaacaaaacaaacaccagaaaaattgtcactaccaccctcttgaagcacataacagacatatgaaaatggatgatgaaatgcattattttataggatgaatatttggcaaatatataaagaaagaaagaaatgaactgaaacctcattgcggtaaaatggatcctatggccctatggcatctgcacatgcatgtggcactggcccatgtggtgacaaccagaaaacctagctatgaacgggcactaggagctgcagggctgtttttgtgcagagagacagtgtgaacacgtgcgcgcgcgtcagatgtgtgcaaggtgtgtgagaaactttaagtggatgtgtgcacgagtgtgtggaagcgtgtttaaaccgagtgtgcaaagaagccttttgtaaactcttaagaagaagcgcgccaggtgtggtgtgtgcggacactggggatgctgagccgtgaggacttgtggagcggacactgcgcgcgcacgttcggcgccccgggtgcgcctttcacagcagcccgaggggctgcgagccgggagcgcggagcccgtgcggtcccttggcgcgcgcacgcctgcgccggctgagcagtgacgcaccggcgagtgcgggagggtccggtgcggcgagcccgggcagagggaggccggcgcgcaaggtgggaggccgcgtgcgcatgcggacccgcgcggggccggtgcgacacagcgggcgggccagacagtgcgcctgtgcagcccgcgcatcccgatggagcgcagcggtgggaacggcggcggcggcggtggcggcggcggcggcggcggcgggtacggcggcagcggtggcggtggcggaggagccggagtcccctcggaaggggctgccaagggcttgtcgctgctgctggccaagtccgcggaagcggcctccgggagagcctcccagtccaccccgcggtccgcaggtaagggccggggagcactgggcaggccgcgctgaggacccccggggggggcggggcggccaagggctgtcgcccggtcgccctttccgggggcctaggtcaacctgccctgggggacttcaggctgcgtctctctttcggcaggtggcggggtcccctcgggcttggcgtgtttgcgtgggcgagtttgtggggggtggctggagagcggaggagcgggtatccttggccacggctgtccccgaggtatggctcggcaccggaggagggggttccgggatggcgaccctgtgggtgcgggggcccgctgaggtgtttggactacagggattgcggctggctcgctgcctcgctggctcccaccctccatcctaaggcgcgcagacggggaagccacagccagccaccaaggtggcccagctttgcggtttacttggcctctcggggttgggaaaataatgtcgcatcgcccgcgggggcagcgacggttcataaagggagcagggccacacgcgactgctgagacgacgacccctccccccccctgaagtcgctgaggtagtggtttccctactggggcgtctggcccctgccgctgccctttctggtacgtgactgcgtggcgattgagtgttctagcccacgggactgcagctgagagctgtcgccaaggggtgtggggatgtgggtccctgttccttctgcccaaggggacggaacatggtgaggacgctgggaagaacgtgataagcgcctgcgtcttctggttctggggctaaccttctgtgtacttgcaggtggtgcggaggtatacgcagtgaggaaaagcatttcattccaattttcctggcgacattttttttaaatgttaataatgagaactaattctatattccatctttcattgcagtttaacattcgaacgaaaagaaaaaaataaaccctcacacaatttgtagaatttgggaattatcgcatcgtggagtatttcctatatggtggagggggaaagaggaaggacatcaactgaacgggcgtgtgggttgtttatgtgtttcttcgttttgagacaggatctggctctttaccttacgttgatctggattcccgtgagccttcaagtcagcatgaccagcttgaagatgctgccttagtcacttgaacagttctttttgttgggatagaggggactatcttactgatctgtctgttgcatcattcatagaagggaaaggaaggctaaattgatttctagtttgtgttctcgtgtgttattaaatgcacaacttagtaagacattacaggatagtgataatacctgccctttaagtctagacttatattttcattccttttgcttgagaaaggccatatctgataagaacccagaacccacacatcggagtctgctctctgtggtaaaggggattccatgcagtaaaacattagatgttttttgagtttacatttttgtttggtggggatttgaaataatagattattttgatgtttcttgtggtagagaaagggctgtattgtcggatgtccagtttatctgggattttaattaacttgaaggaatttagggggcagttctttttcctattgctcagttgcaatgtggacactagttttattttggaattcctaaaataattctaggttttaaatatatagcctgttataaccatttagaggtcattcttaatagttgtgtgaaagaaaacggatttttttaaactttatttcaacagggatgggatggagacaggtttatgtgatgctatataacccatattgggcatgaattcatgttcccgtttcccatcaccagcatttctgactaaagttttgtttttcttctgtgtgtatacttgtgagttgcagtttcctgtggctgtgtggggatgagcttgtagagttcacaggttcaatttaggtctcattcctcaggcactttccatttggtttttttgaagctaagtctctgactggcttagaactcagggttttggtcatgctggcttgtcaaggagccccaaggacccaccttttccaggctccccagtgctagcttacaagcacattctaccatattgaactttttcatggggtctgcgatcgagcttagtacttgcatggcaaggactttactcactaagctttcttcccagtcccatgtttaatgttttaaagatttatttgttcatgtattttatgtatatgagtgctctgtcttctctcaccccagaagaggcatcagatcccattacagatggttgtgagccaccatgtggttgctgcgaattgaactctcgaagagcagtcagtgctcttaactgctgagctctttttggttttcgagacagggtttctgtgtagccccggctgccctggaactcactctgtagatcaggctagccttgaactcagatcttcctgcctctgcctgccatatgcagggattaaaggcgtgcaccctgaccacttagtctcattcttaatttctaacttgtgttttttagttagtgtacagaaaagcaggttccattatgacatttcatattcctgatcactctcccttgtcttcctcccacctcactggtcaccttcgcaaatatcccagttttcatgttctttacacgggtagttttgaatctaggttctacatatgagggaaacttgatagtcttcttccccctaaggagggattcttcactttctttcccccttttccttatccccatccccttccctttactttctatgtagcccaacttactatgtaacctaggctggccttgaattgagggggatacctattgctttagtcctctcagtgttgggattacaggcatgtatactacatatagctttctgaaggggggctggccttttttttttaagatttatttattttatatgtgtacactgtagctgtcttcagacacaccagaagagggtatctgatcccattacagatggttgtgagccaccatgtacttgctgggaattgcactcagtacctcgggaagagcagtcagtgctctcaaccactgagccatctctccagcccaaagaaaggggtgggggggggtctcgttttgttttgttgtgctttgttgtgttgtgtttttgtttttcgagacagggtttctctgtgaagccctggctgtcctggaactcactctagatcaggctggcctcgaactcagaaacctaccttgcctctgcttccgaagtgctgggattaaaggcatgtgccaccactgcccggcaggggtggggggatttcttaattatacttattgtagaaccatttaatgaatggctctgatactaaaattagttttaaggatgaggatatggctcagtgggtagagctagtacacttaagattacctacaggaaaaaatagaattttagttgttgcgctattcacaatagctaggatatggaaccagcttagatattcattaacagattagtggagttaggcatagtatatacctgtaatcttaggaggtagaggcaagaggtcagtagttcaaagccactctgagctatttaacaagaaaacctggactataagagactactctttctttaaaaatgaacaaaacaagaacataaactttgggtgaataaggagaacatacatacatacagtggcattttattcaactataaattaaaaatgaaattacattttcagaaaatgggtggagctggaaagcactatattaggtgaagtaacctaaactcagacaggtaccacattcctccaagattctgggcttagatttaaattttacatatgtgtatatgtgagtatgggtacaagtcataaaaggggaaaaacttaggaggagaagcagcagcaaagaaagcaatacaatagatgtgacatggaagcagaatgagtgctaatgagtggagggagctcaacaaaacagtgtaggagctagagagatggttcggaaattaggacatactgctcttgcgggggggggggggactggagtgctatacaatcgcctttaactacatctccaggaggtctgacaccctcttctggtgtctttgggtactacacttgtacacaaattcctacatataacagaattaaacgtgaaaataaaatattttaacctaccatcacacccaaactatgaaaatgccatatgaaatctattattttgtatactaattagaaaaattagtatttaatataagttactaaacagctatttttttaatcaaggttggtattgtaaaattagaacattgagtgtagattgcaggtgataccagcctttgtacttttgggactaatgatgagtccatatatttaatcctcacgccagtcttttttttcctgttttgaggcagtgtctcatatagcactggttggcctcacactttctgtatagggaagagtatctttgaacttatgattttcctgccttcacatgccaagttatgagattatagaaatatgccaccacaccttggtcatgtgttctggagatcaaatccagggattcatgcatgctaggcaggcattctaccaactgagccacatctcagcccctcaggaaagtcttaattgtttttggtagttaggatcaaatccaagactttaagcatgtatgcccatgttctataccaatttacattccccactccagataaatcttaagtcctgagctgttttttaacacattctcttgggtctggggatgttgttcagtttagtagagtggttacctagtatgcacaaagccttaatttcattactcagcactacaagtgatgataatccatcctagctgcttgaggtcgtcttatgtgggacccattcctaataagtcttcatttgtgcgccggccgtggtggcgcacgcctgtaatcccagcacttgggaggcagaggcaggcggatttctgagttcaaggccagcctggtctacagagcgagttccaggacagccaggactacagagaaaccatgtctcaaaaaaaaaaaaaagacttcatttgtattatttgaactactgttcctaaggatgcatggagtcctgtgggaactacaaaggcagaatagttggagatatttgaacttataaaatatactgtcatattggcatactggggatgcgagtgattaagtggttttcctaaggtgttgtaggacatggcaaggaaatagccttgggtgttccctcagcaacaagattttcaactattgaaatcctgtgcttgtttcacttacccaccagtgatgccttccttttagacatttcacttcttgggtccaattttaggtgggtctttcagtgccacctagtgcagaaggtggctggatgactgtcctacccttctttggggtgtgtatgcacagcaggtctgtaactaatgtttgccagctgttttctccaacaatctatgctagggtgaatgctcagtgattatgtgttagattataaaagtgatagagaaacttaaaatagtggaactacaagtcatgtggtctgatgtctgttgaggttttcctgtgcttctcaggtaattattgtcgagctgaattaaattatttgcttattcttagtaaaccaaaactcataaaaccaagtattctgaaatcgaagagtttattaatggtaagcaaaaggaaaggagtagctcggcgacaagttcccttaagcaataagcagcaagacatgtgggcagttgggaagatgtaaaaggcagagtgagctggagagaatggcgcagcagttaagagcacttgttgctctcacagaggactataattcagctcccagaacccatatcaggtggttcacaaccacctgtaagttcagctccaagggatccaatgccctcttctaatctctgaggagtgtacatacacacacaaagaagggtactttgtaaagaatatttgggaaaggtgcaagttatttaaattgagtctacattgattattgccaagaaaataattgcctccttattgactcagatttaagcaaggctgctatagcacattatactattacagtatattatttggttaatgttttaacgtgcatttaataatgtaaatttctttttccgatagtcttaaacttactatttagctgaaactggcctgtaactcggattctcctgcttctacctctcaagtgctgggagtatggcttgtgccatcatgtctggctatcagatttttttgaatactctatctttcctcctttatattcagagttccttttgtaattacatttaggatatctcagaatttaaaatataatgtcagaatattaaccccctccccctttaatagtgataacattgcttataggcaacacagtgtttcttgatgtcttctcacctgcatgtcttccctccccatccctggagtagaagacggcagggctgggggctacaaacaggaagttcagtaaagtccctagggagtcaaatagagtgggattgggtagtataggctgaaaagtatccccaaatcagttatgcatttgttttattttaaagagcttcttgattttttaaaatgacattattttctattatgtgtctattatgtgtgtaggtacgtacatgtgagagtgctggtgcctatggatgccagaagcgtcagatccccctgatgtcaatattaggaatagaactcaggtccttcgcaagagcagtgtggtctcttaaacgtctgagtcatctctctagccccagttcatcgtctttcaaagttgcatttatctgtttctattcacagtggtgagcattgaccacagggccttgtcagtgctaggtaagcactacacttcccagacttcaaagctgctttaaactcatggtggcacacattcaagagttaattagcactcgaggcagaggcaggctggcgagatggctcggaggctaagagcactgactgcttttctgaaggtcctgagttcaaatcccaccaaccacatggtggctcacaaccatctataacgggatctgacgccctcttctggagtgtctgaaaaacagctacagtgtacttacatataataaaataaataaatctttaaaaaaagaaaaaaaacttgaggttattgctgagtttagaaacatactctgacccttccctctaatcttttgtgaaaagagttgtgccataagaagaaataggagacgattaaaggtgactgggtattgtgggctgtgaagagagaaattgattgctgttgtctttgcatctaaggtggccataaccttgcaatgtgaggtctgttgtcttattaacagaggccatccctgatatggtctctgaattcctccacatctgcctcttaggtcagtctgatagcattttctattgggaagcatttttttttccttttgcctagaaacatgtccctgtcttaaaagccttgcgaaattcagactgcaattgaggctaaagaaaatgaatttatgagtgaataagaaactaaactaaagccacctcaccagccccagaatttgttttcttttgtttttattttctttcccctgctttcacagatatatgattcatcatgctcctctttcaaaagacctgtgcttctcacatctatccagatcttaaaatctagctcacattttaaaatatagatagccacatattacaaggactcttttctttcttcctttttttaagagaaaaaaaagacatcgtgtcttttcttcttctatttcttctcctcctccccctcccctcccctcctcctcctcctcctcctcctttttcttcttcttcttttcaagacagggtttctctgtagccctggctatcctggaactcactctgtagaccaggctggtcttgaactcagaaatctgcctgtctctgcctcccaagtgctgggactaaagaaaggcatgcaccaccactgcctggcttttgctggcttcttataaagattttttttgagatttttcattagtacagagatgtttttcctcaatgatgatgaggatcttattttttagaattatagcaaaaattatattactaaaatgcttagaggaagaaatttcaatttaacagaatttcctggtctgctaagaattaatccttatccatttcctgtgagctttgttgctgctgttgaggatctttgaagacaaccttagttggcttttttagccttagaaagctgagttccatcttagaaagctgaattcagtgtgactgagcattgaggcccctgttacacctctgagtcatcactgtaaaaggatcacagaaaattctctgatactggtgtatttcagaccaacttcagtaaagaacaccatttttgggtttttattttgttgttgctgttggtttttctttttgtttttgtttttctcgagatagagtttctctgtatagccctggctgtcctggaactcactctgtagaccaggcaggcctcgaactcagaaattctcctgcctctgcctcccgagtgctgggattaaaggcgtgcgccaccatgtccgactagcagccagttctgatgagcttattaggacagatgtttcaacacttgggactgttctcttggctagtagcattctaggttctgttctccttgtcctgtggtctaatgggatagagctggctttaggtatagagagtcttactggtaaaggccagttagccagaatttgcttcagggactgcaggaagtagtctctctgcctgagcagtatgtccctggagcagttggttgtttttcacctttagatctaagacttgagtgctagtttaattaacaagtatgatatgccaattggatagggatagaataacagagctgagaagttaatctagaggtcttttcatcatagaagataactagcattcatgtgttctgaggactagaatgtagataccaggagaactgtattattttggtaacatgtggctgactcgttttgtgttccagtgacagttctagttctagactgacctctgtcagtctttaattgtaagcattctggttgagatgggagaacaatccctccctgccacctcaagcaatgtgttctcattgtgctagtgatagctttactgtaacttagctctgttgctttacaaatatctaggtacttacatctttgccaaactaagcaatgcatcatgaggcacggtatataatttatatatatttaataaatgctgatttaataaatgccctgtggattccaaaagctcacttagaactgaagatggaaagggaaactcatgcttacatcctagctgcctcagatcctagatctaaagtaggtggagtttctcccccaataaaaataagacttgatcagagtcttgcctctagtttctacatgtttgtagtctttcccaagatagttgatctgtaagtgagtaatgctctagaaggagagttaggccttaaacacccaagggcactggttggaaatgacttgagtttgtatgtaaatgagaggaaaatgcagtcccagcaagaccccaggaacctccagattttacagcctttgtagagacacaggctttctgttattctctactccactcatgtagaaatatactcagtctcacttactgaggaaagatttgaaggtaagtaatgttttctagccctgaagaaatgtcatctgtgcagacttaaaacctgccttggaaacttgaagctgaaatgtttgagaaaggtgaagccagagtggaagtgatttcagatgaccctggactcaaggtagtggtggatgcaaatgtcttgacattagagaaacctagaggtgggctcaatagaagaaaggtgggattgcgcttcccttcggggatattctgatgcaagtaacagcttttctggtttactccctagtcatctttgctgggcacacacctggcttccttcccaagagctataaggttttagggccttagtggtatcttgccaggatgccaccgtgttgcttcagcttggtattatgttgatctctgtgatggagtgtgggtgggctccccatacacctctgtgtgtgtatgtgcgcgcgctcgctcacgtgagcacatgtgtgcttgatttttctgagtgtggtgaaggactttcttatctctcacaggaaactaatttcttctaccaaaacttggctgttttatatttggaacaaaaggaagttgatctttggaaaaaaagtattatcttaggataagaattactgtgacagacctatgccagacttacaggtttctgtttaaagataccctgacaatgccaccaactttagtgatttgaattgcatgggcaattcatagactaatctgaagcaagccagccatgccagaatagaggcaggctgtagccagttgtatgctcaatatatttatcagaaggtctcagataggctaaatggagctgtggctatgtgtttatgaagttcagatgacttcttggatgttcactgtgctgtatctgagctctagaggtcaaataactgcatttatgctcagaactctatctaaaatgtggggcaactctcttttctctctgttttctcagaccagagaggctgagactggtttccctttatgaactcaggtctggaaagattcatgaaggaatgtaggatgagtccttttaggtaattatttttttttacccctttccaagataggtctcagctagacatttgtggtagctggctggaagggtatatcccctcacatcctaagatgggaagttctctatattactacagttttctctttatttggtatgacctttgtgggtaggcagaaataagcacttggcattctttttttaaaattatatatatatatttatttttaaggcattttattagatattttattcatttacatttcaaatgctatccccaaggccccctataccctccccccactcattcctgtttcctggccctggtgttcccctgtactggggcatatgatcttcgccataccaagggcctctcctccaattgatggccgactaggtcatcttctgctacatatgcaactagagacacgagctctgggggtaatggttagttcatattgttgttccacctatagggttgcagactccttcagctccttgggtactttctctagctcctccattgagggccctgtgttccatccaatagatgactgtgagcatccacttctgtatttgacaggcactggcatagcctcacaagagacagctatatcaggatcctgtcagcaaaatcttgctggcatatgcaatagcatttggcattctttttgacaaattttcacaaacatcatctatgacagacccttgtttgagctacaccttttccagttagttaattttctgttacatgattttgagtttgtgtgttatttagtgtttctttgctgaaatattatgaccaaaagcaagtttggggtggtgtggagtggggtgaaagggtttatttatacttatacttccatattatagcccattactgaaggaagtcatcacagaaactcaagcagggctgcagcctggaggcaggagccgatgcagaggatatggaggtgtgctgctttctggtttgctcttcatggcttgcttagcctgctttcttatggaacccaggagctcagcttaggaatggtacctcccacaatgggctgaaccctctcatatcaatcaccaattaagtaaataccatcgagaccaatattgtggaggcattttctcaattgaggttccaagttgacataaaactagctggaaaattgatgccttgccaatttgacacacaaaacgcattactgttaagccataatctttcctttctcatcatccccatgattacacattaatatcaataataaaatacaagcattcaaaactttagaagtcccacagtctttaaaaattcagcctctttaaaatagccagtctctttcaaaatccaaagtcttaaaatttagtctttcggggctggtgagatggctcaatgggtaagagcacccgactgctcttccgaaggtccggagttcaaatcccagcaaccacatggtggctcacaaccatctgtaacaagatctgactccctcttctggagtgtctgaagacagctacagttgtacttagatataataaataaataaatctttaaaaaaaatttagtctttcaactgtgagagtgtgtaaaataaagtaaattatataagttctcccttgaggggggaagaaccagggcacactcaatctgaacaaagcaaactcgaaccagtataaataacttaatgagcaatgtctggaaagtcactcatggtcttttggactctaccaaagggcttgggtcacttctctggctctatcctctgcaggacactgaagtctaagctcccactggctccactgtcacactcctctgtctgtgaaatgagttccttggtcagaagcaatattgtgtggaataccatgatggtggatatggctttatgtaatatatccttgaggttaaactgtaaaagtatactgctggccttgttaactgaaagcaaattctttctggtggtccttattgataagtacttagaaaaatgcatttgctagatcagtagctgcatattaggtgccaagggatgtgttaatctgctcaagtaagccttttgtacatcagctgcaattggagtcactatttgattgagttttcaatagtcaactgtcattctccacaatctatctgtcttctgaactggccagatagggagttaaagggagaagtggtgggaaccaccacgcctgtgtctttcaagtccttggtggtggcactcattttctgcaattcttccaggaatgtgatacaattttttattcactattttccttggcagaagcaactctaaagggttccatttaaccttttcaaccataattgttctcacaccacagatcagggacacagtgtcagaattctgccaacttctaagtataccacatatgccgggactacaaaataaccacaggatgagttcagggacccactggacctactgtgagttggactttagccctaacccctgacctcaataagcccctaatttaactggagggtaccataatatttcttgggatcttccagaatcagcattatttcagaaccatttcccaatagaccccagaaattctgactgttacctttcctccagtgtacagttactcttgtaaaaggccataagtacctctgagaaaggactggggaaaggctatcagtaaaactttcagtgttttatcaatctccttcttaggggaacctggccatcccttcaaaccttccccatcagtcactagtataaaaaatgccctgcagtctgatcttatggagtcatttcctcaattgaggtcccctcctttcagataactctagcttgtgtcaagttgacataaaactagccagcatagtttaatattcattcctgtcacttagcctccctgcccttatttgcactaactgcttacaatgtagcttttaacttttcttaattaaacatctatgacttaattccttaatccagttttgattacaggcttgattactgatgtcggtttcttggcccttttgttttatattgtttaccacttctattttaatttattttaaaatttttatagattgtgtatttgcttttattttttaagacaaggactcactttgtagaccaagcttttctctgaactaaacttaccttgaactcatgttgagcctcctgcttcagcctgaaattacagatgtgctttgccatgtctggcagtcaacctctccattttggaggcaatactagggattgaacttccagagcctctcacatgttaggtcaattctaaaaagcctttaatttttttctttatttcgtccttaaccaagttatcattgagtatcgtgttgttcagctttcatgtgtatgtgtgctatctcctgtttttgttggtgtttaagatcagccttacaaaagacactgtcaataagacaaaaaggccaccaacagattgggaaaggtttttttttaccaatcctaaatctgataggggactaatatccaatatatacaaagagctcaagaagctggactccagaaattcaacaaataaccccattaaaaaatgaggtacagagctaaacaaagaattctcaactgaggaatactgattggctgagaatcatctgaaaaaatgttcaacatccttaatcatcagggaaatgcaaatcaaaacaaccctgagataccacctcacacaagtcagaatggctaagttcaaaaattcaggcgacagcagatgctggcaaggatgtggagaaagaggaacactcctccattgctggtgggattgcaagcttgtacaaccactctggaagtcagtctggaggttcctcagaaaattggacatagtactactggaggataccgcaatacctctcctgggcatatatccagaagatgtcccaaccggtaataagaacacatgctccactatgttcatagcagccttatttataatagccagaagctggaaagaacctagatgtcccttaacagaagaatggatacagaaaatgtggtacatttatataatggagtactactcagctattaaaaacaatgaatttatgaaattcttaggcaaatggatggatctagaggatatcatcctagtgaggtaacccaatcacaaaagaagtcattagatatgcactcacgccgggcgtggtggcgcacgcctttaatcccagcacttgggaggcagaggcaggtggatttctgagttcgaggccagcctggtctacaaagtgagctccaggacagccagggctatacagagaaaccctgtctcgaaaaaaacaaacaaacaaacaaaaaaaacaaacaaacaaaaagatatgcactcactgataagtggatattagcccagaaacttagcccaagatacaatttgcaaaacaagaaaatcaagaagagggaagaccaacgggtggatacttcattcctccttagaatagagaacaaaatacccatgaaaggagttacagagacaaagtttggagctaagacgaaaggatggactatccagagactaccccacccagggatccatcccataatcagccaccaaacccagacactattgcatatgccagcaagattttgctgaagggaccctgttatagctgtctcgtatgaggctatgccagtgcctggcaaatacagaagtggatgctcacagtcatctataagatggaagggtccccaatggagaagctagagaaagtacccaaggagcttaaggggtctgcaaccctataggtggaacaacaatattaactaacaatattaacttcctaggttttctaactccagggttgtctccctttgtgatttctctactgtctctagttccatttttagatcttgggtggttttgttcatttcctttgcctgtttgattgtgtttttcaataattctttaagggatttttgtgtttcctctttaagggcttctagctgtttacctgtgttctcctgtatttctttaagggagtcatttatgtccttcttagagtcatctatcatcatcatgagaagtgattttagatccgagtcttatttttctggtgtgatggtgtatccaggacttgctatagtgggagaattgggttctaatgatgccaagtaacttggtttctgttgcttatgttcttacgctggcctcctgccatctggttatctctagtgctaccagcccttgctatatctgactggagcctgtccttcctgtgatccttgttgtgtcagaactcctcagagttcatctgtctgtgggatcctgtgattctgggatcctttgatcctgagatcctgagtgtgtcagagctcctgggagtcaagctgcctctgggaccctgagatcctggtatgaccaagctcctgcgatcctgtgatcctgtgtgtgttagagtacctgggagtggatcttcatctgggtgttgtgggactggctgcagagtttgagcccaaggtctgctcagggcaccggcccagactggaaggaactcgtgccactggtcaggttgagttcctgggttcctgggtcctgctggtcccagttacttccggtgttggtgtcgatgttgtgttctcttcacatctgattctgtgatcctgagtgtgttagagctcctgggagtagagctttctcttggttttgtggggaagtttctgggaagatgtgaaattaagctatgggagtttgaaaaaagatacacggtgagctaaggttatcttaagtatataaaatctctcgttagtaatcattcctaagttttgcctagatcagccttaggcagttattttcttttgctctgataaaacaccatgaccaagacagtttataaaagaaatcctttcattggacttacaattccagtggattagagtctatgatggtgaagggaatgcattgtggcaggaacagccaagagctcatctctcaaactgaactgcaaggaggaagttgaaggtgcaatagggatggcatgggcttttgaaaacttcaaaattcaccccactgatacaccccctctaacaagaccaccccatctaatccttcccaactagttccaccaactggaggttaagtatgcaaacataagagcctaaagggaccattctcattcaaattaccacaggcagataagaggaagtttagaaaagaaagcctgtgcatctgttacttacaatgtagataataggaaatttcttttacagaaggatgtattttcggctatttctgtctgtggttcctataagtaatcactttaagctaaagaacatgggcatgttggtacatacctccagtcatagcacttggtacgtacctctaatcatggcactcatgaggttggggcaggagtattgctatgattccttccagggccagcctagggcacttcgtcagttagaagccagcttggaatacagagtgagagcttgcctaaaaacaaacaaacaaacaaacacaaaagaagggctggagagatggcacagcagttaagatcattcacttctctttcagagaatccaggtttgcttagcattcacttggtagctttaaaagtttgtaactctaaaatttaggggatcccatgctctctgctggcctgtagggcactgtacactcatactgcacacacatatatctaacaaaatactcatctacataatagttaaataaatacataatacatattggagaactatcttttgggttgacctattcttggatcttatcaaatgtgggttcttacatgtaagaattttaatttgaaattccttttacagtgataatatatgtaatacaaactatcattttatcattgtaagggcacacagttcagtggcattaagtatatttaccatgctgtctcaccatcagtactgtttgcagaatatttttaacattgtcaatgaaagctctgtaatgaataggttcaacagtaacaccccatttccttctctatcttctgtttctatgcatttgcctattatagataacttatagcagtggagttacataaaatttaccctttggtgattgatttcacttagcataatgtcttcataattcaatgatgtcatagcatgtgtcagacgttacttctttttaaggctgaataattcattctttggataacatacatgttgtttatccacttatcaatggactcttgagttgtttcccttttctgctatcatgaataatgctgctatgacataggaatgaaaatatctgaatttctgatttcagttctgggtatgtaccaacaagtagaattcctgggtcatatagtaattctctatagtttggcactatatatagctgaaaattattgtattcactgatttgtagcttcttaggacttccaggagagagaatcttgatggtagcttggctatcaggagttattcaagattagtacaaaaagttatttatatcagagatttaaaatcattatcaagcccaccatgaggcttttagacctgaagttttaagtggctcccttgctacttgacacattttcagccactcttgaggctttcttttatggaacaggaagttgcaaggaacaccacaaatgggtcagattctccagcagtgctctggatgcctggctcctagagtagactctccttcatgtggtgtttgtttttctctacgaccttccttgcctccagactacttcttttccatatttatttcatgtgtatgcatgtttgcatgcatgtgtgtgtgtgtgtgtgtgtgtgtgtgtgtgtgtacatgtgcatgtgcatgtatgtgtgtattttgaagaattgagcccagagacttgtgcttttccaggttgaccctttaccactaggccacattacacccctatcccattctctgattcagatcccaaattctgcagctaattgttttttttttttttttttttttttttttttggttttttgagacagggtttctctgtatagccctggctggcctggaactcactttgtagaccaggctggccttgaactcagaatccacctgcctctgcctctcaagtgcaccaccacgcccggcttaattgtattttcaaacatgaagcaatttatttaaaatagataaatatcttaaatacttggttttctgatttagtgttctgtgttggataaagaataagccttaattttgtttttgttaatgtgtcccatttataccttccccatgttctcatcttatagttgtggctttaatgttttatgttgagtattattattttttttcatagtttgtcctttcttctttttatctgtggtggggtggtactaaatgcagtcttttatgaagggtgctttggcgctcactgtgtagactaggtcagcttcagactagtagcgatcttcctttatctgcctcctgagtactaggattgcatgtgtgagcctcatacttagattctgtcttttgttttttgctggagttagaacccaagaccttgcacaatttaggcaagcattctaccattgagctatatagtacataggccccctcccttccccctctctctttctttcttgacattgcaaaatcacccatttaaagtatacaatgttttagcatattcaaagttctataaacactgccataataaattctacaacatttcatgatccctgaaagaaaatctgcactcatcaacagtatttccctatttcccctcaatcctcaaccctatacaacctaccactagtcttccctgtcttgatatatttttacatgctcccttcccctcatatcccttcttctttcacttttctcacatgacattagcttgttaactgaatccttgagtaattcccaaattgaatgaattgttgagagaagcaaatacaagaattcagcacccccaacccccagcatagggacacctttaatcccagtactaatgaggcagacagaacactgattttgaggtcagcctggtctacatagtgagttgcagctcaaccagatttacctggtaagaccctatctatatacacacacacacacacacacacacacacacacacacacacttcagcccccccccccaaagtaatgatggatacatagcacagttgagcactgtgctgtccttgtaagtcaccttctttcattcggccactgtgaatctggattttcactggctggtctgtaaggataacagagataggtctatgaaagtggagccaaaagttgatctcgtattgatctatgatatggtctggaagtggtgaactaagacttcatgtgagtgagtgagtgagtgagtgaattctgggacagaatttttgtgtcagttgtggtagtgcacacctgtaatcccagcactccggcacacttgtaattctagcacttcggagatacaaacaggaggaacaatgttagtctcagctatatagggtgtttcaggctagccttggctatgtaagaccctatctcagaacacaaaaaacaaatttaaaaaattttaaaaactataaatgcattaaaaactaatatttaaaacttttacaaaatgctgcattgattataaacataaacatagaaaggtttagttatgcttgggttcttgctgagaatttcggacaagggaatttcttgtgggtaaatcagaatattttgttatttcttatatttttgcttgtgagcctaacatttaatggctgagccatctctccagcccttgtcatttcttattggtcactgttccctattaaggcaaaccactttgctcaaaacaaataatcttgaagaaagaggattatcagggtcttagtaatgagtctgctaattgcttggtgtttaaaaaaaaagagcagtgtgtgttcctgatcatgatacatgcacatacatgcttctacatgcacatacatgcatgtacatgcacacacatattctattatatctccttattgctgggaatacagcaagtatgagcaggtctttgctgtggaattttcagagacacaggataggaaaaaaaaaacagtgtacgcttaaactaagatctgtcctgccatttagtgtacgcttagactaagatctgtcctgccattttttttttttaattcatgagtaagttttggttgggggaaatagactaaactgttgttctgagagcaactttgaagtgtgtgatgtgtgtgtgtgtgtgttttatgtatgtttctatatttgtcacggaggggtgcataaacttgtgtatatttggaggtaaatgtccaatattaaatcatttcattctctgctttatatttgagccagggaaccccattgaacttggagctcactgattgtgctagactgactggacagcaagcccccataatcctgtgtgtctccctgatgcttggattacaggcagcccctgctttctgtgtgggtgcagggggtcagaactcaggtcctcaggcttctccggcaagcactttactaacggagctgtctacacaataccttgttttatttcttaagacagaaaattgtcagactcctgctgatagaagctcatctgtttagctagggaagccctcgagactcacagagctggctaaagtgggtcacagaggacctgaagatggttactcgcacttttttttagacaaatgttggccaggagcagaaatcaggtattaggtaccttccgagtctacagccttttaatatttgctcagtgttaatctatgataaaaaataagtcagggcttgtatcccataaggaaaatggaattaggacactgtttatcttgtttatgatagaaatctatacacttgctgtgttgtccatgttcactcatatagtatcatttgcctgtttttttttcatatgtgtgtgattacttcccaacaggagtagagtctgaattcttatgggtaaataatagacacatagaaaaaagcctgtaatgatcagaagctcagagggtatggaagcatgaggtctgtgtggctaccatataataaagaaagctggggtgaacagacttcagtgttcagttaccagtttaccttagggagccctactctaagctgtgtagacttcatgtaagtagcaggtcatactgtgaatagagtacatgatctatattagcttcctttgaaattgtatatattgatattttatttatttataaacataggaactctgcttctttttttgtaaattagaaatattttctttttggggggggctggtgagatggctcagtgggtaagagcacccgactgctcttccgaaggtccgaagttcaaatcccagcaaccacatggtggctcacaaccacccgtaatgagatctgatgccctcttcaggtgcgtctgaagacagctacagtgtacttgcatataattaataaaaaaaaaaactagaaatattttcttttttaatatttttattaggtattttcctcatttacatttccagtgctatcccaaaagtcccccataccctcccccccactcccctacctacccactccccctttttggccctggcgttcccctgtactggggcatataaagtttgcaagtccagtgggcctctctttccactgatggccgactaggccatcttttgatacatatgcagctagagtcaagagctccggggtactggctagttcataatgttgttccacctatagggctgcagatctctttagctccttgggtactttctctagctcctccattgggggccctgtgttccatccaatagctgactgtgagcatccacttctgtgtttgctaggccccggcattgtctcacaagagacagctatatctgggtcctttcagcaaaatcttgctagtgtatgcaatggtgtcagtgtttggaagctgattatgggatggatccccggatatggcagtctctagatggtctatcctttcatctcagctccaaactttgtctctataactccttccatgggtgttttgttcccaattctaagaaggggcaaagtgtccacactttggtcttcgttattcttgagtttcatgcgtttagcaaattgtatcttatatcttgggtatcctaagtttctgggctaatatccacttatcagtgagtacatattgtgtgagttcctttgtgattaggttacctcactcgggatgatgacctccaggtccatccatttggctaggaatttcataaattcattctttttaatagctgagtagtactccattgtgtaaatgtaccacattttctgtattcattcctctgttgagggggaactctgcttctttaatgaggagccagggtaggagttatgcttttgcatcatgctgtgcagtagataaccagttgagtttcattttcttctatcttttgtcatttttaagctatctttgagtatattaatattatttttctgagtgatattaattagaatgcaaacagcattttatttttgtatgaattatacatgtatctgattaagctctgattttaatactgaaggattatttattgctatcctcatagggacaaaaacaagagagaccctatatcaacaaattaattggttttaatatgtatttcatgtgtgtgtgtatgcatatacacttgctcacacacattgcacagtaaatgtgtaaaagtttagaggacagctttgagatgtcagttgtcttcgaccttgttgatgtagggtctctcttgtttttgcttctggcctgcatactccaggttagctggccccgtgaacttctgggcaactctcctttctctgcctctcacttagtatagcaatgctaggattagagatgcaaaccatacattctggttttatatatgagctcatatctataattccagcactctagaggtagaggcacagtgatcatcagaagttaaggttatcataacaggtacagagtctaaagccagtttatgctaaaggaagagaaagaaacgtgaaacttcttagttgttcttcataacatttcccttccccttcattccttcttttatggctctagctagtcaaactgcatcctttggagctttaatcttttgcttcatcatagttattactaagtttttgagacaggatctcactatctagaccaggctggcctctaactaacagaaatccacttgtctttgtctcccaagtgctgggattaaaggtgtatatcaccatgcttggggctattattattattattattattattattattataatattccaattttgctactataatgaagcaccaggtacaggctactttttgaataaagtgatttttggctcatgtttatggaggcaaataatcaagaagcctcacatagtaataatcttgctggtaggattccaagttggcaaagaacttgacagagcatcatccacaatgggctgggtcctcttccatcaattaccaattaagaaaatgccctataagattccctgcagctccattttgtggagtgtggaggctttttttttttttttttttttttttttttttttttttttgagacacggtttctctgtgcagccctggctgtcctggaacttactctgtagaccaggttggtctcgaactcagaaatccgcctgcctctacctcccgagtgctgggcttaaaggcgtgcgctaccacgcccagctggaggcattttcttacctagcttgtgtcaagttagcattaaactatccagcccagttcctcaggtgattctactatgtctctaaagctgggaagcagtgatctgtttccagtgtgtttaaaagagagttgtagtacaaactagatccactgttaaatctgtgcccgtgtagctactgagccagagattgactattcatgaaaggatatgggagactccccacagaaagtgggcgctttcattgaatttcttatataagctctttattcttgtcccccagacactgaagtttcatcataaagtttcaacctcattacttagtataattgagggtgttttaaaatatacttgttcagagccggatgtggtaattaatatacatcctataatccctgaaacctagaaggctgaagtaggaggaatgccatgatttttgattgagaccagtctgggctacattgtagaatgatcctttctcaaaaagccaaaataaacaataaaataaaattcacttgttcagttaagttttaaaacagatggcttcccttagaaaatttgaatttcagtaatagttcttaacagtatccatgaataattgactaatattaattcattaatattctagtagagtgcttcaggctaataaaattcatttaaaagtgaggttttgctgcagctcaagggtaatgggaagctattcccaccaacagtaaattagtgaagggtggggttagcctggtggttgcttgctcagtatcactggtttttaatttttgtattgacaaattgtatttcagaggcatacatttatctgaatgtacttgccttggcaagtgttgctacatctagaatgggaacaggggtatttccaaaacattcttttttgtttagctctatcccagggcttcatacttgagccagatttgttttcttcatagtttaaatgtctttgttttgaggttgttgttgatttacatgcagttatggaaaatctcatacagagagatctccaaattataatgcaatgccacaacaaatgtgtttatattaatgtagtcaacattgaggctccctctatcaccacaaggacccctttcttgatgcccattatagctttctacttcctattcccctgcctccacaatcactggtaagcacagttctgtcggccacccgatcttacggaggcttacaggataaggttatgtgtctaggttttgataaagagaaaataaaggtccacatgtaaagcacaatagaataaaggatggttatataggaaaacaaaccttagaattttaggtgacacagaaagactttctttggagttaaatccttgagtgtattatttctttagaaagcgtttcctgcattggtggttgtgataatctcacatgattcctctgtcttaaatttagctgttttgttgtgggtagtatctgatcaagtccgtggacatttcatttattttccaactctttttacattgagatgagcccaaaggtctcttgttagcctctggaagtttgtcagtagtcaaaaggtaaaagctggagataagttgtttagcttttctttaaatagaaagttcttgaaacgtttagaccattaaataggagagacatatatgctgtgaggaggaagagggaggaggaagagggaggaggaagagggaggggttgggaccttagctttcttagccagtgttatagttaatgttctattaatgtgaagagacatcatgaccaaggcaactcgtataaaacaaaccatttagttgggaaacttgcttacagtttcagaggcttagtgcatgatcatcatggtgggaagcagtcagacttggcactggagcagtggcagagagctttacatcctgtcttcacagttggcaaagggggtggaaaggaagagggaagggacctttgaaacttcaaagcccacttacagttgcaaaccacctccaacaaggccacatcttctaattcttcccaaacagttccactaacctgaaccaagtattcaaatatatgagcctatgggggcccctcacttgtcactcaaaccaccgtacccagtaaaacttcaatcctgattgaactcacatactgatttttttcatctgacccagagtaactaaacttgaggggaaagagtcacaggaatgacctttcaggcttctccaccatttctatgcagtagaatagcaatccaatgtgtgctatgtgacctaggaactgaacttctacttgtttgtctttgtgtagttcatggctgccaaatggatagcacagagattccaccttacccatgttaggctgttttgctttgctttgctttgttttgctttttattagtgcagcaaagctgaattgcttgcttaagccatgaggaacctaagttgagtcttacagctttcacccattctccagccagcatcagtctctaagatagcatggagtaaatatttccaaaccatcagtctgagagaagaataatgagctgaagggatacttgctgcatctatgcacagctgtgcccatacttggctctcaatactgcctatttcatacttctctgtcagacttgtacttcttttccagactttcaggctcatgggatcaggatatgatttgttagtctgctgaatcaaagcaccaaagaaggtgctacatttcctttgaaaaactggtcattgaaagtgagagtgttcgagtcaagttcccaggttaaatagaatccagtttgcctacttttaaccatgtgacctgggacaaattaattaacctttttgtactcctgtttctacacttgtaagatgtcatcatagggtggttgaggccaataaattcatatagtgtactttgttcatagtggtgtgtgtgtgtgtgtgtgtgtgtgtgtgtgcatgcgcgtgtgtaaaacgtagcatggatttcaggcttgccttaaactagccctataattgaaaatgaccttcctgccttcacttctcaaggactgagattaaaggcatgtgctatcaccacgcgtggctgcagttggtccatagtaactgcttgtttgttacttctgttatgatgaagctgctgctgaccatgtccctgatcataaggagtttctagaagggaaacttgtgtcttacatgtgcccacaagagggcagcctgagaccttgcatgtccatggaacagccttctggggcagctttttgaccatttctttttccttccagtttttctttgtctagttaaagagcattttgatcattcccctgacttgcctcatatgtaaagcaggtttcttatcatcaagacagaggctcaggtcgagagtaggtacattggctgcatgtgactaggcctcccaggctttttatttttttaaaagcttttcagacagaacaaattattccgagtggaacttaagatagagactaaaacctaaattaagaaaagaccttatgttttcttcttattcctctatcaatttcagcactatgtgtgtgtgtgtgtgtgttgtgttgtacaccctgtgtaagaggtagtagttggacctaggcaaacctagggcagtcccagttatatatcactttagaggctgccagggagaggaagttacttttctgtacaggaaagaaggatgaagtaagggcttcacaagtggtatgggagcatggagtatcatggatcttggagcctagaaggtggacgaggttaaaaagatggcagtgttggtgttggtggaacgaggggcaggcaatgtaaactagaagatattagtggaggggagaagtggtgaggtcaaattagataaggagttgaagtcacattgttgacggtttggaatgagttggagttggatctttaaatccatgatgacattcattttgttggcagtatcataattaagaactgactaaaactaaacatgaattatgtcagtttgtagtcaaggactgaattattcttgtaattgtccctccaagggacaattagcacttatttatttaatcttgaatttagaaagttttttagggacatgaaaggagtggggtatggatatggagatgcagggatatttcttagacatttggggggataggtattattcatttcatcttaactgttacagacatttgcatgctgtgtacatagaagtatatttattttttgaaattctgagatactaagattgacatcaaagcaaatttgtcagaactaaaattaaatttgagggatacattttgcagtggtctaaagtacttatatgtatttgccacagttgacttatttcagaacatgaaatctttttcaactgtataatatttgatatccaaaatcatattcaccttgtggcttttgctctcccctaaactattctgccatggaccttcaagccagattagaataggactaatgagtgtctctgcatacagctaggtttctgtgtcacttaattgcatttctgacccctccaggtcaggccttgggacaaagattagctaaaggactcttgtcagcaccactacaccacacgttggaaagcacaggtggaagccatgactgctgcccttgaattgttggggctggctgagaatgtatgataggaagtgagttccttgaaatgaataggtgacaatggataatgtgtatgtatgtccagacgaagagggacatgtacccaaccatctctagcactcagtagataaagaagaataaaaaaactgaaaattatgttttctatctcacaggaatggatggatttttaaaatcagatgagagacaaagattagccaaagagagacgagaagaaagagaaaaatgtctgggtaagttgtatactttggctattgaagttcacaaaagtagaaaagtagaaatgaggtaatttctaaaggtctttagaaatctgtgaatgactggaaagagaactaagactggtagacgagtctagaggcttgagtgtgaactcacacagtaacttgcatgataacaaaagctggaattaataaaccattcactcacaaaatattgaccctccactatatcctaggcaggatgcttggagctatggacaacaattgctgccactgagggggcgggggtggagagatggttccattgttgttgttgtgttgttttgttttgttttgtttgtttttccagacagggtttctctgtgtagccctggctgttctggaactcactctatagaccaggctggcctcgaactcagaaatccgcctgcctctgcctcccaagtgctgggattaaaggcatgtaccaccactaccctgccgtttccattgttaagaatactaactgccctgtgctcagtccaatggacggctgtgagcatccacttctgtatctgccaggagcacagggtccccaatgaaggagctagagaaaggacccaaggagctaaaggggtttgcagccccataggaggaacaacaatatgaactaatcactacccccagagctccctgggactaaaccaccaaccaaagaaaacacaagcatatgtagcaaaggatggcctagtcagtcagggaggagaggcccttagtcctgtgaaggttttatgccccagtgtaggggaatgccagggccaggaagcaggagtgggtgggttggtaagcagggggaggggaggagggagagggggttttcagagggaaaactaggaaaggggttaacatttgaatgtaaagaaaatatctaataaaaataaaatacaatataatagaaaaataaaagaagaagaagaaaaaaatactgactgcctttagagaacacagatttgattcccagagcacacatatcagctcacaactgtctgtaactctagtcccatggaatccagtgccctcttctggtgtccttaggcattgcacatacatggtacacatacacacatgcagacaaaacacatacaaataaataaaacaaaacagtttcttcctctgtcttaggaagactcggtgtccttaggtatccactatgtgcactcaccttctccttggagatctagaagggccatcctcaagagaaatgagaaaatgggcacgcattttctgcattacagcagtatgcccagtgaggaagtcttttattttttaacctcttgttagttatagataccaccatggagttctgtgagttaggtagatgataatttccttcattgaactgagatgaataagaagctgttggattcttgtttggccttctggacagttcaggcactatgaccccccagagagcctttccttagcctggctaggtagaggtaaagatttcttagtaagtggcttgatgcaaagacaagactttgtacatcttaatgctttgctcagatcactgtgcatgctcatttaacacgattttgattgaatgcaccctaaactatcatcattctagccactctatgaattacctattgtatacaagtttggcttaattatagcaataatagtcataatacctatgtgtggaagtactttttgtgttttacatgcattgcataattttcttcactatattattactgccactgtataactgagaaggaagccaagacagagcgataacatagttattaacatgccccataccacttaacaaatggcagagaagagagaacacccaatctcagtcactgcatcctgggatttcatcaggttattgtttctgtgttcttggtcttaatccaacttgcatgaggagcagttggagtgacactgcttccatttctcagctgctcgggaacaacagatcttagagaaacagaagagagccaagcttcagtatgagaaacaaattgaggagcgatggagaaaacttgaggagcagcgccaacgggaggatcagaagagggcagcagtggaagagaagaggaagcagaagctccgggaagaagaggtaagtagggtctcgggagccttccaccccagccagctcagtaactcacatagggccaacgtgttgagggcatctggtgtactacccaagtgtcaactgtgagagagacctgcctccaaatcttgtcctggtgacatagtgcgccttctttcagcactgtaatacaatgagtttgaggaagtagcacttgcagaggagcaaagaggttttgccatttcattccagtttgttgtacaacccagggcaaaatgcttgccttctcttggctctggtttgcttgtctctgctgtgagcagttggatttcctggtttccaaggcgtctttcaactacaaccttttctgatgaaattaagagacacggcgggcttgtggcttggattttgggtgatagaaaactaagtattatgccaggaggaggcccatgcttctggaacagatcaaggccaaagcatataataagatgatcctgttatttactgctagaaaattctgtttgaatacaaagatgctagtgcatttaaattttaatgtagctactcgcattaatcatcctttccagttacctttcaaaacagaaatggaatgcaattatctgcatggagtccgttattactaagctctgggagtatatttaggaagcatatttgaattatagattttcttaacaagtgtattttaaggatgtaatcgtactcttgtatattcataaggtataatgactcatcttttagtatgaatatagcagtttgtcaatttccaacactataaaatacagagacttttatataaatttagtgtttttaaagtgtttttaaagtctctgaatgcttactactatatatatttacttttgtttttataataaaataacatattataagataaaacaaaaattaacaataagatttggacaagacaagcaaacagaaggaaaaaagatcccaagaaaagttttttagaaaatcagagatccactcattcccacagtcaagaattccatataaaacagtaaactggatgccacatggtatgtgcagaggacctggtgtagacctttgtagggcctgcccatgctgttccagtctctgtgagttcatatgaattttaatcatgttgatgtagagggccttgttttttttggtgtagtcctccatcctctctgcctctcacactttctgcttccccttctatggggttccctaagatcagaaggggaggcggtttgatagaggcacctcattcaggtatctcactctgactaatgtctgcctgtgggtttctgtttcttcctgtctactacaggaggaagcatctctgatgagtgggaaactaatctatgaatagaggagagtgtcaccaagagcaatggtttttgctacatttttttttgttcttttgaacagtattatttggttttctcctaaatccctaaattatctagtctcaggttcttggtcaccaaaacacccattttagaacaaaagatttgtggctggcttggtgtttatgtttcttttttggtagcataccaagtaccttactgtcttgaccttgcagcgggagagtggggaatgactctttttaggtactagcttgacttctccatgttaagtgttttatgtaggtgttgttttcagctgtcagtttgctgtcagtttgtggagagcaacctatagtcttggcaacaacttgagttgcttcaggattcccatgagacctgtttggccagcagctagataaaatgtaacataatgccattatttgaactttatttagtgataagagatggccagtcagtactctgtctaatccattatttagttatttcatttaaaaagccttcattcacacacacacacacacacacacacacacacacacacacacatatggaagcttctattgtattagtttaagctgtctttccccatattccctcccatcttcctcttcccctatttgatcccctcattccagccaaaccatcatctttccataactatctgttctattctacattactaaggagatctgtctttatcccccagtcacatactctatacctaacctctgtgtttctacagactgtagcttggttatccacatataagtgatcatatagtctttttggatttgggatacctcactcaggatgatttttgttgttgttgttttaattttttatttattttatgtatatgagtacattgtagctgtcttcagacacaccagaagtgtgcatcagattccatcatgtgattgctgggaattgaactcaggacctggaagaatagtcttaactcttaactgctgaaccatcttcccagctcccatggttggttactttctagttgtattcatttacctgtgaatttcatagttcttaattgctaagtaatactccattgtataaatataccacattttttttatccatccttcttcagagacattgtggtggtgtgaatatgtttagcccagggagagacactattaggtgtggccttgttggagtaggtgtgaccttattggaggaagtgtgtaactgggagtgggcaatgggaccctcctcttaaccacatgagaaccagtcttctgtttgtctgcggaacaatatgtagaactctcagcctctcctatgccatgtctgcctagaagctgccttgatggtaatggattgaatctctaatcctgtaaaccagctgcaattaaatgttgttctttataagagttgccttggtcacggtgttctttacagcaatggaaaccctaaggcagacatataagttgttttagtttctggctattatgtatagatcaccaatgaacatggttgagcaagtgcccttgtggtaggataaaatgttctttgggtatatgcccaagagtgctttagccagatctttagggagatcaattcccaactctctgaagaactgccacattgattttcataatgtctgtatagtccaccagcaatggaggagtgttccccttgctccacatcctcaccagcatgagctgtcgtttgtgttattgatcttagccattctgacagacaaaagacagaatctcaaagtagttttgatttgcagttccttgctcattaaggacgttgaacatttctttaactatttctcagccacttgaggttcttctgttgagaatactgtttaggtctatggccataccaccctgaacgcgcccgatctcgtctgatctcagaacctaagcagggtggggcctggttagtacttggatgggagaatactgttagatctgcatcccatttttaattggtttacttgttttttgatacctaggttttttttgagttctttttatatattggatatgagctctctattggatctgtaattggtaaaaatatttagcattgtataggctgcccctttgtctgaatgacagtgtcctttgctatacagaagcttttcggtttcatggagtcctatttattaattattgatcttagtgcctgagctctcagtgatttgttcagaaagttgtctcccatgccaatgtattaaaggttattagccactttttcttttatcaggttcagtgtatctgttgttgttgttgaggtcttggatccacttggacttgaattttgtacagggtgatacgtacagatctatttacattcttctacatgcagagatccattttgaccagcactagtgcaggttcctggagtcattataaaaaatcaggtgtctgtgggtgtgtagatttatatctgggtcttcaatttaattccattgttcaacgtgtctgtttttgtgtcaatactatgctttttttttattactatagctctgttgtacaatttgaaatcagggatggtgacttcccccacagttcttttattactcgggattgttttagctattctggttttgtttgtgtgtgtttccatgtgaagctaaaacgtgtcctttcaagatctgtgaaggtttgtgttagaattttgatggggattgcaatgaatcactagattgatttttcttttgtaggatggccatttttgctatgtaatcttactgatgtgtgggaaatatgtccatcttctgatgccttcttcagtttcttttttcagtgagttgaagtttttattatacaagtctttcacttccttagagagttataccaagatattttaatgatttgtgattattatgaaagtttttgtttccccaattttcctgtcatttgtttgtaggagggatagtttttatgttaattttttatccagctactttgctgaaagtgtttatcagctataagaattacctggaggtgtttttaggtttattaatgtatactgttacatcgtttgcaaataaagatactttggccgggcgtggtggcgcatgcctttaatcccagcacttgggagacagaggcaggtggatttctgagttcgaggacagcctggtctacagagtgagttccaggacagccaaggctatacagagaaaccctgtctcaaaaaaacaaaacaaacaaacaaacaaacaaacaaacaaagacacaagatttctaaagatatcttgacttcttcctttctaattcttacttccttaatgtcctacagccctcttattgcactagctaagattttatacactatatttaataggtatggagaaagtagacaaccttgtcttattcctgattttaggggaatttctttgagtttctctccatttaaattgaggttggctgtgaacttgttgtaaactgttttcattatgctaaggtatgtcccttatatccataatctctatagaacatttatcttgaagggaagttaaacattgtccaaggccttttctgcatccaatgagatgattatgtgggttttgtcttttagtttgtttatatggtagattacatttataaatttctgtatattgagccgtccctgcatctctgggatgaagactacttgatcatggtagatgatctttttgatgtctacttagattaattttgcaagtatttgattgagtaaaattgcgtctagctttataaaggaaactggtctgtaattctttcttagttgggtctttatgtgatttgggtatcagggtgactgtagtctcatgaaacaaattaggcagtgttccttctgtttttattttgtggaataatttgaagagtattggcattaactccttaactcctttttttttgttttgttttaaatctggtaggtttctatgctaaaacaatctggccctggaccctgtggttgggagacctttgatgagtggctctatttcactgtggcttagaggctatttaaattgcttatctgctcttaatttaatgttggtaactggtatgtatggagaaaattaccttgttttgttctgttttgttttttgtttttagatttcccagtttggtggagttcagggtttttaaagtatgctcctaatgattctctggatttacttagtgcctgttgtgtggagttatgttccctatttcatttctaacttttaaaaatttttaaaattctctctgccttttagttaatttggataagagtttgtcaggattgctaattgtctcagaaaacttaacttttaaaaaattttatagattctttgtgttgcttttgtgtgtttatctggtgagattccctttgtggcttcccagagagtgcctgctggagttggtgactgagataaaaacagtgagtagtgggagggaggttaggagggaaaactctgtgtggtccattggagatgtgggcagggagaaaggaagcaggtgttctgctgtccagctgaggataaaactggaggattagatttagaggagcagagggagctataaagattccagtctgcctacctgcttccctagccagagtccactttctgttttttagttttaaagaggacataatgcacattgaccatagattgaaccacctagtacaaaataatgattagaaatgtgaaactgtcttcagttactttagttgactttgctggaggcaaaaccaagatagagtgccagaagacatggaacagtctatgcactattttaaaaagtcacatcgaaatagaggctgaaggttcagaagttcaagtttatccttgatttcatagacagtttgaatctatgaaactaacctcggctatattagcccatgtatcaataaaaaaaaattcaggataaaaatcctaaaatgaaaacaaaacaagattcacatgggtctggtggtacagctctgtaaccgtagctaattaagtgtttaagacagaaagattaaaggttcaggagatgccttggctatagcataagttcaaggataacctgagcaatttagtgagactgtatctcagagtaaatagttttaaaagaaggctgagagtatatattaatgagaaagcagttccctaacacatgtgtgtccctaggttcaatcctcaattttggaaggggaagccaatgcatgagaaggtgtttgggtagtttaagatagatttatcctttcttagcttgtatgtttttcatgagtcactggacttgcctattttcttcccatcctcctttccctgatgacttagagtttgtccctttctcccttgcattcacattttaattcttgacatcctgctgattcaggcaaaagcctgtaactacttcttccaggaaagaacactatgcagtgtcacattagatggttctcttgcttcagcacatcctgcaatgtcacaagggtccactttggaggcaatttctgtgcataatttttctttatagaacattagtgttggaagcacttaatgtagtcagtctcatattccttgttgatgaagggatattatgttagatacagcctaatctgtagtactttatagtctggatattttctgattctgtgctttcttttatccttaatataattgaggatatgctctgaccactggtcagcatgaaaacaacctgaaaatgcttttctattttttctaggaacaatgtggcacagttttggcaggttaggtctatgcagagagctgggttttctaaggttatttagcaacccaaggaaggagaagcttgcctttgtcacctgcacccaccttcagggtcccaggagacccaggtatagtttaaggactttccacacatagggtaaccagttcactccatcaggttagtatactgctgatgctaactaagacttaatgttttcatgagtgatctctgtggaagtgggattgctctacactatggaagttctccaaaggaagccttcagtgatcaactcaatgaagagctcaatgagagctgttaaatgctcaacagcacgtggctataaaatcatttttgttgttgttgtttttgtttttcaagacagggtttctctgtgtagtcttggctgtcctggaactcactttgtagaccaggctggcctcaaactcagaaatcctcctgcctctgcctcccgagtgctgggattaaaggtgtcttcctaaacttatgtgtcccatcacagaagttggtagtctcagtatcccttagtatcacattaggggtttacaaatggccagagccaaattttaaaaaaaagtcctgaaacaaagccactaatgatttagctacattaatgccagatcatctggaatatcattttatcaggcaaaaccaatacattgactcttaaaggtcttaagaattggcaggactatggcagtggcagcagttttcttatggagggagcccatgtccagtatccacttgagaccctgtccttaaacaaactaatattcttagtagaagtcaccttcaggtgacttcctatagcatccaagatgccacataccttcagaatttaagttctagaacaagttcttctaactcaagtttttggtggacagttcattattctcatctaatctttattcagtgtagcttcttgactaattgccctggaaggtaggatttagaaaaagatcaactcttgattcttgtgctaacaaataactaagaaaagcttctttcaaaaagtagcttcgccttttccgttggattgacccatctaaacttctcacactgtcattgcttaatggctagtaaaactcaaactgggtaggtgcaaaacaagaaatttctgaatttatccaaacaaaaacttgactcagctaaaggctggctattcttagagggccttggctaactacctggctatatatagaaatctgtttgtagagaggagacctcttgtgaagagccctattgtggaccactgtgggcttgagtttcatccttgaacatgtatagtagaagcagtagaaaaggtatagcttgttctctctgcctgccccctccccctcctttcttcccttccttcctccctcttgcctctttctttctcttcctctattctcttctcccttttcctcttcctctcctcccccctccctttcttccctctttctctgaccaccagacaacagtgtctggatcattctgtactagaggacttttcctgattgattgattgattgatttatactaattctagttttagttaaaatagaacataatggatttcattttcacatttgcatatatatacgtatacatgtgtatatatatatatatatacacatgtatacgtatatatatataaaaatataaaatggtatcttggcaatatttcctgccccactaccttttcctactcctccttcaccaaacagtcccttttctattttctatttttcttttctattttcatgttacatgtatgtatatatgtatgtatgtatcgtttaatgcaaattcctcatctgaaagaaaagtgtgatattttctatcagtccccctttagttttatgtcacatatgtttatgaaataatatgaatttatatttaaatctaatttccatgtatgagaaagaacatgttatatgtctgagtctggcttattttgtttatcatgatcttttagttctagcaaatgacataatttcattcttcattatggctagataaaactctatcgtcggagctggagagattgctttgtgtttaagggcacatattgctcttacagagaactcattagattcctagcacccatatggtgcttcccaaccagctgtaactagttttatggaatctggctcactcttctggcccccataggcaccagacacacacatagtgcacttatattccttcaggaaaaacactcatacacataaaattaaaataaaaatttaaaactccatcgtatataaataccacaatttcttttttaatcatttccttttaactaatttatttaatttttaagttggtatacaaattattgggttccattatagcacttttacaaaaagattttgatttatgtctatgtggggagtagtacatgattctgacctgtggaggccaaaagaagggagtcttctggagctggagttacagacagttgtgtgccacctgacgtgggtactgagaactaaacctacatcttcttcaagaaacactgagccgggctggagagatggctcagcggttaagagcactgactgctcttccgaaggtcctgagttcaaatcccagcaaccacatggtggcttacaaccatccctaatgagatctggcgccctcctctggtgtgtctgaagacagtacttacatgtaataaataaatagattatttttaaaaatctttaaaaaaaaagaaacactgagccatctctccagatggattatgacagtttcttgctctaggtcctttcattctcccaattgccacattttcttgatctattcatctattaataggaatctagggtggttccatatcttggccattgtaagtacagcagctgtaaacatggatatgcaagtatccctatattatggcaacagagtagtccttcaggtatgtgtgcactagtgatacaactcggtcattcatatggttaatgtcgttttattttttatttttttgaaaaatcgccattctaacttccatagttgctgcactcattttcatttccagtaactatgaaagtgggggtcctttccccaatattctttccatcattcattgtcatttattttttttaatgatagccaatcctcccatggtgaggtagaattataatgaagatttaattggcatttccctagtggctaaggatattcaacatattacaattacttatttaccaattttatttttgagaattatctgtttaatgcatttgcctattaattggataaattggggtgatggaatgtttaattttagtagttctgtatctgtatactttttttttttttttttttttttggtttttagaggcaggggcagggtttctctgtatagccctggctgtcctggagctcactttgtagaccaggctggcctcaaactcagaaatccgcctgcctctgcctcccgagtgctgggattaaaggcgtgtgccaccacgccaggctctgtatatattcttgctactaatcccctgtcagatgtatagtttgtgaaagttctctcccattctgtaggctgtctcttcactgataattttttcctttgctgtgaaggaagttttcagtttaataagatataatttattgtttcttgagattatttagtgagccactggagttctttctggaaaatttttgcctactcttaaatcttgaagtagtttcattaggctttcctctgtaaatttcagtttggggtcttaagttgtgatctttgattcatttttcattttttgtgcagagtgaaagctaggatagaatttcattcttctacatgtgactatccaattttccccaatgctctactggattttgaatccagcttggctagctcagtggtcactgttggccacagttctccagatttgtctagtcatctagttagatgtagagttagtcagaactaaagggatcaggggataagattaccttcctccctgtcttccttcttataagtccacacaggtactaaagggacaagaatatgtcttgccatttcccaacctctggttggtcaccagcgatactcgggagagccagagcttagtaggtactatatacttccaggatttatgaatactgttttcctagtgtaactaaactttctttcccttgctttctcatactcaacttttcttctgtaagtcaacaatagttctgtgatcctactagcagcagcacctgaaaactagttaaaaatgttaagttcttgggttaggtatactttagttcttgcttaacatgtgcaaggccttgagttctaatcgccagtactgccagaaataaatataagaatgcactactccagattcctgagaaatactaaatcctgtggggagggaggcttctgatgcacccacactaaagtttgaaagccactgttctgagctgtgtttcaaatcttccttcaaattcacattcatttagcagtggtaaaagagttaactctctcaggtactagatctaggaattaaccttatatgacatggtgacataaataatagtatcttcattttataggtgaggaaattgaaggacagaaatataaaataatcagagggctaaaaagcggatcacaagtctactcagagtctaaaggaacaaggccccgcttttgtaatctggagccacttgggaaattgagggtggttagtaatgaatagatttttctgaagttgttttttttttccttcctaagtttgccaggggtatgtctggctttaggagaacaagcagttctttataattctgcctcctcagaattataactgctcagtaataaggctggtttcagtagtctttgttctgcgtccccttaatatattagtaactatcttaagaggtccttctgatccttttgacatgtagaaaatctaccaaaactcatcctgaattgaatttattctagggtaacgtgttgaaaacaaattaggctgctagttaagtacttttggtttaaattcatgtaataaaatactatttagtctgtctcatgtgaccatatttcactcatccagtgttgtaaatttttattccctcctagttccaatgtttatctggaagaccatcagtgctagtcatcagaacttaatggttcaaggtcatcaggaaaggacatgtaagaaatgtacactcatgactggaaagcacttgactccaaactagaacacaagtgcctaagtcatgattactcagttcttgctgtcccaaattatttttttgcctatttttataaaccatcaaaaactctagctatgtattttggagtccaatagggttagtctactcccagatgactgaaatgtactgaccactcttaccttaggcttctctagtagaggcaaggagtagaactagtattttgcattgtcattgagctagtgaaggtgcggaattagaacaccttcagttcactgtcaaggacaactttatgaaagtaacagtttagttaatatggataatttgataaatcttcctttaggagagaagcccggtgactgattttattttctaattaaaaattacttagtccctgccacctacacacatacacctaactatggcaaggcatgggtattttattttgtaaccagaagtctctgtacctttgtcaaatcttggactatgcaatattttcttaagagtaatatgagcagaaaattattacaatgttgaaacagagtccaaagatgaaaatgggacattacaaaataggtttcaaaatcaaatgctgtccttaaaagttatatacaaggctgaaaattttcaaattatactttaatttcctcaaatggggaataggttatgctttcaattagaaaggctatatttggtaccaggatcaaatttcttaaccagacttaagacaggcttgaaagagttaatgcttattgagcattattcatgagcaagtggagctggcatagcaacagtttctccccagggaggagaggggaggagacagacaggacaggacacagtgttcacagtctgtggttggagagccagcactagcctagctgtattgtttcctctccaccccagcacaaaggtactggtgtggtgaagagagcacatgtgcctgggtttgggatgctgagcacagaaagccccttttggtgcctcttctggagcactaagacagcagcagtgcagtacagctgaatggtccatactgtttctgctaaagttctacaccttttgtaaattgggcaggagcgcctggaagcaatgatgcgccggtccctggagcgtacacaacagctagagctgaagaagaagtgctcatgggcaggatcaccagggcctggcggacgtgatggtgagtctaatactgtctctgcattgcagggccctgtagggaatctcgggagtgactgatgtctgcaggattggaagatcctgtgcacagcttttaagatgcttaaactgccatgcttcctgtatgtatatgcatttctcatagaggagagctgtcattctttttgctatcaggtactcaaagcatgaatactgggctttagggaagagtgaaagaaaagcagagaaaataaatatagagcctggtagctgaactgagcacacaggtccaaaaacagtctcattttaggagagggaaatagcagaaggcacagtcacagctctagatatgcctggaaaagcagcagttactctctaagaagggctgggcggtttccttttttcccctgtttgttgctctgattttattttaaaggaacttaacttactttactatctaattcataatcatctttaaatcttcaaagacctaacttatggattattactactatcaggatgactttcccctcttttcaatgtcatagtttgtttcaataatctcagtattctattatacaggagttgtatgctacctctttctgagagcagattgtaaataactgactcttgactttgccatcttgtgatttttaaccatttggcaatgaatacatttttttttcttttgaaaaggcaataattcatttgttacttttctaatttctttattaaaaactaaaatgcagcaacaaattggaactttttcttttacctctctttgctctgatttttttctgtgtaggtgaatcagaaaataccccaccccttcctctaactttagcaaccagcaccccccctttggacacagggaccactacagctgctgccgagtccaccaacggtatacacgagcatcaccatgccatagtgttctgtgacaactgctctgatcaccctcctccatcactgtctgtctcaattgtgaagtcactcaaaagtgaaatcactttcacaattgatttcttggtctgacttgtcatgacttttccccctagagctgtgaacgacatgcccatatgttttttgttcctttgtcatcacagtgctgcatgccttatatcttagtgtcccggagacatttcatcctcagctcactaacttctgcctttaaaaaaatctcatcaatatttggcttttgtgcatttagagtctcattagtcatcttgttttacttttaagtatcaaagtactttttttacttctggtaaaaaaaaaaacagaaatcacagattctgaatagaatacttgggcttggttaatgtagtgaatttctggagaagtgtttgagaggcagtggtagggaattcatcagtactaacatggagagtctaaatagtcagacaatttggctttgtgccagacattctatctctctgtctaaaaatacaaaacatagaaaatataaacatgaaaattttccatggtctagattaagaatagaactagcaaaactttgttttcatttaataatggctttagaaatgctgtatatttgactggtaaactgaaaatgagatatagaagggatatgatacttatgagcaatataggaagatatttgaatagtaagaataaatatctttgatttctcgtatcccgttgacacagcctatccttattggtagtgctaagtagcacagattttgctttctaggttgagacttggccttccccatagtaaagctagttacaaggtgagctgagggactcagacataccacctatatgaatgccaaaaatagcaagatgaaataatattttaatgctgaatttataaaaattaaaccacttggtcagcagaaattgtcagatatgaggaattctttcatttgaaagcatgagttaaattttgaaaatattaggtgttagcttccttgataggaatgcatgggttgttttacttttgcctcaggttctaacacagattcacagggcacggccagtacttttcgtttggttgtaatgatttaatttagaagccaatatagaacaatgacagaaaacataagaacatcaaatctagggtcagatatttaaattcttactatactgttaaaacatttgcagaggagccattttgatgccttctcttaaaaataggaagaaaatctaccactgctaagttagtgctactttaaacacaaactgcattacaagtaacattatttttccaacctgagcctcaaataacctctaggaaatgttctgtttcggcacatacagttttattcaaggtgtttgatagttctaagaactgttgtccctaggtctaggttagttttgtttttgtttgatgtggatatgtttaaaagttgctggacacaagaaaatactggatgagattagcatgtttttagctgagtattagaatgagtttgaacatttaaagagaagagcacagtgaagaaattgcaaaccggtgaatgctgtcgcctgaacatttccagcttaagataatgaaagcagtgtgctgggctccagtggagtaccactgaacgtgtgtggatgaggacaggaaggacgctttgagatatgatttcacaggcgacagtgagagaaaaccaatgtctttaatgcatttctctgcagcatgtgacaaactttcaacatcaaccatgaatttgccaaagcagacggagtctcctatgagtaaacacctgtcttcatccaccgtggcaatatcttattccccagaccgaggcaagtgaatgggtagaccttgtctctccagtttgcttctttctggtgtgagcgtcttaacactgccctttgtgaaagtctcctttcttagccttctgtaagtcttaccactgtcctaacctctagggtttggcttacaggactttggaaaattagcactttgttctataaagaaaggtcattattaattaataggaattgacagtattctaatttgccagaacctatttcacagagcatagaggagttttgttttgttttgtttaaagaacccactagatagccgggcgtggtggcgcatgcctttaatcccagcacttgggaggcagaaagaagcaggcggatttctgagttcgaggcctggtctacagagtgagttccaggacagtcagggaaaccctgtctcgaaaatacttaaaaaaaaatacttaaaaaaaaaaagaagaagagactgctaggtcagtgatataattgattataattgattagctagaggagaattggttagtcagacttttctagaagacttgataagagaaaaaaataggactgtgaagtcattcatggtttgtaggcctgcctattttataaatgaaaacaaaaatacagaaagaagtcgatgcttttttaaaaaggtaaaccatgaacaaccttttaaggcagtcttttgttttgggagacagtatatagagggacatccactactttcagaacctctgtgttctagtgaagtcttggaagagtcactggagccccggagttttgccttttagtatacatgggttaagaaagagaggtctcttcttgtgtaacaggaatatcctaaaacacggatgaaggaagtcaggtattagaagactgctgaggttgtcaggtcatcaccaaggggtgagcaagaagaggtttgtgacttggacaaggctgggaggcctttcctgattgttactcactgccattgattttatccccacatcccagaggcatgatatatggagtagagtccccagaagtgtcataatgctgttcatttctgatgtccgtttatgagtaaactgctcgaaacatggaaggaaggaagagtttgaaaagaaaatacttaacacttttaactctatgttcattagatcacatggtcataggttgatcttaaattcattttttgcattaatgaacatgtaaatataaacatgccatttcatgattgacaactgaattatctgcttatgtgtatattctagattgaaatttttaaatctccataccatttactaaataggcatctaaacaatatctattgtcatatatccctaaaccaaaacattttagttgttagattttattttttcttttctttttttttttgatattttgttgttgattttgcttttctttttgaggcagcatctgattctatggtccaggatggctttgtacccctgatattactacttacactcccaagtgctaggtgtaaattataacatccaggaggcaacgcagtttggatcatgaatcctacctactgtcttccattaaagccagttatttggttggctattatttttgtgccattggtgtaattttggccttacttaaaaaattaaaagcagaagaaagaatttctctttctactattatatgaaggcacttttcatttaaaaaaaatcagcattttaaaatatttcttttatatatttttaaattttttattgaaaatacattcttctctcacacaattcattccaaccacagtttccctccttctgttcctcttagcacctctccacctctcctctcccctagatccactccccctccatttcttctttggaaaagagcagacctctaagaaagtgtaaaattagtttaaaattagtaaaattgggcatgatctttgtttttccagtgttatatgtccttagtaagggagttcagataactttgggaagtggggttaattctttccatctagtactggtcaccgagcttgttctttgttctgctttgctttgtttttgagacaggttcttactgtgtagctcaggctagcatcaaacaggattcttctgcttcagtcctcaactgctttgattataggtgtgtaccattgcacaccgagagctcacctgtggctcagagaataatgtgttgacttaattctgatgccacaagagaatgaaggaatgaactcgaaaatcttgagtgatgttttatttttttttattttactgtgacaaactccaaaaccatcctttgttagagttactttaattttcacagttgttctgccaccaaaatgttaaatgctatcattcactatcttgtttaaacactattttcttttattttaattttgcttttaaaaattcaatttaattccatccctcagctcattgcatgcaccttaattccatagacacctttcttgtttccaagactgctgacaccacatagcctttttaagccagcagcagaaatacatacatgctctttgagcaggcccgtgactcaggtgaaagagtccaagctgtgaaatcaaagaacatttctgaaacttttttttgttgttgtttttcaagacagggcttctctgtatagccctggctgtcctggaactcactttgtagaccaggctggccttgaactcagaaatctgcctgcctctgcctcctgagtgctgggattaaaggtgtgtgccaccgcacccggctctgaaacatttttgatcagccttggattcattcctgaatttttgcatcttacttctcttttgctgcctttataaaatgctttcaatgactaaatagcgttttctgcctgacagtattttgctgttgctgtttgttttaaagttgaataatatataggtgagtaaataattttatgactggtgacatgtgaatcaggtggaaaatcaacttgatagactatggaggttagaattttcttaggagatttgggggggatagcatatacatcattccccttggagtaccacagcgactactcacttttgctcattgaaagtggaagtatttatttatttattgtaatgaaagccacatcttgtggtaaatgcttataatgttagctacttagtaggccaaagttggaagatcatgagtttgaggccagtctggacaatatagcacgactgtgtctcaaaattttaatattaaattgtcatgaggattaaatgagatcatagtataaataaggttacacagtagttggcacagcataaaagctcaacagatgtctagagccttgctactcaaaaaagtgatccatggaccagtgatggaaactttgtagaaaggccaactctgaggccctccctaacctgtatattaaagtttgacaaacactggatcagactatcagtgacctttctttattgaatacgattagaacatgatgtcaaggtttaagagggtaagcattctcttcatttgcacatgagcagcacagtgactatataaggccacattccaagatacagtgtattcagtgaaaattacatcagactacataggcctgttcttctttttaccagagaggacaagatctcatgtagtccagactggtctcaacttcactaatgtagctgaagctagccttgaactcccaaattttctgcctgtatctcccaagtactgagatcgacagtatgtgcctgtctggctataaaacctcttaagtggttacagtgtggtgtggcacttctactcctagatacagagccagaaaaattaaaaacacttaaagggtgaatgttcttagcagcattattcacagtagcccaagtggaaacaatttgaatggataaacaaaatgaaacatatctataaagtaaaatattgttcagcaagaaagtcatgctgatagataatacctaatagatgaagtttgaaactattccaagtaaaagatggaaggcacaaatgtcacgaattacatgactttgcttatatagaatgtttgaaataggtaaatcctagagacagacagtagattactgtttaacatggaaggcagggaagaaaggttaatgactgcttgatggataaaaggtttcatttgagagccttaaaatgatttgtaatttggtcatgattgtgaatatactaaaatcaatgaactggacatttaaagggaaaattatatgatgcgctgattctatctcatcagtaaccctaaattcttaaccagtaggaagtaccctcattcttaggaggagaaatgtctcagggggtcttcagatttgctcagaaggtccagtatgcagctagactcccctcttttatttattatgatgaaaagctatacaagagaatccaccaagggggaaaaaggaaagacagagtctagggaagacaaggcacaagctcccagagtctctccaggaatcactgaggatgtgtttactgaagtgacttaagacaaggatgagctgcccaccagggaagtttggtagatatttgatgctgatttttttacagagatgtgaccatgtgaactccttgttcaatatgtagcaagattttgtattcttgagccgggcagtggtggtgcatgcctttaatcccagcacttgggaggcagaggcaggcagatttctgagttcaagaccagcctggtctacagaatgagttcaggacagccaaggctgcacagagaaactctgtcttgaaaaaaaaaatgtattcttgaaatgaaagtgtattttcagattatttttacatacagtttaaagcacaataaatgatcttctcaccagccaatgatggcatccttgataaagtcttacattcccaggctttgttcagagacccaccttagaagctggcttttccaaggccagcagtcaaatctgaacagtctcttctgaatagtccatactcttaaccccgttgccatgtctttaacagtgagaccccacacaacaggataaggccagcctgtggcagtgaccttacatgtaacttttagataacctgggtttaaaagtagaatcaaagccgggcgtggtggcacacgcctttaatcccagcactcgggaggcagaggcaggtggatttctgagttcgaggccagcctggtctacaaagtgagttccaggacagccagggctatacagagaaaccctgtctcaaaaaaaaaaaaaaaagaaaaagaaaaaagaaagtagaatcaaatcccactaaccttaaaggtctgtcagccatgttgtttccttgttccttctgaatctttttcacctggctccagcccagctctggccagtaagttgaagctttcctgactaccttcaattcaggtctgaggcaatgatggtaaaggcatgaataacaagcaccattctttagggtacatgggttcctatggaaaatgagaaggcgaggacttcaaggcactcagagcaggagatttcattgatcaagagactcactccccaatctgcattcctattgtagttttccagctgtagttgccccagggtgcttagtacagtgggagtaatacatttcagtctgtgattccagaaagtctgcctaaggctatcagtcccaaagtccccttctgttggtgacactgacccacctacctggtgagtgtggatagtatatcaatgtgctgtctaaaaatagagagtgaaaagacccgaaaagaagaaatttccacaagagatatacattggaattttaaaattcaaatagagactacaatggcagtataccaaaaaatggcccctcatagttatctcagtaacactgttatttcagtttagactcagaaatctgtgcacagtagcttgcagaggcattgtgggaaatttcctctagaagaagagaacttcttagagcaattctggaaaacaaagattacaaatatctttgtgacaatgtcccccatgctactataaccagacttttttcctttgtattctattcagcatccaaaacttgatttctcaattattcactacacttgcacaagcctctttttaaaaagggcagaacatcttcattggtgggagaggaagaggagaagaatatatataaaaaattaaatcatcttaatcagaaagatatatcatgtttagagattattcagagtcaaatcctaaattttcaaagaaggtatcttagatatatgtaccaggaaacggtaaagtaagtagagtcaggctgtatagtccatttttataaactacttttaaaaatcaagcagaaaatagtaatattgcactttgacaatcttttgcaaagaatatacatattctttgcatccaaattatagcactgaagagcagcttggatttttttggatggtgccaacatagaccatgtcctgtagacatttatatagcccaggtgtttcagcagtattcagggtgtttcacagtttaggagggttgtatttgtagtagtctctatttgaattttaaaattccaatgtatatctcttgtggaaatttcttcttttcgggtcttttcactctctatttttagacaaaaataatagtgtaaaaaaaaaaccccaaaacattagtttgaaacttgttctggtctcagtacgtagttccaacacacccactgagacaaaaacaagaaaaggttggtccctcctcatttccactgaaggaaaactaaaaccactccctgactgattattttttaaccccagtttaggtagaatagccaaaagtagccaaagaatcccctgaagcaacactcttggaattgcagtagttatcttcaaattctgtatgcaatttttcacctctcacaacagagaatgtcttggatgtttcatatcatgaccaacaacactaccgccacacagcaccacaggttcactccttcctgcccccccccatttccccaaacattgtttttgctttattttttgaattggagtcactgtagcaattcccacctctgatgtcaattgtttctagggccctcaagaacaccagggtttggtgattcatcaatagaactcagagaactcatagctcctggctgtaattcattatgatagcaagatacccaaccaagtttgcaaaaggaagaatgcatgaaaagtagagtggaaagcgggtctaggtttctaatgatctcctagaaaagtcatacacatagtgttgcaactgaggaagcaccctaaagatttagtgccctgggtttttaacagggtctagtcatgtaggcactctctaccaaacaaatatccaaacttcacacacttagaatgtgttctttttacaaacagggtttgtgctgttttttttttaagcattcacctgtgaatgtcattaaccttcctaaaatctcagctcctagatactgacctaagctcactcaaccttgtaagcagacctgcacagacagcagtcaggacttctatgttctgcctgtataaggcagttgaggcttagacattaagtagcctgtccaaggaatccagctatcagatggcagggcaaagtcttagctcccaagtacattaaccactcaaatgaaaaggactgttgagtcttatttaagatgagtcctaatgtatattcagtagaaaaaccataatatttttttaaatgcggactaaacattacattttttaagaagtaagctctttttatcccctgattgtcctgccttttccatctgtgcttcctttattttctggttattgtactgtaactctctagtattccatgcctgtccttgtgtagctctcgggagccctctcaaatcttcatacaagtcctctccaacccggaccactgagaaaaagaagaatacacctatatctgccatgggagatgctgggaagggagccatggctggaggagagccttcacaggtaaatttaagtgttcttcttcattctatagtttgtctgacagtgtgattgtttctaccattgacctgggggtctctcctttgtccatctatctccagggcctgttcaaaggatgcatttggtttaagtttttaccaaactttggaaaattatcaagtgtttttgcattcctctaaagcttaatgtcttgtagcagattcctgatgatattgttgtgataatacagcctttcttccaggggacatgagtcagaaggagtgttgcagcgacccattctgcttcctcaggctatctggttctaggactcttgtctctgtatacaaccaaaactgaggttctaggtcaaacttcattcacaatagcctttgaatgatttttttttaatgtcatacggacactgttagtgaaaagactattaaacaggtacctcaattttatgtatttattaagaaattatgctgggcagtggtggcgcacgcctttaatcccagcacttgggaggcagaggcaggcagatttctgagttcgaggccagcctgttctacagagtgagttccagggttatacagagaaaccctgtctcagaaggaaggaaggaaggaaggaaggaaggaaggaaggaaggaaggaaggaaggaaggaaggaaggggggaagggaaggaaggaagaaagaaaagagagaaagggagaaggggaaggaaggaagggaggaaggaaggaaagaaagaaagagagagagagagagagagagagagagagagagagagagaaagaggttatatatgccatattatttgtgttatcatttgctacatagtaaagtaccctaaaccttgtcagattaagtaaaaacagtatgagccgggcggtggtgcccagcacttgggagacagaggcaggtgaatttctgggttcgaggtcagcctggtctacaaagggagttccaggacagccagggctacacagagaaaccctgtctcaaaaaaccaaaaacaaacaaacaaaaagtaaaaacagtatgtcttcattcctaagttccttgggtttgaaattgaagttagctcaattcagagcttggtggtttgggtacaagatttcatgaggattttgtcagaatgctggccagggctatagcatctgatggcttaactgggcctcttgtgagactttcattacagggctactgaaggagggacaggctcagttcctcattcccacaagcctctccacaaacctacttgtgagtacaaaatggctgacctccctcagatctattgttattcaatacaaagggagttgagtgccacctgttgaaggaatatatatatatatatatatatatatatatatatatatatataatcagttgtgtttgattatgtatcaattgttaatacatacaatttacattaaaactactaaatactattgagacttttagctttattaattattatttttattatttgtagtcttagagagcaaattcaggaacttccatgttacattgagtagtctaccactgtcttaatatcctgagcactattgaacattttataaaaacatttatttttttcaaatttgtgtttgccctgcgatagttaaaataggagctggtatttttgagtctaagattttctgtaaggtgggctatttgtggaagaaggttgccatttctggggaccaaatgaggacttgttacagaaaagtgtagtaaggaaagagggtgaggctgtttctgcaggccagtcagtgatgcccattcctttctgccaagagaagtaaggggaaaatagagaaatgtgtgttttgcactctgcattatataccatgtatgcctcagagtttacaactcagcatcttggatattaaagtccctttctggtaaagcttttgtagtaaatgtatggttttgtttgtatgaatttaatgtttcaaattctccaaaccctcccatatacttctccttgctctctttcaaattcatgatttttttttttttttttttttggtttttttgagaccgggtttctctgtatagccctggctgtcctggaattcactgtgtagaccaggctggcctcgaactcagaaatccgcctgcctctgcctcccaaatgctgggattaaaggcgtcagctaccacacccagctttattgttacatatatgtatatacatttatatgtgtgtatatgactatgaatatgaatatactaatatgaatatattagtaattcctaagtacataaccaagtataggaagcccttttttgagttgttagtcagggttgttcaagagacacccaaaacataggctattgctctttgccttagttgctctcagaggtggaaggttagtccttattgctgaaaataccatgtacttccgacacagaacccagaaacttctgagctacaagtgtatgtttttgtactctttccagttcctatatatttagggccactatctggttatgctgtttgttacctcttggtaagataataaaatgtggggcagaggatctccatgttgaagcacaaactattgttccaacttgatgacctaaatataatgatgtcatagtatcataattctctacaaagattcatgttacatacatattgatacctctgtaagaaaactgtgtcactctgatctggtttttttcaaattgtagaagtagtaccagtcatgagctgtggctatcatattttttgtcccttacagatggagaaaatgaagaaggggcgagtggcaacttctgctgcttctgggggtcatgggtccccactgagaagatgcgagcctcctgaagatatttccaagaggttgtcttctcctgtgaaatccaagtaagcagtatttcccttgtcagaactctgatggttaacagtcaaacttagtttggttccatccaacattgtggcttctgctctgccaaaagcacgaccagcaaaaagatttgagcaagacaaatgcctacctttgaggtatgtgctccatgcttatatatcttctggataaatgaaggaccatttataagttcattgcttggtaacatatataggactcatatttgccaagattatatgttcatcgttttctctttaaagccttcaattctgtttttctcttccttattccctctggaattatcctttttcttctgatgaaccaggtctagctctagattgaagtgattgcattatttgtgggcacctgctcaccatctttcattattggagcttagcaattttgttttggagacatagtctccaaaaccaagttctcgtgaccttgaactgatctttctgtctctgattctacagtgttgagataataggtatatgttatcacacgacacaatattttccaataaaacacataattttcattagggatagataaactcaacaaggacaatataaaaaaacaaatttatgatcattgtcccaagttactaaaaaattttaccaacagtaattgacaagagtgattcagttgaagggtcagtgggtcagtaaaatggtttgcttgctaaaggtgcttaccataaaagcctggctacctgagtttgatcccaggaactcacctaaaagtggaaggattgtcctctgaccactatacatgtaccattgcacacatcccctcttcatgaacacacatatagaaataataaaagagtgaatcagtaacaacctaattccgaagtagagtggaaaggtataatgttacttagaagtttttctatgcaggattacataagatcatcttcatgcaagtatataatgttttttgagcatatatccctcagtgtaacatttgagtggagacctacctatatgaagtgaggatcaggcctcagttggagccttcttcatctgaagcttgtttgcattatatcaacatttcatgttcagttagtggtcttactttgaggctggagagtgtcttttttttttcttaaaaagaaatacattaaattggggctggcttacaatttcagagttttagtccattatcatcatggcaggaaacatggtagaatgcaggcagacatggtgctagagagttctacatcttgatctaagggcatagcatgaccataggagaccttaaagcctgtctgacacatttcctccaactaggccacacctcctaatagtgccatccctatgtgtgaatcattcaaacacctgagtctgtgagggccatacctatattcaaatcaccatagacatcaacatgggcccaggtgatagttcagaccagggatatccgcctggcctttggtgatatcagacctactactgaagggccatggatcctgatatggcccttgttggcaaaacaggctaggacctcaccatggccttagggtgacactgttggctactctcatgaggctgttcctcgctaccttggagtctccagttccacatcctttcgtgtctctttttttaacatcccaattgctgcccacaattccgtcctccttcccccctccccttccctgagaggatgcccacaccctgggtattcccctactctggcccatcaagtctctgcagggttaggcacatcctctaccactgatgccatacaaagcagccctgttggggaatggattccccagacaggcatcagctttagggacagccctcactccagttgttgggctacctgcatggagagtgagctacatatgagcagggaggtctaggtccagcctgtgtatgttctttgattggtggttcagtctctgagagctcccaaggtcccaggttagtttactctgttggtcttcctatagagttcctgtcccctttagggcctttaattcttcccccaactcctccacaagagtccctacctccacccaatgtttatctgtggatatctgaatctgttgtagtcagctgctgggtggaacctctcggggaacagctatgctaggctcctgtctgcaagcataagcagagtatcattaatagtgtcaaggattggtgcttacccatggactgggtctcaagttggaccagttattgattggccattccctcagtctctgttccatccttcatccctgaatctcttttcagacaggataaattttgggttgaaagctttgtgtgtggattggtgtccccatccctccattggtagttctgcctgactacaggaggtggcctcttcagaaccctcaggggggttgtctatttattgttataggacagatgctcagtatgtgtctgtcttagttcattagagctaggaatgcgtcacagtttagagttgctcaggcttggggatgcatgtacagacttaattggttaagcatccttgatctgactatttgaaatctgagcatttctcagcagtaccatgatgctttaaaaaatttggaatatggagcatttcagatttcaaaactttctattaagaatgattaacctggggctggtgagatggctcagtggttaagagcgccgactgctcttccgaaggtcctgagttcaaatcccagcagccacatggtggcacacaaccatccccaacgaaatctgattcccttttctggagtatctgaggacagctgcagtgtacttacatatagtaaataaataaatgttaaaaaaaaaaaaaaaaagaatgattaacctaaaaataagcaaagaaaataaaacacagcagggaaagggggaaaaaaagaatgcttaactttggttaaagagttgagaggtctaaagagaagcaagtgtttctggttttaaaatgttcagaaaagccagactacatttgggaggctgaagcatagggatcatataaatttctaggccaaagctgggtgtggtggcgcacttgggaggcagcggcaggtgaatttctgagttcgaggccagcctggtctacagagtgagttccacaacagccagggctatacagagaaaccctgtctcaaaaaaccaaaaatgaatgaatcaatgaatgaatgaatgaataaatttctaggctggcctgagccagaatatgctacatatttaaacctttcttccaagtaaataaaaataaaatactcagaaaaacaggttcctactaggtgaaaaatagtggatgaataacatgggtgtagaccagtctagagaatcatgagagcttatatgccccaagcataaattaattaaattttagccaaactatacattaaagaactcattggtcacaactgccaataaccacatggatggatctcaggaatgtcataatgattgggaaaagcaagttatagaagaatctcaatggtaaatttcatttatttttagttcccagattacttcttaaacaatgttcttcagaattaaatgtggtaaaatgaatttttataaaaataacatggtatacataaaatttaggaagatactggattctttgaatgaggaaagatggggatcagacaaagaaggggcacacaggaattttcaacataatgacagtgccattcttctggattaaatggtggacgtgtgggcacttactgtttcattctttacaccttaatatattttataacctttgttttatgtattcagtattgaagaaagacaagaaaaagaaacttgatattaaaaattgtatcccacataagcaaactctacttattattgacattttctaatttaaatatgcatgggtgctttacccacatgtatatctgtgcaccggagtgtgtctggtactcatggagcccagattcctgtggaactgaagttaaagaaagttacctgctgtcatgtagctactaggaattgaacccaggtcttctggaagaacagccggtgttcttaaccactgagccatctctccagctctgggtatgtttatgggagagtttctagactgttatttggggtagaaagagatgccctaaatgtgaacggcaccattccatgggctggcaagctgaacatcaatgttcattgttgtttcctgactgcagatacaatgtgactagctgtctaatgcttttaccatcatgttatactattaaccaaccagcaaaacaaacaaaaagcacatgttttctttcctaaattacttttgtcagatattttatcacaagaagaaaagtaacttgcacaaaaaggtattttgcataggtcaaaataagcatctcattgctctaaatcatttgctcatagaaaaccaggaatatttaattgtttttgtctaggagccattcccatagacttctctggcagacgcactgtatggttatccactcccatagataattgaccgtagggcaccctgtgttgactattcagccgtgttttgtcaccaccatttgttaataggctttattatctgagcttttttatctgaacttttccatgtaaaggataattgaaaacatcaagagatacctggtcctataggtatatgtatttacccactccgtaatactatatgtttaagtcttatcaaaggatcatttgaatttggatcaacttttaagcctttctctttagttcatttcagttttaaagaattataagtaccctttcatccacatttgttttatcatctcatcccctctatcagtagacatattccattatctcccagaacttttgaaagtaagttgctgacaatatgtccctcaaaaacaaaggcattcttttatttactatgaaggttgatcttcattgtcaacttgtttagatttggaatcacctaagagacacacctctgggcatgtgtttgagggagtctctaaagaggtttagcatatgttagcatattctgtttattaatgaagggttaggatagttgaatatacacagaatttcttcccaaataatctattctcacttaaagggtagaaggggtttgttccgggtttttttttattggacattttatttacattttaaatgttatcccctttcccaatcccccctagaagtcccctattgcatccccctccccctgattctatgagagtgttcccccacccaccctcccactcctgcctccccaccctcgcattcccatacactggggcattgagctttcacaggaccaagggcctctcctcctgttgatgtccaacaaggccatccttagctacatatgcggctggagccatgggtccctccatgtgtactctttggttggtggtttagtccctgggagctctgcggggtctggttggttgatattgttgttcttcctatggggttgcaaaccccttcagctccttaagtcctttctctaactcctccactgagctcagttcaatggttagctgcaaacatccgcctctgtatttgtaaggctctggcagagcctctcaggagacagctatatcaggctcctgtcagcaagcatttcttggcatctgcaatagtgtctgggtttcgtgactgtatatgggatggatccctaggtggggcagtctctggatggtctttccttcagtctctgctccacaccttgtctccatatttcttcccatgagtattttgttccccttctaaaaaggaccgaagcatccacactttggtcttccttcttcatgagtttcatgtgatctgtgaattttatcttggttattcctagcttctgggctaatatccacttatcagtgagtgcatgccatgtgtgttcttttgtgattagattacctcactctggatgatatttctagttccattcatttgcctaagaatttcatgaattaattgcttttaatagctgagtagtattgcattatgtaaatgtatcacattttctgtatccattcctcttttgagggacttctgggttctttccagcttctggctattataaatagggctgctatgaacatagtagagcatgtgtccttattaccagttggaacatcttctgggtatatgcccaggagaggtattgctggatctacgagtagtactatgtccagttttctgaggaacctccagattgacttccagagtggttgttacaagcttgcaatccccccagcaatggaggagtgttcctctttctccacatccttgccagcatctgctgtcagctgagtttttaatcttagccattctgtctggtgtgaggtagaatctcagggttgttttgatttgcatttccctgatgactaaggatgttgaacatttcttttggtgtttctcagccattcggtattccttagaagagaattctttagttagttctgtgccccattttttttagaggcttctttttctttttttttttaattagatatttttattagatattttcttcacttacatttcaaatgctatcctgaaagtcctctataccctccccctgccttgctccccaacccacccactcctgcttcctggccctggtgttcccctgtactggggcatataatcttcacaagacctaggacctctcctcccatttatggcctactaggccatcctctgctacatatgcaactagagacacaagctctgggggggggggtactggttagttcatattgttgttcctcctataggactgcaaacccctttagcttcttgggtactttctctagctccttcattgggggctctgtgttccatccaatagatgactgtgagcatccacttctgtgtttgccaggcactggcatagactcacaggagacagctttattagggtcctgtcagcaaaatcttgttggtatatgcaatagtgtctgggtttggtggttgtttatgggatggatccctaggtggggcagtctctggatgttccttcattccgtctcatatctgaactttgtttctgtaactccttccatgggtattttgttcttcattctaagaaggaacaaaatatccacactttggtcttccttcttcttgagcttcatgtgttttgcaaattgtatcttgggtattctaagtttctgggctaatatccacttatcagtgagtgcatatcaagtgagttcttttgtgattgagttatctcactcaggatggtatcctccagatacattcatttgcctaagaattctataaattcgttgtttttaatagctgagtagtactccattgtgtaaatgtaccacattttctgtatccattcctttgctgagggacatctgggttctttccagcttctggctattataaataaggctgctatgaacatagtggagcatgtgtccttattaccagttagaacatcttctgggtatatgcccaggagaggaattgttggatcttccagtagtactatgtctaattttctgaaaccgctagactgatttccagaggggttgtaccagcttgcaatctcaccagcaatggaagagtgttcctctttctccatatcctcgccagcatctgctgtcagctgaatttttgatcttagccattctgactggtgtgaggtagaatctcagggttgttttgatttacatttccctgatgattaaggatgttgaacatttttttcaggtgcatctcagccatttggtattcctcagttgaaaattctttgtttagctctgtaccccatttttaatggggttatttgattttctggagtccagcctcttgagttctttgtatttattggatattagccctcttttggatgtaggattggtaaagatcttttcccaatctgttggtgacctttttgtcttattgacagtgtcctttgccttatagaagctttgcaattttatgaggtcccatttgtcaatttttgatcttagaacttaggctactggtgttctgttcaggaaattttcccctgtgcccatgtacttgaggctcttccccactttctcttctattagtttcagtgtatctggttttatgtggaagtccttgatccacttgggcttgagctttgaacaaggagataaaaacagttcgaagtatggcattgtgcaagtagacttggtactagaagagccaagttctaagtcttgatctgaaggcagcagaggggaatatatatgagacttcacggtctcatcttttccaacatggtcacacctcctaatagtgccacttgatgttggccaaactttcaaacacatgagtctatgtgggtctttttttttctgacaataaagtttgaaataaataaaataaaaccagtttgtctattgccatatgctgaaaccaaatccaactctaatgttcatctaaaaggaaggtataggaaatgttcaatattgtgtcttaatttgttttacattaaaataacaaaatgtttgaagcttgatgtttcgtaaagaaatgaggtttggtttggatcacagactttggaggcatagtagatgaagagcatatagtgccagcattcccttgtcttctggtgaggcactcgtgctgcatgggagaaaagacgaagaaaactaggcacatatgaaaggtcctgcatatgtgaggcagggaacgctgctccccactcctaacacatccttataggaaataatccgatcccagaaagtgtagcttactgggccagtagggtgattcattctttgtatgaaggcatttgccacccaaatctggaaacctgtgtttagtgccaggagcccacataaaggcgaaaggaaagaccccacaaaattgtcctctgaacttacatgtgcaccacagcatggacacacacatcttttgttgaataatcatatccaaaccatgttactatcctgtcctaaacattgccacacacacacaaaaatgagtttagggcagggtattaccaggtagatttcttaaaatatttctctttcttccaagaccatcttacaggtaccatgtatttctttcaggatgactctgggaagtatattctaaactctacaattaattctatagaaggttgaagttatttagtttcctggaacaaaatttcttaggaaaagttctatgatcaagctctgtatctgttatgccccacttttgttttccaggataacttcaaaaacatatccacagtcgccaaagacagcgaagcccacatacttagggtctcctgtgaagtattactttccacccattgcaaacgaagaaacaccaaagaagaaggcagagaaggagaagagaaataaggaaaaggaaggtgcccctggtcagcagagcactgtcctacctagagaagaaagcctagagaagcgcatggctgacaagtatgccaccgagaagtatgtagcagataagcatgcaactgagaaacattctgcccctggaggaaaggctgagcacagtgcaggtaaagtggccctgttgatgttgccagttagacttagctttcccctcattgttccctctctgtcctgagctgtgtatcacactctcatggtttggggttttcctctaggacaacttcatccccttatactgctttttcaggtttgctcataatttttgaatcctcctttttttctgagtagacctagaccttgactctgcttgtgactaagatttcataggagtgctaagatgagccacatacagcctgtatgtgtacttttgcatgacaaagcactagctttagtccttgaagtctctgtcatgcaatgagttcattaataacttagtattgtagaacttgcttgtagccctgtactcgactatttcctgcccctactgtggagtgaacacacccagggacaagctagcccattgcagcttcttctgcttagtgaccagttttagcaccgttttgtattgtttgccatcaccatactgagttaaatagtattgtgtccatttctatgtgagtggacttgtgttcattccccctgatctttttatttatgtattttttgctaccatttgtctgactgcctcaggaaaacccacagcaggcaccactgatgcaggagaggctgcaaagatcctagctgaaaagagacgtcaggctcggctacagaaggaacaagaggagcaagagcgactggaaaaggaagaacgagaaaggtatacagacacttagatttgtgtaatctattgtaaaggtggggttggaaaaatagcttgcttttctttttacaatttttatgttgccaaaacctggacagaagtattggaatctagattgtatggactacagagaaggtgcttaggagactgcatcttcttctatatgttactaacagttgctcttttctgaggacctagaaattcacatttacaggatctaaatggtacaggtaccttcttttcccttcatagatatagaaatgaggcaactctagtagaactatagggagagtttgaacttttatgatacattgagtctttctggaaagatagaagatactagatatagagatcttgactctgcttcccaaatgatcctaacttgtgctcaaaagtcggggaggaaagagagtcaattagagtcccagagataagggctagagagaagaggcaagcccatgagaatgagttatgtggaaatcctcacctggaacaggacaaaggatgtcattgcagtggttctctaaagtgggaaacatagtggaaatgtgcttgctctagtctcatcctcccttagcagttcatcagggtttgaaagccactgtggtaatagtactagaacacttttctgtgatactggtagtcctgctttttctgatctttgtgttcagaaaggaaacaaattgttaaaggacaaggtcaatttaatcactacaaagagaaagaatgttcttgggataatcacagagtacaatcctgcaccatttagagaatgagaacatggcaggaagcaagcagtgctgtatcacaaggccagcactgaatttataataacaaataataaatattcctgatccttgagcaccttataaaaaatctttgtggtttctgattaaatgtttgttgatctatttttctaatagttgggtggtaggtcccttcttctgaacatctcttacatttttttcttcagccttttgattgatatcaacatgttttgttattgttggatgatgtattcaagctggtttgggtgggctggaggttaagtaagggaaattacaggtaataaatcatgggatttcgaatgacagattggtaaaagtagccacagagataacatccctattgctgtgtacttaagaactaattatataccttctagctactttctacactctcacagcccagctgcagaaagaatcattagctcctgtctttattttcccaactcaaacccttcacacttctacacaccctgcaatcattcattacccaattctttttttaatttttatttatttaatgtatgggtgctttgctgcatacacacctgcaggccagaagagggcatcagatcaccttatatagatggttgtgagccaccatgtggttgctgggaattgaactcacaacttctggaagaacagctcttaaccactgagccatctctccatccctacccaattcttcatttgattcttggtttcctttggctcgtggaacttgttcttgttttttattcttacttgttgtctctcctaaatgttgcctggacttcaggcccttagtacttaacgagctttttgcctgacaagtgtccccttcgcatagtggtgctagctaatgcccctgacatccttccagttttctctggcttcaaaatatttatggctgacagctgatgcagcagttttcatgcttagccacgaacttgctctcatttcccttcctgagtccatttcccctttaccttatgtttatcacctatttctgaagctaactgtaactttgttttgtaaaccttctctatacttttctgcaatatactgaagactcccaagtctgtgcctatgccctgaatttactctaaagctgcattttattataccaaaacatctagatatatgtgaattgaggaaaattcaattccttggccttattagccacatatcattgtttatttccacatagcatcattttataagtcattttattatctcagaaagttgttctataatgcaaatcctatactttcaaatgtatttaactgtgtctcacacttacctcacattcagcatttcaaaggcataaattagtatttgtcactcagacttcttattcatttcatgcactccatactcccatataccccatttccaacatctcagagctacttccaacgtttctgccatccttcatatcacatcagttatcagctaagtcttcattggctctcatgttaacgttctccccatgctcttccagcaccagataggtcatctagactatgtctgtagaatcttagctgagtgtttcagatctcccagagctgatgtccatgctgtttctagagtgactttcttaaatagatgtgattgtccttattagtgattcttttgactacagggtttatcaaagcctaccaaatctaccacggaccagccactccttgcctctctgccttctctgtctaggccagtctgcgaacctcctcatatgttccagtatgcagctccacaaccacacaaagctttctttagctgtgctttcacatgaactcatgttcctcgccatctgatgagtctttctttctcacgatgcaggtcaagtagctcctgcggcatttctggacctgtactggaaaaagaactgatctatttctctttacctttgagctaagcttccacatgactaacatagcctcatttgtgtacaggttgtctcccttttctggctaacatttttttttttttggtttttccagacagggtttctcagtatagccctggctgtcctggaactcactttgtagaccaggctggcctcgaactccgaaatccgcctgcctctgcctcccgagtgctgggattaaaggcatgtgccaccacgcccggcttctggctaacattttaaaaggccagagtacagtctttgatcactgttccttggtgctcagcgaagagaaagaagctcaactaaaatgctgccagtaacagcagtgggttaagtagactcccaggctaaaattttatagtgaaggagaagaaaatggtgtatacatactgagacaagtaaaaagaaaggggcaaattttgggggagatactaaggtttgatttgaagtatttaggaggatggtatgcccaaataatagaccatggaaaggtttttttaaaaacaagtctgaaaagctaaaaattaaccatctgattttagataaacataggtgcgtgcagaacacacaggtagttggaaatcaaatagaaccctgaggccaagatgaaattgagatgaatacatttaactccaaatcagttttcctctctcttgccagaatgtgaagcattgatagtgctacccgcaaggtgagaaaggaaagtagcagacagcctgaggctggaacacagcggacatctcttggaataggatcatcttcacatctgttttgtttagtgtcaatagtttaagtcacaaagctgtggttaccagttgagaaaatgtagcaaaagataaaaataaagatactcgtgct

SEQ ID NO: 349 - DNA, 264 bp, mus musculus
atggctaaacatctgaaattcattgccaggactttgatggttcaggaggggaatgtggaaggtgcctacaggaccctgaacagaaccctcaccactgatgggtgtactgaagtcataaagcgacgactgtactaagagaagccttgctgccgtggccagcgggagagctatgaaacataccagaggatctacaacatggaaatggctcgaaagattaatttctcgatgcaaaagaacggtgcagacccgtggctgggctgctga

SEQ ID NO: 350 - DNA, 140 bp, mus musculus
ttcgagccatttccatgttgtagatcctctggtatgtttcatagctctcccgctggccacggcagcaaggcttctcttagtacagtcgtcgctttatgacttcagtacacccatcagtggtgagggttctgttcagggtc

SEQ ID NO: 351 - DNA, 350836 bp, mus musculus
cgggcgggcggagccgctgagcttcgccgcggcggggaggaggggagagcaggctccgaggcggctgcagggcactgggctgggcggtgctttttttcttttcttttcttttctttctttctttttttttcttcttcttcttctttttttttttttttcgcaatttccactcgcagagagcaggaaacccggagcagccgggtgcagtggggccgcgatgcagcagcagcagcagcaggagtcgccccagggtagcagcggcagcagcagcagaggcagtagcgggcggcgctgagctgccaccaccgccgctgaggacgaagccggcccagcagcagccgcgtcccgacgctcgcgcccccgatccctgcgccgcgacctcggcgctccgaacccaacgcccggttccgccaactttcacgctgcttcggcggctcggctcgtcttggcgccaatgggtgagtgcaggggccgttcgaaccttcagcccatctgtgtgtaggggtcgactggcgcgcccatcccgggaccgcggacccggggagggcgccctggagcagggccgggagagtgacatcgcgcagagcgccctccctcgccttgcgcacccccattcactctcacttgctttagtgtccctgcggagcccgcgcgcggcacggactggaacccgagggggcctgagcagagaatcgcgggggctagctccggggctgcttgggttgagggagtcagggggtgtggttggcttcttcgggtgggcggggagagttttgtctttgccattctcccacccaagtgcaccctccctggcgctgtggacccgggtaccaggatttggtgggctctggccctgtacagggctcttgggccagcctgagaagagccttgaaggtcggggtctctgggagagggttagactgtctttactgcctgatgatgccggtggtgggaggttaggaaacgccccagtaccgggcatggcgggctgtcccagggtcctgagctcttcatgcgttccccacttgtgcctccacctctcactctgtcttcccccacgccgaacccctctccactctgttacactcaaaggctacttcctatatcctcctctcagtctgcagggccaggaactggaaatggtgatccagtttttgatgcacctagcaagcataatttccatgtaggcagctaaccttagctcttcaggatcctttttattatagacctgacagtgtggaaaccaccttactgcccaggggaactggcactttactgagcaaaggacttgtgactgtctggtctctagtaaacgtttgctttatctaggtactagccttgctcattggtcagcctttgcttgttatgcctctagcatatgatttttggggtgtttctaggccaagcatagcagtttgcacattataatgaatcgttataaagtgagactttttgtatgcaggtaataggatcttacactagccagcaagaaataggcaggagtcaaagggtgctaacccagtaagttgttcattagtgaagttcaattcccttttgtgattgtttaccaaaatgtctttccctttgtcaaagtggtagtgactgggtggcctctcagcttaagtgcccttttctgatgatcacagcactctaggtctaaatgagttcctttatcgtatgacattttttttccacatcagaatgacatattccagtgtgtttaacatttatctcctctacccgaggctcagtgaccgttgggacagcattgtgttgtatggtactgctcagaatggtttttcttccatgcctggtgtagaatcggctcagaatcaatatcgaatagatgggtggatggcatgaaactccgtggaagacacaacacttaattcatactcttgctttgccttgatgaagatgacttagcccattggcaaaagaaaatactttaaaacccttgtggaaaatggtcattgtggaaatgcagcgatttcttctgaggtgataaggaatgttttggggatcacttttcctttggggtggattactgaaagagttctgcacaaaaagaagtcgctggtctgcataggcaggctgtgctttgttgatctcaatgggaagaggatggaggctcctttaagaagcagcagacctgtttatcattgagatctaaactgtttgcattctttaggctctcttaagaaaatgagagagtgcttctgcaatttacagcccttttcagtatcattttaaaattgtagccattatgcaagtaggggtgcagcaaccaattattatttatttcaagagtttatatgtaaaggcaccaagagtaaaatgaatgccatttaattcattataatgtgcctaagtgggatttaaggtgcttgtagtttgtggacaaaaatcacctgctgttttctaaagtgtccttagtggtatatttgcaatgaaatacagatatttaatagttggttctatttgttttctaagagcaaaacctagtagtgctgggattctatgtacaccacacacacacacacacacacacacacacacacacagacacacacagacacatatatacagacacacacacacagaccacacacacatacacacacaccacacacatatcacacacacataccacacacatacacaaacacatatatacagacacacacacacatcacacagacacatacacacacacacatatacacagatacacacatcacacagacacatacacacacagagagacacagacacacatacacagacacacacacacagacacatacacacacagagacacagacacacatacatcacacagacacagatacacacacatgcacacagtccctttctccaaagctttctggttttcagaagatttctcttatttgtcaattgatatgcttgcttggcctgacgatgactttcctgctgatagctaacataatcaaatcataccatatagtccttgatctaatcactaagtgaaagtcacacaatccctaaccctgaagtgaagctggccggttgtgcagtggtctcttattgaactgggaggggcctacattgccagacacagggaaagcttcttatgattagagcagtgcaagtcctgtgacccaaatctggaggagcgaagggcttgcaagccaagcaaatgacttctgttgaaggctttccagaggaacagtgaagtttgtacagcttgaggcaatgctgtgtcagtggtcgactatgctaaaagaaagctaaagtgaatgcaatgctatgcctttcacaaacaaatcttgaattagacatggaagaaagggctctctctcctttacttttcagaacccagggcctgagtgaaaccttgctggttgcagactttggccatttctaattttacctctctagttacctttgccttactcatatttgttcataatgcttctgttcttagttttttgaagtatgctccatgcagtggtgaatatttgttcatctatccatccatctcaggtatcagtttccagctttgtgccaggaaacaggtgcatggtgcatttagacttacccacttaaactttttagtctagtggaggattttgagtgcaaaggttgcggcagcgtgtaagtaaaagctatagtaggtcgcctgaaagaagagaagaagaatctggtggaggccggggaactggggaagataatgtctttgaggagagcgtgagtcatcaccatcctcccgccacccacccttcctgggaagacacctggaattcaacaagctgagttttcttctccttgtacaccatgaggaccatggtgcctctgagcaagagggtatgagagaggctggctttggggtttttacctgggttaggtggtttgggggggggtgttggatgctgccaggactgtttctgtgatggagtcttttagcaaatgctctctagaacagggagaaattggagccaggcaaataggggttagtagagagcaggaggtatccacattagcaagaccgaaggatgtctgctcacatttgtggtctggacaaagcgtatgttttgtctatgttcaaacctgattgcagggtggctttgtttgtgtctggtcctgttctgaggctaggactctggaggattgtggatcttcaacagtacacccagactatgagaacccagccagttccccaatagtccgatcccttttgctcgttctcaaagttgaccagaggcggtggatgagaagcaagactttttagggtatgttccatgactgttactttaatatcagctagctgtagccttagaatttttgtttaatattgagaaaatgagcaactggaaagctataccaggaaatatatggaataatacacagcaggctcctgggaacgtgagaaagcaacagtaccagaaaatgccagaatccttatagtgttagaggagagctgctgacagtggtttgcagagggcagggccttgggattacttgagtgacaaaatccttcagtagtaattccagcagacctacaaaagtagagattctggacatggggtccaatggtcagcatttgaatacatcctccaagaaggtttttttttaattagtttttcagacatacatacacatgcaccatgatgtactcgtggcagtcagaggccaacttgtaggaatcatttctctccttctgccttgtaggtaccagggatggagctcagggggtcatgattgacagcaagtctctttaaatattgaaccatcttgccagctctggttctgataacagggccaagtatccaagctccttgcctttcggatgtttgctccctgcccactggagtatttgaagtactctgttcataacaagatgttctaggcattaggctgtgggtatctgggcagttgggaagcaacaatattcttcttactatatttatattaagtaggtttggcttttcctggtttctcctgggtaagtgaacattcataagtatcattttcttcctccttgaagagtctacttttggtcttaaactttagagttttaaaagctcattattaaaaatgccatgtgctgtaaattttcaaatatgtccccccccatatttgtgtattgaaaacttaatccaccaaaaatgttaatagtgtttggagttggagcctttgtaagacaaagagggttggatgaagtattgagagtgagcttccatgatggaattagtgtttttgtaagaacagaaagaagcctgttttgatgtcctccaccatggtatgaagcaacagaacagcccttactaggagccaggcaaccaccagtgccatgctcttggacttaacaacctttagaagaggaagccaagtaaacctctattctttatagattacccattccatggtatttggttacagcgatgggaaacagactcagacaccaccttcaagttccactttgcatatattattttcatctttggtcttcactgctgatttttgagacagctttgcccacttctatactttttttaaaaaagatttatttattatatatctaagtacagtgtagctgtcctcagacacatcagaaaagggcgtcaaatttcattatggatgcttgtgagacaccatgtggttgctgggatttgaactcaggaccttctgaagagcagtcagtgctcttaactgctgagccatctctccaaccccccacctctatacttttgacatggagcctgctttgcaccttggaggatgacctgtctctggcactgtgctgatggtacactagaatatgtccataccatggtaactcataaacaatgtgtctcctattcacaaaacacaccaacagtcctcagaatctttgaattaacttgaattgccttctgagtctgtgaaccccttttcttgacttcttactcccagttttctctactactcttgcaatctctagttgaaccctaagtgtatctctggagtaggcctcttatgagtttccccttgctgctgtaacagatgattacaaagacagtggcttcaaacaacaggtccaaactttaacatgagttttatagggtcaatatcaaggtgtagggagggctgcattctttctgtaggataattcttctcctcttgttcggtttcgattgctccttggatagtcttggttcataattgcatctttcctgcctctgctttcctatggtcacatctatcttatcctgccccccttcccagtataaagactgttagtcactacacccacttgagaatcggggtaccatcctattctctagaaccttatttaatgagtcacaggctctgagggttaggaaataaagtttttgagggggccattatgtagctgcaatacccctcattcatattgtgaagactgctccaaagattactgtacaatacttcatcttgtctgaagtctgtcatttccaactgggtaccccccccccccaggcttcactgccctggctccttgcctggcatacagcaagtgccatatgctaatgaattactgagtaaccctttcacccagtatggttactacttgcaattcctgcaactgtgaactaggggggcggggcgggagggagggagggagggagacagagaaagagagagagagagagagagagagagagagagagagagagagagagattgattctttaaaaccccctgggcaaagtaggttggcaaggtctgtttgcaagagctcctggaggtctaaagagtaacacctcaatgaagaactacaagtttcaagatagaaaattctcctcggtctctggaattgcaatgctggactatttctttctgtcatggcctgttccatttgccgatgaggctcagactcacataggcatagtgtgtgcctccctggcccccacagcaacccctgactctaatattgaggaagcagccatgcccaacttctaggttctctatcaatgtcaagctcccactttttaagtgctttttgttgtaatgtcttcacaacaaaagtgatgtgtatatgtgtgtctatgtatgtgtgtgtatatctatttatcatatctatctatctatctatctatctacccatctatccatggtactgaagattaaatccagggcttttgacttgctaggcaagggctcttgcactgagctagacccctaacccaatttttatatatgacaatttagtattttaagtttataatttagtaatataatattcagtgttctgcaaccagcaccactgcctagctttaaaactgttttaaggttgctcctccatagtacttttctaaagtgaggttcagaacctgtgtcttctaggggcttctgggcctgcttaataccttagagaacgtttgaaagccaaaggcacccacttgaggtttctaaaagaatacaagaaaaagaaagcatggtttggttgttttgaaaatgctttggctcttattttctctgggagacacttcttttgatttccctctaggtaccttccctatgtacaattcctgtcacctcagggtagaatttggctatatggttatatcctgaagtagttggtgtgagttgctagggtagtagcttatttggaaattgctgggatttattgagaatgcctgagtcctgggagaaaacactgcgatgccaaactgatcccttgatctcacacatccaggggtgatgacactcaacagcaaaggatacgtggatacgtgtcttttgggcaagtctgtccttttcattaggggatgcttaaaccaagcagattatagctctttacctcagtgataaattgtgcttacatttagctttaggaggaaaaaatatcagtaataataaaactcatgtgctgtttgttgagggcttgcttagttggcaagcaaagccctttgtttatatttttccttccattagccaagaaagtggctgggacaacccaggaggctagcctgtccccaagtggagggacagagaggcaagatgaagtgcagctcctcttgttactcccccaccatcttggattatatactattaatattttgatgctcattaatcactcattttgcatagcaaattttgatccttacatactgtggagcagtgtatatagacaatttaaattatcatctccttacactttagctccttactgatgcagcctgtatacaccaactcttgtgtttatactgaattttttttccttaggactcttctatactttgaagacttgaaaccctattctaggtctggtcctctgaggctataccagttttatccattacctgccacctccctgtgcacttgtaattagcttggtgtcctgtctaattattccagttagtcctcttattgtgtgttttagatcctgaagcagttgacatgagttacttgggaatcactaggatttgctaagatgcttagtcatgttttggacaagatctgggaaggccttccttgctttgctgtcctctctccttggccggcttccttatgaatcttcattgtcttcaccagatagttttgggagctgcctttgtctacacattgcttctgagtgaaatttatttgacttgagaggattcatgaatgaagtttgcctttctcctaccttggtcattaaaacaaaacaaaatcaccttttaaaacttgattgaaatgagatcattaaatcacttaacttggttttcagtgacctactgttcttggagaggtttcactgtggtacccagggtggtcttggagctccaggactcaacagatagccttgcccaagccttctgagtgacttggatcacagctactatgttgacttccagtcattctcccatggaaaataggtggcaacccagaagcagcccatcaatgaattaatttggatacctaaggcaggttgtgttgggtgtttctttattgatggtgagtttaagctacttttgaccctcagaaaacaactggaggaaagtcattttttggagggtcctggggaatggagttgggagggtaagaattgtcaccagtcaagagactgagagcgaggaacagttcacactctgctaatctgcttgcttggcatgagggctgcaaatgttggcttgagacctttaacatttattattattgttattgttgttgctgtaattttgtcttgagacaatttctcatgtagctcaggctgacttcaaactcgttaaactcctgatccttctgcctctacattgcaagtgctgagattgcaggcatacacgactatacttgtcttcaaacttaaaaaaatttttttaaattttatgtgtagaggtattttgtatgttactacatgtacttaaagatctgaatttgctatgcaaaatgtctgattaatgatcatcaaaatatttatagtatatttgtgtatcactttcatgtgtgttgcctgcagaaagccacacaagggcatctgatcacttggaactgaaattccagatgtttgtgagctgctaggtggttgctgggagttgaacctgggtcctctggaagagcagctagtattcatagctcctgagccatctctccagctcaacttaccactatttttaaaggtagagtttggaataaattatacatctacaatattccaaattctaaaggcaaatgatgtaaatatttgaaggccttactttgtttgaggagggcctcaatatgtgagacactcaagaaaacaaaacagaacaacaaaaagaccctatttcccattcatggcctccagatattctgtgacccttctcgtagattgttgatagtttgtttctggagttttctttcatgggaggtttcattcataggggtagatagttacctccatttccccctaatttcttttttctttctttctttctttttttctttctttctttttttttttttttttttttttggtttttcgagacagggtttctctgtgtagtcctggctgtcctggaactcactttgtagaccaggctggcctcaaactcagaaatccacctgcctctgcctcccaagtgctgggattaaaggcgtgcaccaccacgcctggcttcccctaattccttaatgtcataattgatggatggtgactacatttctacttcatttgtggtttatgctctctgaggatgtgttttacaattctatgtctgaatccatccatccatccatccatccatccatttatctttcctgtggtagggatagaacccaggacactgcatatgcatccaaagtacttttagtcagctgcacccctagctcacttaccctatttgataggacagtatgatgtttggaaaacttctctgagggactattataatctgaagatttgacttgtccacgatctaaactgataagagacttcatcctaattcttagctggtctagttctaagtttttagctgagataagaactatcttttcaaaaaaaaaaaaagaattgtcttttcattggtcttgatgtgtgtatatgtgtgtgcatgcatgtgtgagtgtgtgtgtatatacccagagcccactgatacagaaaatagggtatttattttcagatccagggtcctctcatgcagcccaaggatgcctactgaaggagagcctggaattgaggttaggccggcctagtggctgtctctccttcttgtccccattctttctatgcaacctgtttacagagcttacctgtgagcttccatgtgtgcatttggtttcttctcagttccaaatttctacttgtgaactctgagcccagtggaatctgaatccatccgtccctgcacatgggtggccactcttcaacccagggaggacagtacctagttgtaatcctcatggaaacatttaaagaggcctacttggtggcagacatatgtcaagtactagaggttccaggacacattgatagccctgaagtcctgccttgaagagcatcacctgctgtgctgggatgcttgtgggacatcccttgggacaggcacagccagaatatgtgccaagtgtctatttgtcctatctttctcttaacaaaggggtgacttatgaaagtcagtgtggcatctcctgtgtggagatgtggccattaagatggtcattctcaagccgggtggtggtggtgcaagcctttaattccagcacttgggaggcagaggcaggcagatttctgagttcgaggccagcctggtctacagagtgagttccaggacagccagggctacacagagaaaccctgtctcgaaaaaccaaaaaaaaaaaaaaaaagtcattctcttgaattgtgtgtgtgtgttttcatgtttctcctttgagagcctgtattgtttaactgagttcagtttctggttttgagttggtggcacttaaaagacatttggagtcacatggctgggttggtgatagcactccatggggacagagccctgttgtgacattgtctggttcattttagggaacctgtgggtttttacatggaggaagagatgaacctattgtgaaaaccagctacaggctgctgggttaacccctcaagctgctgtgagctccggaaaagggaccaagggactctcctatccagcttccctctggctggctgtttgtccctccctcctgccttcgcacccctcatatactctgttccctcaccacctcttgtccctcatctctctctcccttcctcccttcctgtgctcttccagcatcctcacattctgttttcctccacttctaaaaaaatatagttcctcttctccttatctcctctctgtcaccctgtctgtctccaagccccacccccactgtccacccaacctctcatcccatacagcctgagccccttcctcattcctgtccattccttcttcttcctctccgcccttctattatgcccagcttccccaccctcctcactcttcccctcccatctggtacatagcctacactccccccatcacatctctttttcttcatgtctccccttcccccatttttgagataggttctcactttttatcccagtctagcctctaagttacagcatttctgcctgagtctcccaagtgctatcattagaaatgtgtgccatctgagacgaaaggatggaccatctagaaactgccatatctggggatccaccccataatcagcttccaaacgctaacaccattgtatacactagcataattttgctgaaaggaccagatatagttgtctcttgtgaggctatgccggggcctagcaaacacaaaagtggatgctcaaagtcagctattggatggatcacagggcccccaatggaggagctagagaaagtacccaaggagctaaagggatccgaaaccctataggtggaacaacaatatgaactaaccagtaccccccagagctcgtgtctctagctgtatatgtatcagaaatggcctagttggccatcattggaaagagagggtcattggtcttgcaaactttatatgcctcagtacaggggaatgccagggccaagaagtgagagtgggagggtggggagtgggtgggggagcatgtgggggacttttgggatagcattggaaatgtaaatgaaataaatacctaattaaaaaaaaagaaatgtgtgccatcaccacagcttttttaaaaggcattttattagatattttcttcatttacatttcaaatgctatccccaaagccccctataccctccccccaccctgctccccaacccacccactcccgcttggttcttcctctaactcagctctctcccttgaaacccctttctttttccattctcccaacccgttggtctccaacagcccccatctctctcacatcctgttttttttttcctttaaaccctctcccacagaggagtcacatgtgcctcagattttcaactgatacccttatctttttggctcagtcttggagccagtgaaaatatctctgtggtctaaagttaagctggccatgtgcaaaaaggttgtgggaggccgtgtgctctttctatgggagagggagcttggaggctacccaccctttgcccccgcaggcagggctcctcaaaggcaggacaagctagtgtggggattagtgtgaggaagctcttcccagtggacagccagcctggagtctagggagcagtgagtgtcctctctcaggagtgtggaggacttaatctcctactgagggcctgggaaagtctagcgcactggttgttttctgactccagtgttagctaactttaaagatttttttatttataaacacataatggctttattgcagaaattagtaacttaccaaacaggagaacatcaatcaaccacccatacagttcttaatacaacccctatagttttattttggtatttttctttaaaaatctatatttacttttgtcagtgtgggatgattatttgtaggtcagatgacaagcttgggtgttggctctcaccttgcgccttgcatttgaggcaaggtagctctttgctgctatgccgtacactccacattcactgggctttgagtatgcttctgtttctacctcccatcttgccacaggattacagatacgttctggagatccaaactcaagttgtcttgcttgctcagggaggactcttaccagctgagccatctctcaagcccagcaaggatatttctttggggtatttttagtatataattatggatatatgtacatgatatgtgcacatacatgtatatcttcgtattttcacttaatttcatagtgctcttctaagctggtacttttagtagataaatatttgaactcatgtatcttaatttatgtggcaatttatttatcatctagcatttactttgtttctgtgatgtttgcattataagcaaggatacaaagttgttcccccttttaagatttaagtttattttgtagttatgcatatgtctatctctgtgtgattatgtgcccatgagggcaggtgcctgtggaggccagtagggggtgttgggtcacccggagctggagttataggaagttgtaggccacctgacatgggtgctgggaaccaaactcaagtcctctacaaaaacaacaaacacttaactgatgaggacgctttcctaccccattccgtggtaccattcatagttatttaccattgctcttacacagtaaaagctgaaacccctgggggcttgccttttcccttctctttctttctccttcccttccttctttccctttttactacctgactggtatttgcaggaactttgcttttaggaactacagagcaccatccatgcctaaaaacaatttatgctaaaagcagggcatggtggtatgcatgcctgtaatgtcagcacttaggaggcagaggcagggggatcgagtgcaagttccatgacaacctgacatacatagtaagacctaccccttctaaaaaaagagttcagtagtggacgtggtgtgtgtatctgtctttttagcactgggggagtagctacaggcagactgctgtgaatatgagtccagctacagcaataaagtgaggtccaggctagcatggactacagaatgaggtccagtcacaaaactaaaagacaaacaaacagctttaagctccaaagatgatcaagatgagtgactaaaaccagcatcgaggacccagtctgtagaaccatctcaaagccttgctcattgaataagttttattaatggacaatcttatgtaaatgatttgtttgcttacccaagtatccactaaatgtcagcttgcatacttgataaaaatgctagttgaatatttatgatggcctttcaggggcaagtttctgtgaaagttgtaaaatttatagatgttaaaaagccttagtagtaatgtgtaccataccctctcttctgttaccttatcaaattctaactctaacttgtgaatttgttgggtaaacataatagttgacttggtactgttatatattgggattcaattaacatagccaagtgtttattgggtgtttgttaactgtaagctttagaacagagggattggaagataatctgaagttccgcccatggacacattttgcttaactttcctttttctaattgggaggaaattgtgggtgtggtcatttcaggaaccacaaaaacagtagttgaaacagaagacctctgagcaaattctgcttatccagaaagaaggaaaagtgtccgtttcaggaaatcccatcagatttgaaaacacttttctgggctttaaccaactctagcggctgcaaaaactccctcctagttggagatttagagaaaatcaaaatagctttgctcaaataactaatgctgaagttccccttacaaggaaaatatttcccatgagcccctgttttgccttaaacttttgaacgtttattagcatttattgattttattgtggttaggtatgcatagcataaacttactgctttgggtgctggggagatggcttaggaaggggaaagtgcatagctgcatgaccctgatcacccaagatcagtttccagaactcatgtaaaaatatccagatatggtggtatgtatctgaagtcccagcacttctcggggtggaagtaggagaattgcctagaacctctccgggtggctagcttggagtactcagcagaaatgacaagagagaccctgctttaagaaggaggaatgcagccaggcagtggtggtgcatgcctttaatcctttcacttgggagacagaggcaggcggatttctgagttggaggccagcctggtttacagagtgagttccaggacagccaggactacacagagaaaccttgtcttgacaccccccccaaaaaaaaggaggaggaatgcaagaaccaactgtggcacatatgtaaaacacacacacacaacttccaagtatgaagctcagtgtagttaagtatattcacactgtggtacaccaacaccatcatctttcctaagtgaaacacttactatcttcctggtagctataattctatttcaggtctccatgaattttctctatacctcagatagatgcaatcataccatgagttcactgattcctttgtgactggcttatttcattcagcatattacctctaaggtttatccatctggtagcatgtgtcagaatttccttttaattgctttaaactatataataataacgttacttgaaaatgcaggcacttaactacgtataaactgattttgcttttagctcatttacaagtataaacctgaaatgaattcacaaattaagcataaattaagctgccgaagttcaaatcaacactcatagaggcatgatggtgtttcagagatgaagttgttgcttggcttcgtgacaggcgcttggtggaatctttcatgtatacttgtatctcctagtcttttcttctgtgttcaaagcgtagggagaatctgtcctacatacagttctcattgagtccttttcacatgctgcaagggatcaagagcacttctggatgcagatgggatatttgtgagctgcagcagacatcattgtcaatgtgtgattgtgatcctgttcttcattctgagaactcacatggtacatgcctgtgtttgatctttgtcctttctctctggcctggagggaacatctcctaggagtcttcttaatggtcatctttcccatttcagaaaaataattttatcattttcatatttatctccataacaaaggcatggctttgcttggttttagtttgataactggagttgaaactgcagagatttgagacttgcttgttgtgtctagcttttgagttaatttgttttcttccttccattgtctgagaatgtcacagtgtgtatgtgtcccatctccagctgctagacacatcagttccagcgttttcttatcaccattcttacagatgtctctggcacacatgtaaaatgtgtgtacttaaaagtgagaacaaggagtgattttgctgggtttcaagttggtggagttccagagtgtgtgcaacaagcgtttgttctaacgaatgaatgagctaaccaatgaatgaagaaggaaacaaaggaaaaatatctgcatattcagttttaaaggacaatttttagttgatcttcaaatttgtgtgtttccaaagtgtaaacatttctgctgctcacattctcaacaatatttgctgtcccagatgtcatctaagctgctttcccagagaacctcccttgccccctgaaaggtgttataatcttcttctttctcaagctactgctgatcagaagacaattcaggggccaaactgttaagctctgcaagggcattggaaccaggctccttctctgttattggcatagttgattctggctcttcagcaccagggcacctcccaccctgtggcagtgttcctttgttaaggaagctgctttcatcactatcagctattcccatagcaagaacacccacctcatggcaagaatatagttacggtcttaaatgcagttgcacatgtctatggcaaggtcatctccagaggtctggggaaagggctcagtcattaagactgcttgttgctcctccagagggttgagatttggttcgaataccaacatcggatggctcccaatcacatgtaactccagttcccaggaatcctgtatcctcttctggccactgcaggtacctctatgtgagcacacacacacacacacacacacacacacacacacacacacacgcacgcgcacacgaataaaaatgaaattaaaagagaaccataatctccagctgggcaaccatgtgccaaccaaacctgatggtgggggagtgcttgtttctgttgccataacaaattacaacaaactcagtggctatcccatagttctggagttcagaaattcaagatagagatgatccttgttcttgttttttccagcttcaagtgaccacctcctcacatcgccatgccctctgtttccttcatcacctctcctctgctggctcttctgccttccccttgcatcatttaaaatcttatggaattgcatagggcccgctgacctaatcaacaatattctcaccgtctcaagatctgaaatgtaacacatctgcaaagtctcttttgcagtgttgaggaacatattcacaggtactgggatttctgatgtgcacacagatgagagcagtggtcattgttctgtacaccattgggggaacaaagtgttctgtttctaaaaagaggaagagtaaaaatggggactggagatgattatcagttcatatgaccacaattttgtgagactcctggcggtgcatatttttttaaagcagtaaaattgtcaaagctggtgaacttgtcaaggacaggattttgtttttcaggagttcatgattcacagagttgaagtgttctcatattccccaaaacaaatcgtatttttgagatctacatcctttgtcactagtgaccgagacgtctgtcagttttcttttgccacattccatttgtagagggcatttccaattactcttctagttgtgttttcttgagtgctaagcagctaccaccatcacaatgattaaatgctgcgtgagtgtatcaagatcttcaggcatacttagagctccagtgtgttaaaaagaaagagaatgtggatggggaaatgcctcgatccctaaagggcacaagcgtgaagacctgaggttggaatctaagaatccacataaaaccaaatgcagtggcgcaccactgtaataatctcagtgcttctgtggtgagatggaacagggcgacaggggaatccacagaagctcctgggtcagcaagcctgttgtatgcacctgtctcaagcagaatagaagggacttgtacttgctttaggtgcacacacacacacacacacacacacacccctcataatagcacaccgaggccagggccctcctgtgtgccatgatcctttatcaggcatttgtgcacatagaaggtagattaaacaagctcctcttttctaatgccttttggctttcagtttgtgtgttcatctgttctgggtagggagggcggggagatacattggtactttttagcttgtgctatcagattggaatgtttgtgcagccccagattcactcatatgttaatgtcctagtacctaatgtggtcctatttggagatggtgcctttgggggagattaattacaggttcggtcatactccttgacacagcctgatttaaaaatctttatttttttgtcttttgtcattaattgcttccttctggccaccaagagccaagttagtaatcagtcatattcacatgcacccagttttgtacacattagaacaaactctctatagtgatgacttagggagtctctagttgccaacaagacttatttgtcctttgttggcgctagcagaacctacccacagcttccctgggctctgctgtctttgcatgttcaagtccctccttattgtccagggctcggtcttgggaaatcttggctttcagcttatagctgacagtttttgcttaggaggtggaagagaatagtacgcttgactacagtaagtcatgcatgtgcattccagtacttatgaaaaggaagaaatcaataggcaaagagctatttatttttgaggcgggtccgtgagacctcttattcactgttgttttccttggattgctgaaaaatggaagaatctgagcttcgtttgtggccatccctaattctgcttcctcctcctctccccaccctaacttagatgctttcggaagcatagaagaaggggtagacacatgttgaagagaagacacatgttggttgacaaaacccagggactttaaggaccccaaccttcatgctctgtgtacattgtccctgccccctggttgtcaggccatgataacagccttcaaattcacatggtgtgttacctataatgggtggcaaaaggaaaaaaaaactgttgaatgagaagaaacatgagtctaaaggcagagtatcattttcccaaaccagggtagaaatcatcatttaattacatgccttattggcttccattggcctgagattggtggtcaggtgcaactgagaaagtcattactgcctgtagtcttccttactgttggccatgttgtaaggcatatttatgtatttggaagtaatttccctgcaaatgacctaaaaaagtaggcatgggagaattttgacattgggatagaatttatgaccccccagatcacttgcctcatatgcatgggaatcttttcttggtccttgactcatcattaagagaagttccttttgtattgaaattaccaagagatgaccctattggtggtcagcctcctgtaaagctcggaccttgttgctgtctcctccgaagtttgccatagaaggttctactttatcagtttaagttgtggtcagccttcaggctttccacacttcctcttgggcctgtaatgaagcgaattcgtgtgcctggctgtgcagagtccatctcagatatgagaacccatgggctgatttctacagggcgttcatcctgcattttagggaagtgtagttggctggcctcaaatgagggatgtttttcttctttccttcactgactggactcaaactttttatcttgaaccagacactgccatttacagcagagttcatttcttttcattagggagtaattgcttaaaaaatgcctctccccccccgcccccccccccccccgctaaaaacacagtctttcatcttctaaactggcagtggaagctcccatcagctggcctcacatgcaaacagtctgtaatggtggagatggtagtaggatgctgagtctctttggattgtcttgaatgttgacaatgaatgttgagtgaacctgctttggatgttatgtgtgtccactcctttagggaccatctcatgtgtcctagacagctctacctttggatgttagtacactttggagaacgggaggagccatatgtctgcttcctaggcaactgagacttactgaaagtagagcttaagtggcccaactgtcctggcattggaaatcattactttttatttttaggttatcctctgttagccctaactcctttcaagtgcaggcaactggaatcaatgagcaagacctttgtcagatgggccctatctgagtttaaactttccctctcagttagttggaaggagtttaggagacccaaattgaacgaaagaacagtgctaatttccatgtttgctctcttttagccgaatctgccatttaaggagggttctgtctccctgtggatttagggtactcactacaagaaaatgatgttcaaaagagttcattctggctctttacgagctcatggcaccagctaaaccaatagccataagaacagtttgcattaaaaaaaaaaaaaaaaacccaaccctttgaggctcctgaagagcaagcaaccctgagactgggactcagacactgtgagcttcagtgggtctcaaaaggaaattggtgtcatcatctctagttgcaaagtgttgcgttaaatgataagaagaggcttaccttgcattgctcattgcctaagtaataatcttattttactatccccgttcttgcccaccttcacttacaaaaataactctgagtgggttttctttttaaagatttgtgtcaaactgatacctcataaaatggcacaagcaaagtgttctatttagaacctgtcctgtgacataaaaacacacgtgtttttagttattggactctggtttttggaattaaggctaggggaatgaagactgatagtagctatgggcatggagctaggttttcagacaagacatgaaaatgctgtggattttgcatagatagatttacttaagtaaaacttgcttattcattaggccccaaacatgctgctatggcatttcgtaagtaggactttatgtttcctattgctacctgttttatttacatatctcttgttgtgataagacattatgaccaaggcaacttacagaagaaataatttatttattttggggcttatggcttcggaggatgagtccatgatggcagagcaaaggtatggtggtggcaagaacagcagagagcttacactataatccataagtacagggcagaggcacacacacacacacacacacacagagagagagagagagagagagagacagagagagacagagagacagagagagagagagagacaaggggagattttgaaagctcaaaacttgcccccaatgacacacccaataaggccacacctcctaatgcttctcaaaacagtttcgtaaactaaagagcaagcatccaaatctatgtgccaatgggggccattcttattcaaagcaccacactgccctaacaaattactacaaacccaacacaagtgtattgtctcccagttctataggagtctgatgtgggtctcatgtgtttagtatgaaggtattgacagggctgtgtttcttactgggaactagtgaaaaatctcttgtttttgaccccagctgctcatgtttcctttctgagtcttcaaagaaggtgaactctgctagcatctcaccactctgacctctttcagtgtgtcttccataatgtgagattcacctggagaatccaggttaattaatctccccattttaatgccaactgactggcaaccttgttggcaacttgctggttattcacaggtccttggaatttcatatgtgggcagtgttggggatgcattactctagatagtttactggggactttttgttctcatcacgtagtgggcaatggtgtcagtagcagctcatggtggaggatagcttccgtctttacagcactgcaggaaattaagaaggtgcagttctcagaccatggctcatgagaggcaggctgccctcgggctagagcctcacggtggcgtgctgttaaaggggggcatggagtggagctgacgagtcacagctgggctggccagccagtgagtaaggaggaagcaggaagatgaagacaggaaatggcagtcgagtcagtcccttgggagaaagaaaatagaagatggggttggctacatttgacctaaagaaaggaaaaagaggggccttttttatcctgtgctttggaactggttcctctcttgaggttatgcggagactctagactgaatacatttggtctctgtttagatacgggttgtgcttttgccaccgaaacacaaaggcttcaagcatgagcgctgagtcttgcagtggggggtagggagagcagcagcccatgtaatctagtcccaggagagctctgctctgggggttgcaaacggacttgtacagattcacagagccttggccgttttctcagactcctaaggtagactctgctgtgaactgacctatgctgggttgtactttgaagaactgtcatgctctcctgggacacaatagaagggaactttgagggtcatttcccacagccttatgatcagagaatattctagccacgcccgactcgtgttagtcggaaggcacagggaagctgtgctaagttcccagtcacagtgtctctgtgtgacagtggcagaattcagctaacccccagaaggaggccagggcttttattttctagccaaacatgggcccggacacagtactttctgaagagggcagagtgctgagctttgtagattcttcgctgtagttcttacaagaatcagcatgccattacagtgttttccccagttcatgggtcacagggccattgctcatgttgatggttcatcagctgcagccagtaaactctgattagtctttcctgctggcccaccatgcctgggaggggcatttgtttctgatatgagtacttcgagtgtgaatccagcatttttggttaagaattaaagctaattaataaaccagaatatattttactgctttttttttgaaagcatgagttgatttttaacactttattttgaggggctagagagatgatggctcagcagttaagagcactgtctgttcttccagaggacctgggttcaattcccagcaaccacatggtggcccacacatgtctgcaactcagttccaggacttctgacaccctcacacagacacatatgaatgcaaaactccaatgtacataagttaaaagtaaattttaaaaactttattttgaacagacttcagtcttgcagaaaagatgcaaaagtgatattgggctttcacatagctcccacccagttttccgtatggttggctagcatctttcataatcatagttatgtttatgttcttgttagaattgggaaaccaacattggcataatactatttgttatattgaaagtattatataatgtcatcaggtttttgactggggtccttttaaaaaattcttgtcttgaatcctgtccagaatcttacctttcatttggttgttgttccatcctggactcccactgtctgtgacagttcctccatctgtcacgaccttgatagttctgaagcatattgattagttatttgggtaactgttctacaattgtgttttctcgtgactggattgaggttacttaaaaatcttatttcatttttgtgattaatataattagaacatttctccttttttcttctttttcttccctccctccaaattcacccatatacttgtctccactctccttcagctgaaagcttactgaataacttttaacaattttgaaatgaggagtttggtggcatcaagtatattcacaggtgtgttgttactattctcaggacatttccataactctcatatagtctatctcatctatcctatcctcgattagtagttagtctccaaatgacccctcctctggcctctcttcactgctagtctccttgctgattctatgattgttgcctagtccatgttccttatgtaggtagcatcatagtgtttactagtctgtgtcttgcctctttgacttagctttcaaggatcctccatttgacaatgtgttggcttggccatggtgtctcttccacagcaataaaaccctaacttgggcagtagagagacagcaggataggattcacgatcacaattcactgcggtggagggcaggctggggagaagctagcacattctgcaaccccaaagccaagagagaacagctgagttggaaatgaaggcactttagtcttctcagtgtttttacatctttgtgactgcatttcctaacaagaaatgatatattcataatatatagtgtagtattgtgtattacatgtaatacttagtatgctccatgtagaagcaggaggattgtgagttgaaggccagccttagtgaaaccatcttaagaaaaaggacatattttacattttgacctcatctttatttatgcttgaagtttgtgattacaccacaagtatttgataaaaatctgttattttatatttctttctattccattagggaaaaaagaaacctgtttcttgtgaccatgcttagtcttagcctgaaagtacctttgtacacaaaggcatgtggttgctgggaacagaacccgggtcctctgtaagagcagccagtgagtgctcttaaccactgagccatctatccagcccccccattttttttcacactgtgcttttcctggtccaaattattcatatgcttttgtttgttgcatattttggcagttgacaccaatctatgtggaatgccatgattaaatataaaacaaatcactgagaacttttgattgagactggaataaattgtgtagtaaagtttacatgcatggaaaaaaaaatttgttttttggaagcaagatctagatttgcttttagttctgtgattctgtcattccttccttctgtcattttatttttagctttttgagaccaggtttctctgtgtattgctgactggtctggaactcagtatgtagcccaagctcgccttaaacacagagatctgcctgcctctgcttcccagttcttaggattaaagtcttggatatgagcacacccagctgtcctttttgtttgttagttaaggcttttgctttgtttcctctagcgtggcctagagctcactatgtggtacacgctagccttggacttgaagtgactgatcatcctgtctcagcctcccagatgctgggatcagaggcatgtatcatgatacccagatgctttgatgctcattctttcttataaaaaaaaaatcattttttgactatctagaaagatatcacctttaaaaaggaagaaaattgctatatctataaaagtttggtaaggcttggtattagtatataaagaagatgccattgttgttattaatagggatattttcccttgcactcacatttgctagagttccattgtttatgcagactttttttttaaggcagagtctcgtatagtccaggctgacattaagcttcctgtgtagccaagaccttgaactccctatcttcctgctaatacctcccaagtcctagaattatgggtgtctactaccatgcttcttttaagagataagttcttgctatgcagccaaggctgaaccttcaacttgccatcctccctgcctctgccctccacgtagctgagatgataggtacactcggctttatgtactcagacatttttattaacatcatataatgcatagtatatttcgttatggcatttcatgtatataatgtatttttatcatacttacctcccattaccctttcctgttcccatcttgctcctgttgacccccatcctgttctttcctagttagtcttctactttcctctatgcatgtgtttatttttggtgacccagtgagtcttattaggcttgcttaaaggaaccaggtgatggattatatataggagcattatatacaggcaaccattaactgcctgtaaatactcagggagggtggttcctcatgggccttgcattcccccagaaatggatgattgcaggcctagtcttgtgcagattatgtgctgattatcaccactactatgagatcaagcatgcaatagtgataccatgttccaaagacgacagtctttccttttttctacttttataatcttttcattctgtcttcaaccacagtccctgagcctgagagggagaggatgatgtgggatgctcctttctagctgagcagtctacagtcctagaggctagaagttcaaggtcaaatgtataaatacaacccgctgatgccatttttttggggggtattgttttgtatatatatggtttcagggctgaccctcttgtattggataaccaattaggggctcatctcttggtttattctgggtatctttttgtgtgtgggggtgtgtgcatgtgtttgtgtgagtgtgcatacttgtacttgtggctccacatggatgtgtgtatgtgtgagcatgtgggagccaaagggccaatggcaggtacttttagtagttacttacccccttatttttgaagctggcgatcatcaattctgtcaggctgtctgcctactgaattccaggcattcacctgtcattgcctacccagtgctggggtctttcacatgggtgctaagtatctaaacttggctcatcttgtgtatgtggcaagcactttcctgactgagctgtctcaccagcgctacattttctttatttcttaaaaaaaaaaaacaaaaagacttgttctattggatgagagcctaccctaaagacttcatcttaggcaattgtatctgtagcacccctgtttgccaggatgaccacattgtgaattattggggttaggaaacatgaacttgtcgaggaaacagtttaactcgtaacagcattgaaagcagatctgagcaaagctatgtcgcaaccatattggggggtgggcagcggcaggtgggcagtgagcaagtaggtacaaggcttgggggaatagatcagaagccaccttctgtattggcaaaagaagaaaagtgccagagaacagggccaaagtgatattgagaccttatgtagctatatggcagtacttaccaattagttatttttaaaagaaattattatttattatatgtatttgagtgttttgcctgcatctgtgtcagggcatcttatatgtgcagtgtccacagaaaccagaagtggggtgtcaggttccctagaactggatggagttaactgacacttgtgagctgtcacatgggtgccgagaaagaaacccagctcccctggaagagcagccagttctcttaaccactgagccatctctccaccatcagaaaccaaatgcttaactcaaaaacatacaggtagtttcttggagcagaactagttgggagaatggaagaaagagctttcccatgatagatcctatgatagtgatttgaatgtgtaagaggttgccagggggagttggataacaatggacctgcattgtctcggctgcttgtgttgacctgctcttgccatcaactgaggtaagtaaaggaagtgtgaaggctttaagtgccattaaaggcctctgttgacaggaaatgaagtcatgggctttctgggacccattagtatttcattctttgaaagaattcagtttttagctccttttaggagactgactttaatatactaaaagctatctgtgtgcgtgtgtgtgtgtatgtgtgtgtgtgtgtgtgtgtgtgtgtgagagagagagagagagagagagagagagagagagagagagagagagagattttctttctggtggggaataatgatggtgcgtagcttattacagtttttgaaatccttcagaaaatgactgctttctggcctgtgttgcagttactgatttgtaagaatgcaaaatgtcattaactctgaagttaattttattttggcaacaattgtttcatgtctgcttctgtgggggaacagtagtgatagagtttctcaccccctgttcaggaaaacttccctctttcccatgcaaacccctgccttttctttctgcattcctatgatgtggtagggggcagggaggggcatgcttcatgtctgcagaaagcccaaattcttccttctgaagtaaatgccttgtagtatgtgtccatcttgttaagtagccagtaagctagaagaaaaaggccagcaaaagaacagacaaggaaaaaatactatctggcatacagtccaactgaattatgctggttgttacatatgcaggactgtatgatcaatgtgtacattaagatgacaaaaaagggggctggcgagatggctcagtgggtaagagcacccgactgctcttccgaaggtccagagttcaaatcccagcaaccacatggtggctcacaaccatccgtaacaagatctgactccctcttctggtgtgtctgaagacagctacagtgtacttacatataataataaataaatcttaaaaaaaaagatgacaaaaaggagttcaattgtagtctatagtacatcattcaccattcacttgcatgctcttctcactgtatcatttctctagacagtcgtctttttccttgtatgtctatcactttaccagtagggactaagaggtattcaaatctgatttgcaatagtaagacataaaatatgtaataccactgaaagatttattagtctaagatggatcttggtaaattatggcctaaagtccaaagctaacctgctgattatttctggaaataaagttttattggaacacagccatgttcgttctttatgtgtattggctgtgactgattattgctttaacattggagttgaatatgcaacagaacagagggctcccaaagcctaactatttactatctagctttttaggggaaaaaatggtcgactcctggtctaaaataataattctcaggaggtggcacacgcctttaatcccagcccttgggaggcagaggcaggcggatttctgagttcgaggccagcctggtctacagagtgagttccaggacagccagagctatacagagaaaccctgtctcgaaaaaagaaaataaaataataattctcaagtttcccaagtaatggcttggtaagtagaagtgagccagtcgatctccagttagtaagtgtgagaaagaagtgatggctagcctgcagatggttttgagagtgtgaaggtggagagcatcttgcaaactaaggcgtaagaaatcagacttattagatgggagcatacagggagtcctcaagggaagagtggaagttgaacccagattagattctcagtatcaaactaagggcacattgtcatctttgagttccagaatcaagactgaacatcctgggaacatttggtatgtttcaaaggcaacattgttgtgcatgatcagtacttactccaggcttagtagacagtaaactctagtctggtacaccacttagctttcttgtctcatatgatggtcattctagatggatttgaaataacagctgtcatcctcagagtagatttaacctcaagagtcttcacaggttaccggtgccaggaaacttgtatggatgatccatcttccattttacttgaagatccttctggagagatctgtgagaaggacacaggacagaaatgtctgtagatgagaggaattgtggggttgtcatggcactgcctctttctttgctttagggcttctgtgctgtctaccattttgtcttggaacacatttgcacagaagtgtattttctattgtcaggaccagcagcttgaatatggctgtccagatagactttttcctgccactccttgctgtgccttgtcagtgtacactaattctaatgctttgacacttgtcacggactttgattccctgttctctcctaccaggatagcctgggcacacccgtgcagtgcttgtcttttgccctattttcgtgggcttggacctgccatgaagccgacacacaggactgttaccaaggctactatgtcttcccaattagtggtgcttctttttttttttacctttttcctctcacccactctttggacttttataaattaacaaacatacatttatggacacaggtagaaagggagggagaaaagaaaagggagggagggagggagggagggagggagagagagagagagagagagagagagagagagagagaggataggtcaattgattgataattaaaatgaatacaaaaaaatagttgtagtccattttgtacaaagcctattccagacttttctgttcacctgtctttactttcttcccacatttatcctctcaacagatgaccttgcttcctaggcagtgaaggtgtcagctccctggtgcccctcatcttcgtgcagtttcaccagttataacagagaactcttgatactcagagtcagcaaagcaaatacctttcttttcattctcccttcctgacttctctttgatgacatagtcaactcatattcctgttgttcattgtgataccttgtctcctgataatttcaataaattctgactggcttaagctgccattctaagaaaaccatcagctaaaactttataaaggctgtcagcttgatttggcctggtttcatatttgagcatactacttgtattcatgtagctttctgtgtgtggcctcaagttttgaggaatacctatctctggaaatctttattaactgaaaaatgtatgaacagaaagaggtgtaagaaaataggccttgagtccagactggcatgtatctgagatatcagttcctgagccttggacaagttctgggacttctaggagttaggttcttcttcctaacgagaaacaacaggaaccacccagcgtgtgcttgaggtgtcatggtggtacagcagagaggccctacctgtagccattttgtgcgcttggatttcaagggtccggagtttcaagaggatatggtggggatggcttgattttactctacagtgtctagttcctcagctgggaaggcttgaagctagaggtgtgtctggcctgtcagagaagtctaggcgttggagccccttcagtagtagttggtggctttgcagaatgaggcttgtcttaaagtgtcctaataagtaagtggaaatatcatatcaccacagaagtcgtactgccttactgtcttgcacttgatgatccaacattggtgatgagtatgttgatggctgggtcctgtctttatttatttattttttattaaacttaaagtctctattataaattatggcctttcccagaattcactgtataatcaaggctgggctttgaactcacagagtccacgtctgcttcttgggattcaaggcaagagccccatacccaacaaaggtacatattttaaaattgtgtatggagagttgtgcctgccactaattggcagtggatttcttgaagacaccctgagacacacagccaccacatggcctggtttgatacggtggtgggtgggcaggtgcgactaccatgtggtggagagttgggagagacagagaagcagaagagttggagcatgatgaggagaggagggactagaagcacggggtggtgaggaacagcctgctgtgagaagcctgcactgccacctgaggccatgtggggtttgttgtccctgaagcagcagcagcagactgtgtagatggccatggccccatattaccaccaaaggccatgtggatgttcatggcctgggttgcctcttagggccatcttgatgtctgaggcgctgcagagctggccccacccctcaccaactgaggttctcaggaaagctggtcctgcccattgcctgggtagaatgggagagctgatcctgagggtatgagagtgggtgagctggccccaccctttgcctgggcagtgcagaagagctggcaggctgaagaactcagcctcaggcccagactgaagggcactgaattagcccaccccagcatctactccatctgggaactgctatactgtttgaaggagctggtcctggagaaccaaagctacaagatctctatgacgcaggataacaacaggatatccgagaggagtcccagtgaggatccagtactgatagtgtagcagaagccagaggccttgaaccattgcaatgattcattgcaatgaacattttcaagtaaagctgtttaggtgaaaggctatataccgtgtgacacacagtgacacagctcaagtttcacggtgagatgggttttttgcttgcttgtttttatttttgttttctcttgtggggaaaggttgcaagggtggagagtggatatggagagatgggggagatgagtgtgattggggtgcatgatgtgaaattcgcaaaggataaaaagttaggaaaaactgtgtgtgtgtttgtgtgtgtgcatgcatatattcccgtgagtctagatgcacacagaggccaggagaaggcttcagatgtcctgtatctgaatttataggtggttgtgagccactgtataggtgctgtgaactaatcttaggtcttctgcaagcccaggaagtaatcttaactgctgagccatttctctagactcaggtcccatgcttgaagaacatggtggagagttcaatgatagaggaaggatcaagacacttggtgtctgcatatacgaatagttttttcattcaactagtatttatgaagtccttactatatgctaagtatatgggcagcactgaatatggaggcaaacatggcagacatacactctttgacaccccttagtttaccttctagcggagggcacagtagtaattacctgctgaaactagatctggagcaaagatcaggagcttctccttttatggaaaaatctggtgaatatcttggggtaattattattattattattattattattattgggtttcaatacaaagtttttctgtgtactcctggctgtcctggaactcactgtgtagaccaggctggcttcaaactcagagatctgcctgcctctgactcccaagtgctgggactaaaggcgttactgccaccattactgggctttctggatgtgcatattctattagatcagtttccccagtgagtgatgagggagggtgatcctcttagatttactgtggattccccagcagcttcctctttggttgcaattttgtagacctggcgacttggattcctgaaggcactctaagagcacccggcctcagatgcacactgtacacacctgactagttagttcagatgcacactgatgttttcctttctgaaaagggacttgagagtggtagaggtacatagattctcctgggggtcatcttcaatcatgtagcgatgcctttccattctgatatggagcagggtgtggggagggaggcaggagaggcgtctctccatggttgaagaggacctccaggagtatagaatagatgagcccttctccagctacactatggaacttgttacaaagctacctccatttcctagctttgggggaagtcaaggaatgctactagatagtcaaggtaagtggtatcaggcaggtccagatatatatacatacgggggccttctgtagttgctgggggttagttcccagagagtggggctctgaggactagccaggtgatccatcagtgtgtcagctttctgttactgtaatgaacacctaatacagatgggcttatagagaaacggtttgttttggttcacagttttgtggggttcagtttatgtggtcgtattgcttttaggactgtggtgcagcagcatatcagggtatggtgggacaaaaccacttagctagtggcagctgctaagaggaaaaatagagtctcagtttcctataacagcatgccccaaagatacaaaaccttttactaatctctatctcttaaaggttatattactctttagtagtgctacactgggaccaagcttttaatacatgggccttgggggaaacattttagacgaaacctagcaaccacatttctgcttgtatttcagaatggattcctagatcagagttctattaagaaccataaccatggaaatggtggtgtaggcctttaatcccagctctcaggaggcagaggcaggcagatgtttatgagtccaaggtcagcctgtttgacatgtttcaggacagccaagggtacctggtgaaaccctgtctcaaaaaaagaaaaatcttgctgaagggaccctggtatagctgtctcatatgaggctatgccagtacctggcaaatacagaagtggatgctcacagtcatctataagatggaacacagggctcccaatggaggagctagagaaagtacccaaggagctgatggggtctgcaaccctataggtggaacaacaatatgaactaaccagtaaccccagagctcgtgtctctagctgcatatgtagcagaagatggcctagtcggccatcactgggaagagaggccccttggtattgcaaactttatatgccccagtacaggggaatgccagggccaagaagtgggagtgggtgggtaggggagcagggcggggggagggtgtagtggctattcctggttgtcaacttgacaatatttggaatgaactacaatccggaattggaaggctcaccagtgacccttatctggaggcttggagatccttatctggatcttggtttgaagatcttgagccatagtggctatggattccagaagattgaatctccgagttaaggaacacacctttaatctgggctatgcctttcatctgggattaaaggtgtggtggaacacacctttaatctgggctacaccttttgctggagacaatataaggacattggaagaagggagtcttgctcttgctcttgctcctttgcctgcttgctgcgtgagactgagtaactgctagatccttggacttccattcacagctgcgactgaacaattgttgggaattgggctgccgactgtaagtcatcaataaattcttttactatctagagactatccataagttctgtgactctagagaaccctgactaatacagaagttggtaccagaagtggggtctagagtaacagaagtacaaggatgaatcttttaaaatactggaattggcttgttgatccaccagcactttcaaatattgaaacctctccagattctctccctcctgggagctcagagaattttgaagacccatggttgaaactatattccgaacttaaagaagctaatgcccttgattttcttaatgaattaggtgattcagtgcacaaagctttctacaagatggggaaaaaatcgaaaaatgattttactggctggctgctcttagtatctgtggaaaaaatgatgaatgaaaggaaggagttgtgtgataaaatcgaaaggctccagacacaagtaaacgatctaaaagttgctaagtgtgtccttgaggagaatcttctctcttgtagcaatagagctcaagttgcagaaaatcaaacagaaactctcattgtaaggttggctgaactacagagaaaattcaagtctcagcctcagagtgtgtcgacagttaaagtaagggctctaattggcaaagaatgggatcctacaacatgggacggggatgtgtgggaagaccatgttgaagctgagaattttgaatcctcagattctcaagggtttgccccacctgaggaagtagtaccctcagccccacctcttgaaataatgccttccccacatgaggaaattaattttgcagagtctgctcacggcccaccaatagtttcttctagacctgtaaccagactcaaagcaaaacaggctcctagaggggaggtagaaagtatagtccatgaggaaattcgctacactactaaggagcttaatgagtttgctaattcattcaagcagaaacctggtgaatatgtgtgggaatggattttaagggtgtgggataagggtggaaggaacataaaactagagcaggctgagtttattgacatgggtcctctgagtagagattctaggtttaatacggaagctcgcatagttaaaaaaggtgtcaaaagtttgtttgaatggttggctgaggtgtttatcaaaagatggcctactggaaatgacttggagatgcctgatattccgtggcttagtgttgatgaagggattttaagacttagggaaattgcaatgctagagtggatatattgtgtaaagcataattgtccacaatgggaaggtccagaagatatgcctttcaccagctctataagacgcaaattggtgagaggggcaccagcacatttgaagggttttgttctttcccttttccttgtgccagatcttagcattggagatgcttctgctcaattagatgaattaaattcactgggtttagttggatcccgaggtaacaagggccaggtggcagcattgaatcgccggagacaaggtgatcctagttattataatggacagcgtagacaaaagaatgtttataataacatacccagtaatggtcagcacaggagaggtgaaatttataatggcatgactcgcttggacctttggtactggctaatcaatcatggtgtttccaggaatgaaatacataggaagcctactgcatatttgtttgatctgtataagcagaaaaattctcaaacaaatgaaagaaaggctacattagatcgtggtaaacagcaatctcggccagtgaatcaatttccagacttgagacagtttgcagatccggaaccccttgaatgaaggggtggccaggttcctctgaggaaggatcttgataagacactcaaaggttttgctgttaccctttctccagttcttccccagagggacctacggccttttacaagggtaactgtacactggggaaaaggaaataatcagacttttcggggtctgctggatactggttctgagttgacactgatcccaggggatcccaagaaacattgtggccctccagttaaagtaggggcttatggagggcaggtaattaatggagttttgactgatgtccgactcacagtaggtccagtaggtccccggacacatcctgtggtgatttccccagttccagaatgtataattgggatagatatactcagaaattggcagaattctcatattggttccctgaactgtagagtgagggctattatggttggaaaggccaaatggaagcctttagagttgcctctgccaaagaaaatagtgaatcaaaaacagtatcgtattcctggaggaattgcagaaattactgccactatcaaggacttgaaagatgcaggggtggtggttcccaccacatctccatttaactctcctatctggccagtgcagaaaacagatggatcatggagaatgacagttgattatcgaaaactaaatcaggtagtaactccaattgcagctgctgtaccagatgtagtttcgttacttgagcaaattaacacatctcctggcacctggtatgcggctattgatctggcaaatgccttcttctcagtacctgtccataaggaccaccagaagcaatttgctttcagttggcaaggccaacagtataccttcacagttttgcctcaaggatatattaactctcctgccctgtgtcataatttagttagaagggatcttgatcgtttggatcttccacaaaatatcacattggtgcactatattgatgacattatgctgattggaccaagtgagcaggaagtagcaaccactttggactcattggtaacacatatgcgtatcagaggatgggaaataaatccaaccaaaattcaaggaccatctacctcagtgaaattcttaggagtccagtggtgtggggcatgcagagatattccttctaaggtgaaagataagttattgcacctggcccctcctacaaccaagaaagaagcacaacgtttagtgggtctatttggattctggagacaacacatccctcacttgggtgtgttacttaggcctatttaccaagtgactcggaaagctgctagctttgtgtggggcctggaacaggagaaggcccttcaacaggtccaggctgctgtgcaggctgctctaccacttggaccatatgacccagcagatccgatggtacttgaggtgtctgtggctgatagagatgctgtttggagcctctggcaggcccctgtaggtgaatcacagaaaaggcctttgggattttggagcaaagctctaccatcatctgcagacaactattctccctttgaaaaacagctcttggcctgctattgggccttagtggaaactgaacgtctgacaataggacaccaagtcactatgcgacctgaactacccatcatgagctgggtactatcagaccctgcaagtcataaagtgggacgtgcacagcagcagtctattatcaaatggaagtggtatatacgtgatcgggccagagcaggtcctgaaggcacaagcaagttacatgaagaagttgctcaaatgcctatggtttctactcctgttacaatgccatctgctgccaagcatgcacctatagcctcatggggtgttccctatgatcaactgactgaagaggagaagactagagcctggtttactgatggctctgcacgttatgcaggcaccacccagaagtggacagctgcagcattacaacccctttctgggacaaccttgaaagacacaggtgaagggaaatcttcacagtgggcagaacttcgggcagtacacatggtattacagtttgtttgcaagaagaaatggccagatgtacgattatacactgactcatgggctgtagccaatggattggctggatggtcagggacttggaaagatcacaattggaaaattggtgagaaagacatctggggaagaagtatgtggatagatctctccaaatgggcaaaggatgtgaagatatttgtgtcccatgtaaatgctcaccaaaaggtgacttcagctgaggaggagttcaataatcaagtggataagatgacccgttctgtggacaatcagcctctctccccagccatccctgtcattgctcaatgggcacatgaacaaagtggccatggtggtcgagatggaggttatgcttgggctcagcaacatgggcttccactcaccaaggctgacctggctacagctgctgctgattgccagatctgccaacagcagaaaccaacactgagccccagatatggcaccattcctcgaggtgaccagccagcaacctggtggcaggttgactacattggaccacttccttcgtggaaaggacagcgttttgttcttactggagtagatacttattctggttatggatttgcctttcctgcacgtaatgcctctgctaaaaccaccattcacggactgacagaatgcctcatctatcgtcatggtattccacacagtattgcttctgaccaaggaactcatttcacagccagagaagtacgacagtgggctcacgatcatggaattcactggtcttaccacattccccatcatcctgaagcagctgggctgatagaaagatggaatggccttttgaagacgcagttacagcgccaattaggtggtaacagcttggaaggctggggcagagttcttcagaaggcagtatatgctttgaatcagcgctcgatatatggtacagtttcacccatagccaggattcatgggtccaggaatcaaggggtggaaaacggaatagttccacttactatcactcctagtgaccctctaggaaaatttttgcttcctgtccccataactctaggttctgctggcttagaagttttggctccagagaggggagtgctcctaccaggagctacaacaaacatttcattgaactggaagctcagacttccccctggtcattttgggcttctaatgcccttaaaccaacaggctaaaaaaggaataacagtgttaggaggggtgatagatccagattaccatggggaaattggattacctcttcacaatggtggtaagcaagattatgtctggagtgcaggagatcccttagggcgtctcttagtactaccatgtcctgtgattaaagtcaatgggaaactacaacagcctaatccaagcaggatgacaaaggacgcagacccatcaggaatgaaggtatgggtcaatcctccaggaaaagagccaagacctgctgaggtgctggctgaaggtgaaggaaatacagaatgggtagtagaggaaggtagttataaataccaattaaggccacgtaaccagttgcagaaacgaggattataaagtaatatgaatgcccattgtaaatttactaatgcgtttgcgattgtacgagggatagttatatcatgttaggcgtatttacaaccttgttattgtttcatgtgaacatgagatattatttgtgtcaagttgacaaggggtggattgtagtggctattcctggttgtcaacttgacaatatttggaatgaactacaatccggaattggaaggctcaccagtgacccttatctggaggcttggagatccttatctggatcttggtttgaagatcttgagccatagtggctatggattccagaagattgaatctccgagttaaggaacacacctttaatctgggctatgcctttcatctgggattaaaggtgtggtggaacacacctttaatctgggctacaccttttgctggagacaatataaggacattggaagaagggagtcttgctcttgctcttgctcctttgcctgcttgctgcgtgagactgagtaactgctagatccttggacttccattcacagctgcgactgaacaattgttgggaattgggctgccgactgtaagtcatcaataaattcttttactatctagagactatccataagttctgtgactctagagaaccctgactaatacagagggtatagggaactttcgggatagcatttgaaatgtatataaagaaaatatctaattaaaaaaaaggaaagaaaaaccaaccaaccaaccaaacaactcaaacatatccatagcacaagtcatagccttccttgtataacacattactgaagaggcccaggtccaaaatgtatacagaattggccttgtccagtgtctacacaatagatatggtatagaacatatttgagtgtactcaattttttgaagacatgagaaaaatcaactgatgatattatttttttatgtgtgtgggtgttttgtccacacatatgtactacatatgtgcttggtatctgtggaggccagacatgtgcagcggataccctggagctggagttacaggtgattataagctgcctgatgtgggtgctgggaaccgaactcaggtcctctgaaagagccccaaatgctcttaactcttgagtcctctctccagctctgtttattactttttttttttaagtgcctaaaagtataccttgaaaaagaaattaggctgacagtgatagaactagcttgtaatcctagtacccagaaaactgaagtatcagaattacggctgctagcccaagactggcctggcctatatagtgagtaccaagctaggctccacagctagatctagtctgaaaacacaacaaaaggagttaggattaatcattaagcagcctccaaagaaaactgcttttccctctgccagaagaatctcaggatatattctgagtgcatcttttacagaggaatgattacaattttatttgatattattttatattttattatccatagaaaatgaactatagtactggaaaggaagttagttttgcatcatttccttctttcttcctttctttcttccttccttttctcttctcttctcttctcttctcttctcttctcttctcttctcttctcttctcttctcttctctctctctctctctctctctctctttctttcttttctttttttgtggtcaatctgggaatttgatccagtttaggttcagctaacaaataagcatattccacacttgatgacatgtttctggcatatggctggcgatacttggttatccatcttttttgtcagtgaccattgtccaagctcttgactacatttgaggttgtgtaattctttcatcctgtgtccacttattacctgttatactgctataacaagaaatacctccttgttagccattatcctgaatttatatatgaaaagcgggacagatattttgattcttaccttatttgctacttttcacagtaatgtgttggttcaccagcatcttgcaaaggtgatacaactgtagtagtctttgtgtgtgagtgtgtgtacatgtttttatgtatgtatgcatgtgtgcatgtatgcagggtcggggggcagagatcgagagcttgacagcaggtgtctctgctctccactttacttttttgttatttgtcttttgagacaacatttctctattatgtatctctggctatcctgaaaaactcacagagaaccctgcttctgcctctcaagtgctgggattaaaggcgtacacacacctaacaagtttacatttttatcttattatttgtcctttttctttaattttttgagatgctgtaaaaacatcatttctccttcccctttctcccttcaaattctcacctacccctccttgctctctttgaaatgtatggcctccttttgtttttcactaattgttgtaacatatatatccaggcttgctggtcagtgagctctaggcatttgcctcccttgtgtggatatcacatatgtgccactgcacctggctttttatgtgggtcctggggatctgaactcagagtctcatccttgcataacgagcactgtgctcacccatccttctcctcggcacccctttaatggcgtctttgttttcatggtgtggtggcaagatcagagttcaatgtctttattgctccttcctcaaaattcctcctggctggcttccttttagtgagaaatctaaatgtaaattgtcttggcaaaaggtactcgtcgagaactctctggtgtgctcctgttgacctttggtctatttatttttattaggatgtgtttcaattttggaaatggtttgaacagtttctgtagatcttactctatttgcctaactttactttttaaatatttatctgtcttatgtgcatagatgttttgcccgtatgtttatatgtatatagatcatgtgtgtcctcgcagaggtcagaagaggtcctcagatcccttggttagggatggctgtgagctaccatgtgggtgctgagaactaaactctagtgcgcttagtcccttcagccccctagtggtctacctttaaactacaccctctacgggaaagtaaaacgctggggttcaatccacttctgttttctaatactccgaggagatgcacatttattaagtgattttctcatacactgacggagcatttacaataatactgattaagaagacacacactcagtagatcttgcttattaactgttagttcagataattcaaacagttaaaaacattaaccaaatgaccaactctgggagtagttcacaatcactatgaagcatcattaatgaaacttatcctgagctgtccagtgtgtcctccctaatagcctttcccagtatagagttgtaaacatactagatgttctctcttggttagatgttagtgaactcaaagtagttagtgcttatgacagtttgcatttgtaggctgctttgaagagccactgttttgccgttatctgcttttagctttggctcaggtttcattttcttggatactcaacttttcatccaattcatccttgtgattctctccgctcagcggcaagcatgtcttgagtgcctgcaagtgtgcatgcaccaaagtgcatccctgggtgttgttcctcagccactgctctctctctcttctctctctcttctctctctctctctctctctctctctctctctctctctctccccccccccccagacaagcatcgcactggccttgaatttgtcaggtaggctagctgggctggccaacaagtcctaggggcctacttctctagcagcaagcacatagcaccatgctggctttttaacgtgagtgttgggaatctaacgctggtctttttgcttgcaaggcgatgctttattgcttcggttttcggtgtcttctccttctagggacttccagtagcagaattccacagctgtagtagaattcctacaatgggtatgtgctgggggcaggggaggtagtaatgaaacttcttttgaaagaggattttaaatgtgcttgaggaaggcaaggaagggtcagtgtggtttcctctcatcttgctgtctactttctctctgaccagacactggttcttttgttaacacagactgctctgtgactcagcccttgctctagctctgattgctcctactgagcacgttttcctgttgaaatgctctcaacttctctccttttgacctggatatggcctcttgcagctgattcggcttagctatcctgaagcatacatgtccatctgtaaagcccttttcccatcctcattatactctcctccagaaaagccagagtcatattgttacagtgcttatggtttcttccactaccaggctctatgaatgcattttcaataaaatagtttaagcaaagccttttagaggtattaaccacaataaaatatatttcaatcatctttaaactgtccgttaaacaaaattaattcacaaaatgagatagtgttttggaacaggaagcaatgttttcttattttattttgcataacctgtaattaattgatacaagcagatatttgtctgttgttctgttttaaagtttacatattctacttggtcccaaacctttggatacttctcactgtgaaaaatggaagatcttattctaatcaggaagttgtctggctctctttggaatgtgggattcagggtgtcattataaaatcatgaaaagctatgtatctttaagcggtattattactttaaacattactcagataaagctctgttcatgggtattcttccttatcgttgaataacaaagattatatcttccttaaatgtctgaagtgttttgactaaactgacattctttgtaaattagtttgctaggaggctatttactttcccttgaatggcttctgcagagaaccatcctctatacttactataacaaatagtctttagtctacactgtggttttaatcttcaaattcatctgtacctactttctgtgtttttccccttaaaacgaattttttttctggtcaacttgctcttatccagtttatctaatgcatcttcgagaagagcagcgtgctcggcttacaagagttagtttcagccctgaagtgtttactaatgcagtgttcctatgcacctgggtgtgtgtgtgttctagggccaggccctggggagcctgtggctttagaatacaggctgtgagttaccagaggtccaaggctttatgagttctttcctgtctacaccctgccttgagtgatctgaattttgattggatactcctctgctgttgggaacaatagtcaaggcagaggagggactgatcactgtagctcttgacacttccagactggtcaatcatactttgtagataacctggttgtgttaattgtgggctcttttagccttccagtcaaataaaagctcacatttgggactgtgtctttttgtgctgaatgagaagatagagtttgaaataaatgccttcttggggcattcctggagttgagctgatatacttgatcaccagcattgactgagtacctactgtgggctagatatcaggcaaggaagagattatactgagatctacattgtaagggttcccagtgggtaggcaatgagggaggcagatgcacagagaaatctcttacagtaaagcatggtaatagcctgtgagactagtggctgccagttgatagagcagcctttgtatagaagaagtttcagtgttcatccattatccttggaccagaccctcttccaatattaaaaacaaaaatgtgaactcaggcaaggtgttttgcctcatgccataaaatagtaaatatgtaggctggaattcacctttagggctatcaggtgttttcttatagctcctattatctatacaaggtgctggtggcctgggaggccagggttccttgagcgacaggaatattttcagtcaggaagtggtgggcctttttctctgttctgtgttgattcacaactccccctcccctgctgatgtccaattagtcctttgagctgttcttgggtccatgacagacctcactgtgttctagaagaagccatcctggcctgtgctcgattccctcatgctcagagtccatacccagtggctctgtcgttgggatctgagttctgagcccgtcttcctcagagaagctgctgataatttcctaccagagtcaggccttgggaatcatgtctttattgactttgtgcccttacttgtgtattcatgaagatcacaaaaaaaaaaaaaaacccaaaacaaaagaaaaaaacaaaaaacaaatgacgatcagcttgtgtgtgcagagcctcatagttcctgtgcccttgaggcggggaaattcaggtccctaagcccctaaccccagactctggtgagaaagcactgactagtgggaacttgaccttctgtagggaagaagctggtacagagtttgtgagttgtaagtaacagaaaccaagtgtctcttaatcaaagacggtgaatgattcatggaaaggctctggggtggcttatgtggtggaagaagtgtaggaaaagtggcaagcaggctgctttctgggagctctggtggagcgtgcactctagccatctccagctgctgtcacattgctggcagtcacttagcttctgtgcccatgcatgggctggcagagtattggacatgtcagctgcattctcatcaggttggatctcatggggggggggcttctccaaatggcttgcttccctggatggggagagtgggggctccctgggggtacctacatagtcaactacttgagcaaatactacagttacaagttcctaaatgtgggtcacatagtgtttccacttttatatttaaaagataaatttagctataacatttcgcatatggaagtgtacactgtgagattttttaaaaatctttttataagtttatagcattgtgcaattcttcccacagtttaagattaaaatgcttccatcaccccaaaagttcccgcatacccacctaatcagtccacatccctggctccaggcaaccattcatctattttctgtctctttagatttgaccagaggtttttatttgttcctgattgctataacttctggatatcgtagaaactctgctacatgggggaaggcaaggaagaagctcttccagtggtgcccaagtctgtatctgtcatttggaagagaggcaatgccaaatcttggtcatggaacattctagacctcagttcttcacctgcaaaattagaaaatgtatttgacaagatgatatctgatgttatttctatcatcagtaatcagcaattatgcttttctttttcatgagatcttttctggtgaaaattacttcttggttttctatattatcatcaaacaggatggaaagaaaactttaaaattaaaaaatgtatccatcagaatgagcacaatgaaaaaagtgtaaacccgcaagtatgtgacatttctacttctgaaatgattaaagcttaagctgtaaagtcacacctcctgagacctttgtgacaacatgtgtatgtgtatagaacaaaggaagttcactggaaattcccatcctcctccatgcttcctggttcattcacatatgtattgagtcacagaggatgctaggtcagggagccagaatcctgggataaataaaggacttttaccagatgaggcttgcaggctgcttggggtaagccagcatgaaatgcagctctaagtggagcaaagatagaggaagttcaggggcaagggaggaggggttgagccccacagtgggggggggggggctgtatcattgcctctgttccccatctatctgcttgacagctggcttagccaacctaacagttaaaaaacaaaacaaaacaaaacaacccaaaacaaaaacccacccattttgggggggaagacattcagcaagtttgaaggcagagatagggaaggctgaagtgttagcatttctaagcagatctcttatctcccgcggctctagcttttcttgttaactgtagcttttggcttttttctgcagacaatagttacagcaaacttgtggaggctggctttttggcacagcaggcaactggagggcggtgtttttttctgatggggagacatttttaaattttgtaatttatagtgtctttaagtatgggattttgtttacttttgtcctaattacacctctgagatcctttacctcatctagtgctttaatttggggctcatgcagagaaagtttcccaaagggtaccatttaaaaagaagttgtaggtaatgttttaccttcatttgctagagttacctgcagcttcctgtagatgaggatatgcgcttggaagcacagacttggggtctggccgtgtttgtgtgatatgaggtctttcctgctttttttgctaagcattattctagactgttgctattcgatagaaatataatgcaagccacactcataatttaaactttctagcagccacattaacaaagctaaactagttcaaattaatttcaatatttatttactccggtaggtccaaagtgtcatgctatagagcagtccatttgacaaaaaaaaaaaatgttcagcttctttgtattctttgctattggagtcttagagcaagaaccctagctccagcagtcccacagcctaggctcaggtacttgtctcagtactccaattcaagagatgagcaatggtgctgagcagagaaagattaaactgaggtggcctattgggaaggaaaacaaataaagggatcaagtagttcctagtttctctttggggtactgacatgaactttaggttttactaaaagaaggattgtgctagggacaagaggctgcattattagcaaccctggtcacatggtctgagtgaccacagtctcagttctggttccagtggtgacccaaagaaggccacactgcttgatagagaaggctggctttcagcaggtaataacttctgttccatggtacagccttgccaccacacacaatagttgccatttggggtgggggtgtgtcctgtccagggagttttggctattgccacaatccaagatgacaacagagtcacaacaatgactcaaacctttaggtgccttttctggtatgtgggacaggacgttgtaaaatgcagacagtcagatatctcagtgactcctatcttcgtgcagttagccttgagcattgaaaggaaatgacataggttaggtgctgtgggtttctagatactcctgagtgattagcaagcctacgtgcagaggcaaacaggtgatgcagagtaaaggagacaaaataaaggcagatggccagattttcatcctgcttttagcttatctgtgcacccaagtgaggagtcattactttgcaacagaagcagtttctaagtgtctgttgtagggaccagtgagatgactcagtgggtgaaggtgcttgctgtcaagcctaataatcactgatccctgggacccacagagtagaaggagagaaccaactcttagaagttgtcctttgactgccacatatgcactatcacaaacagtgctccttgtaccttgaaaaagtattttttatatgcataggtgttttgcctgcaagtatgtatgtgcatgaagtgcctatgaagtgccagaagagggcgtaggttctccctgggattggagttaaagacagttgtaagccaacatgtagatcctgacagtcaaagtggggctccctagagtagcggccagttctcttaactgctgagccacctctctagcccctcattatacttttatggcacatgttgattcacacaaagccacacttcatgtactcagtagccactgtaacttgtgctattacgttggaaagaaaaatcctgaaacctttgaaagggaggaagagagacatagttcatgacttaggagctcttaacaaagtcacgcacagctttcttgccttaagagaaacctgatatgttaaaaaaaaattcatctcgacaggaaaggtaaagcaagcaggaagtgattattcatgtcacaaaagaattaaccgcaggttcttttaaatagcaaactcccttagtgcactgaacaatatgactcaatttgcagaaatgagattggcacttgacattttagaggtaccttttgttgggcagaaactatctatcaatataaagtgtaagttgctgagtggttggattatcaagtctgcattgggcacctactgtatgccctggatgctcacagtggccagcatagaacaaactaagtgtgattgatccacacccaaaaggcatttagaagctcaccaggaggacccacaaatcatcactacaacatcggaggaactcagcggcatagccagagaggcctaggggttagagaagctagggaggtggtttggaggtcgtcagggaccatttgaggctgaaaggcagggagggaactttcctaaggttagagagactgttaagttctgttttatctgggaataattgtctttcaactgggagtttagtgaaagagtaaatgaagaagcaggcagcttggcagtctgttgtgaagaagacttgaacattgtgcttttatattctctccatgtcccagacctgagtggccagccttaccatccatagtgggcatcccctaaggcaggcaggcaggcccttaagcacatgggaagacacctggcagcggccgttcacttggtagccatttacttaaagcaggctactggttttcttccagctgcaccttgctaaagaaagttcaggtagagacctgctgtttaggaaggaaaaaacaaggctgtgatccacactttagtcaagtctggagcccctggaagtttacaggatctaagtgaaccaggacagctgcctttgtctctttggagggaggcctccctctcctgcaggcacacctataacttgagttctctcaggttgccttccccaacattttaatgtctctaatcagaaaaaaacaaattagagcagaaatgtcctttcctggtctaacgtgatgtgttttggggagcccgagttcatggttttgtatgttggtttgtttttcatggtgctgagaaccgtgcttaggttctcatgccatgctaggcaagagttctaccattgacctgaattcccagaccttgttttttttctctttctttcacttaaaaatatttatttcacgtgcatgtgcatttgcaaatacataggtatgtgtaccacatgtgtgcctagtaccagaagactgtgtctggtcccctgaaactagagttagagacggttatgagctgttatgtgggtgtaaggaattgaacctggtcccactggaagagcagtgagtgctcttaactactgagctacctttccaactccatgatttcttttccaataaagaatactatttttgcatctaaaattttgtcagggatacatttttttaagtgatgtcttctttgtgagaacatcagagtacaggcacacacagatggctgtggtaccatggatggtacagtcttttcatctttccatcatcattggtttattgaccagacttatatgtcagatcactctatatattactggatggggaactcttatcttttattagggacagtgaacttttgggaaacaaatgaattttgtatggccatagggagtttggagaaaaacaaagctatttattttgaaatgttgttaatccctggatagcccgacatttataactctatcatcgggggtggatgtaagcccgtattacaattttcttgatgttcactggtcattttcctgtaagatgtgattggtttaagctgcagctcatctctaaatagggctgtcaaagggctttcgccaggagctaaagtggcagctgtacattttcttgtttacatggccttgagttgagtagtctatagttcctacaccgtgcatatcttttgaactgcttctccatttagtgagggtgattttagttaaaaggggtgagaatcataaagaggcgtaggcaccgcagagctgtgggtgcacgccttgccactggagctggtgcttgctctagcagagcttgctggcttgtgttccctgcccagcacttcttgcttcaattgtctcataggttaccttctgctccttggagggctctgattgtctgacagagagcagatgaagatgcagggtcactttgtaagtggcacagtagggaagttggcattttctctttttagaatgaatattgaagaggcagtttaactttttttttcctccaagcatcatctcagcggatccctgaggtgggtgtgtctcatatcggaaaacattgtctcagaaaatgagcttaactttcttgttgagcttcgggtttcctgggaagatgggcatcaagctatttaattgggaaatgagataatttagtctggcatgtgaacaaaggttactataatctcagtttcaatagaccaatctctatttaaagtcaactttaaaaaataaattgatatgagggtttccaagtgttgggtgaactgttgggtcttttgcttcagcccccagagtagctggtactataggaatgtgcgactatacctagctgaaaactggttttgacttttttatttgttacacaagttcacaataagttgagcagactggctttgaacttgctttatagcccagacaggcactgaatttcacaatcctcctgcctcatcctcctgaataactggtgtgatagatttgtgtcatcagacctagtagtttttaaattgattgctatgagggctcattaaaacaaattctctctctctctctctctctctctctctctgtgtgtgtgagttcaggtgtgtaagtgccatagtacatgtgtagaggtcacaggacacccttgggtgactaacgtcagtttccattttgttttgagacaatgccacatttttgttgtttgctgctgtgtatgaccaggctagtgggcccatgagcttctagggatattctcctgttcctgcctcctgcctactaccttgtttggctttaagtgggttctgaggactcaaactcaaatctttaggcttgtacaggaagcactttgtccaccaagtaatggctcattttaactattaggggccagggcatgatacagagaaattggagtgttcctgcatgcatacaggaacacatgagaagacagaaggggctcttgtatgtgtgcttataacacttttccatgggtaagtgatttcaataggttgcaaatcaacttcatcatgaatagatttatgacaggagagtacattaactgattatgtaatgaaacaacaatctaggaaaaggcagttctatcccgagttactggattagctcactggctggtttagctgccttcatgaatagtcagtctggaggacaggctcttctgaaccagaatggggtgggaacttaacctctgacagaaatgtaaagtccgtgtgagagagacccactcacctactgacctgccccaccaaaaagtgatctcagtgtattgaatttgttttgaaccatttgtacattttagttttctatttaagaaatctttttcaaaaccaaagtcattaacattttctctcatgctttcttttctttttgttttttgtttgttttcttttgggtttttttttgttttgttttgtttttgtttttccgagacagggtttctctctgtatagccctggctgtcctgcaactcactttgtaaaccaggctgggctcgaactcagaaatccgcctgcctctgcctctgcctccttagtgctgggattaaaggcgtgcgccaccatcgcccagctctctcatgctttcttagatcccaaaataggaactcaaagtttctgaaaagaaatgacaggggaatggaagtgctaattaccccatttgataagtgcaggctctgtgcatgagttgtaatatcacactgtaccccattaatgtgcatgactattgcatgttaataaaatgttacaagcaagccccaaagaaacagatgtatttatgtttgtaatgcatatttaactcatttacctttgcctttatctgattgtagctcattaagttgcttattttccacttggggtttcatctaattttcactctcttatttattcatttaaatgaagttgcaaatagaaaagagacaagttttgatattatcttagattgaggtgcacaaagaacacctcagtgtctaaagggatcttgtatctgctctatgcaaccaatctctggttagtttttgccaaattgcattggtgctttgtcaacaaaagagcttgtttatctgttgcctccgtatataccaagttgtcagacagttcttttgcctttgagaagatagtgcagtatggtccaactgtctgtgaactcacggattgaggcagcaattctcacttcagttctgaggtgggctatctgagacattaggtcaaccagtggtgccctctgttctgtatgtgtctttactaccatatgtcgtcatgaaagatagcaatcatctgtgtagcatgggaaattataatccatattttgcacagccaaggtccaagaatgttaacatggcaggattcgttagcactggccaggtaaagagagggctgaggactcaatgtctctcatttgtggtctctggtctctgcacttgaagaaatgatgccgaataagctatgagttgggtaagtgttgttaggccactgtcccagtgtggtttcccttctgaagcccctgccggccctgacacagaattataggctaccttgcctgtgtctgaccacgaccagtgtgctttgtggtttctgtgctatataggcttcaggttaacccaaatcagtttgcctgtggtcttgcaggggatgttggagctcagacttgtacaacagctgaccctaaattgctcttttgtcttctcttcctttcagtggaggccatagtggagtttgattaccaggcccagcatgatgatgagctgacaatcagcgtgggtgaggtcatcaccaacatcaggaaggaggatggaggctggtgggagggacagatcaacggcaggagaggtttgttccctgacaactttgtaagagtgagtacaaagtcaaaccctttttcctgttcctgtgtgggctttgatggccaaaaggctgtgggggccatgtggataaagtgcacggggttcttgggggctttgctggcagcttggtctcctgggtggtatcaaggggagcacatataattttgccccatgtatgtggggtatctgttaagtgacttctttttaagacccaaaatgatctcccccaccccaatggtttatcaccttttagaaaatgctgagaaaatataaaaaaaatataaagcctgtgaaattgtttggtttatctgctttgagagtttgagaagactgttccttttttacattccatgcaaaatggaatttgaaactcggtcttggccatgtacattgggagccttcaaatcaaatgcagaacctaaatgatgccttttactactctctcctcatagacttgccttcatcacagcagcagtattatttccttttcttgtttatgtctgtgaagcattgaatagcatctgttttgttaggaagattttgaaacctatgccctctgtcaaactcatttagggcttcattacaaaggtttctcattcctattaatacacatactgttgtaaacactggtgaatttgggggttaagaagaggttgcccgtgggaaatattaaccaagtctaaaagacccagtaccataagcttctggtcccatgctagagaagagataattaccctccattcatggagaatggccaggcatggagcagagttctcagtggtaccagaccatatgcaggggtgtgtcttgccagtacagagcaggttgttggggaaatcttggacccagagaatcatgcatcaaaggggcctcaagggctgggtgggaaggctttatgggggttgttggtaaaaccatgtgaagagccacaagtttccagtgcttgggcctccaacctttaccctgtgagaatctaaatggaataggagtagaattcaggttttcttcaggatcttgccctcagatggccgtgccaacttctccttgtctttgcttttggtatacagcaaactggggagggaagcagcgttcagctggcatatgctgataaccttgctttggctttctgtggtaggaatgttgagactatgctggaattagggccttcctctcattcttggggtaggaaagcacaacttctgggctaccactgattgactctgttggctctgtctctctagaggtaattcttgtgcctttccaaacaaatcttaccacgttggaaaggggctgtttttgaagttgggccaaacttgcgtgtgaaaggagaggttccccaaaggagggggcaatgcttggggtgaaaatgaaggaggaaataatgaggcagaggatgtggctgagagagcagaaaaccctgggaaggagaaggagccttgggaaagggtggaggaatgtgagaaagaggtgggacatgggaaaagaggaggagcttgggaagaagagaatagaaggtgctttccctgtgatgtgggggtgatgtggttcttttggccaggtggtcattgaatgaaggtcattgccttggcttagacttgggaaccctcagatacagacccctgcatgtgatgggctttggttccaggggtgctcgaaggtgagacagaaaagagggagagcacagggctctggggctactccttatgctcctatctgtagggtgtccctgggctgcctctgttccttaacaagagaactgactgctcacattcagtccttttccctccgtgctccggtttgctttctctttatccctttgctactgtcttagggtttatctttactttatctgattgaaaaatctctttattaatctggctccaggttgatctgagcatgctactttcttttgtaagcccaactccctcatcagctgctctggggattaaatggcactgaactggcaatcattgagtaagtgtgccttttgtcctgttaccacatacagggatggcctgctctttgtctttcctaatcagttgtcccctaacttaggcttgagtccttgttcagtgagaggaagtcacattctagggaggcacttggcccacctgtggtcgatgaactagaaatgtctaggagccacacccctggctctcacaatctatggaaactttgattctttcagatggctgagtctattttccagtcttcacccttaggcttattattgaaaactcagtaggtggatgcaaaggagtttaacaacaattcaaactcccgcagtgaattttaaaaagaaaatgtgtttttaagcaataacaatcatattggcatacatctgccagttttgaatattttatttagcttaagaattaatttgtcttggatcgaattaagtaatcttgtggagtcccatcatttatttgtgtgcctctgttgatgttatcaccatcagagagctgccttaagtattttctcagttggtttatcaaatccctagtgccccatttgagcacactttcctgaaataatagcattcggggactgccttcaactctcccagtccagcatctctaccatattcgtaccgtgctctgtattctgtaatcttttcaactccttcttctcttttccaccctccctctttccccacttcttttcttagaatctctcttctttgattgtttgaaaatttcatataggatatgatgtttggatcaaatacactctcccatttcctccctgccagttcctcccctatctttcctactgcttcccccttccaacatcatatattctgtcttttttttaaaaaaaatcacagagtccatttactactgcctacatggatctcagggggtggatccctgaagaagacctactctccctccctcaggagccatcacttgataatagctacttaaagagaactggggcttcatgaactggccaccatccatgctgctattcaaactttcttgattttgtaatgcagtcatagttactgtgagttcatgtgtaaaatggtgttgccatatcctgcaaatactgttttgttgtaggtgtctactgtcactggctcttatagtttttctgccctgtcttccctgatgacccctaagccttgggggtagggaatgtgtcttagttagtgtttctattgctgtaaagggacaccacaaccatggcagttcttataaaggaaaacatttaattggggctggctattttcgtccattatcatcatggcaggggaaaatgggtgcatgcaggcagatatggtgctggtgaggtagctgagtgttctacatctcgatctgcagacagcaggaagtgacggtgacatactagccaagcttgaaggtctgagacctcaaagcccacccccacttcctccaacaaagccacacctactccaacaaagccatacctcctaatggtgccactccctatgggcctatgggggccatttttattcaaaccaccacagaatgtgataatagccattcagggatgagcaacgtagtcttatcttcttcatgttgatcagtgctagatctctactaactacatattaataacatatatagtgatatatgttttaggatgttttcctttatcttgtctcttcaaaaaaattaattcattttaaagataatttttacatagactaaaatggatgtcagcatccattatgatttttgtttttacataagaatgtacctctacaactactatctagatcaatactgtttctgccatctcccaccccacaaatttctcttgttttttcctatacattccctcctctccccaagtgatcagtctattgcgaaagattagtgtacccatacttgaattgtcatgtaagtagggctgtaagaacatgtgctagtttatatgtcttcttttgtgtcacaaaattgttgcatgtgtcaatacttattgccattatagtttacatggtaatgaatatatcatatcttgtcaatccccctttttattggttgatggctatttgggttgtttcatttggagatttttgtggcattcttgtgagtgttctataaatacatgtattaatttcatatatatattagaagtggaatgtcacccttgatttcagccagtaggctgtttttgttttgttttgttttttctgtctaaagaacctggtcatctgtaaggagtggtggtaggtgttatgcatgtactttgagcctcttgtctgctagttaagcccagtgaacagatgagcctgcatcctggtgagtctgactggtgaggaaatctgaagcacggagctcagtctcttggagctgatttgattgggggggggcaggaactatcaaagactaatccttatattattaaaaacatgcgcacagagagaatgtatctaagctctgtaggactcatttaatgaggaaaccagtggaataacaaaacttgatttactgaggatatgaggaactgattaaaaagtcagtgtaatattcaaataagactgtaaagtgagattcaaaacgggttcatgtcttagaggacaataaaaccctaacctttggagctatcatctctagtagaagaggaaaaaaaaaagccaaacgccatactgtgttttctatgagttattctctgacttttgtagggctgtaaagtgtcctaataaagtattagtccaatttatatttccagagagccagatgtccctcctggggtctcccttaagaaaatgcattaacataacactagaagatcccatgatcatgactgtgggctttttttgtttttgttttattttgttttggactaatttccaggtttgggtattgttctcatgaattgaccatgaaagaccatagtatggtttacaatattaagaaaaaaacacagtgagtcatcatagtcatttaataaaggaatctatgtcctttctaaggcctcaaactgccacataaaatagagggcagctgtacaggcacatgtgggctcattccttggatttaattacaagtatcatcccttaaaaaccttactctgagatggacacagcatggtgctttgatcatttttggtacctcttgacatgggctcccaggtaaagagaagcgggatgagatgtgttgtaatttacatgcagaaagcaggaagctgtggtaggggttaaaagaatatggtcgttgatcttgaaatgcatctgacactgtctgtgaggaagcaagctgttttcttggcctggctctgtccatggaactacctttgtatgcccccctgcgccactgttgaaagctgaagtatgcttacttacagtttgcattctgtgcgtgcgaagtgtaacagttctcagctcaatttcccagctccttactactcccttgctgggtgtttgagctctgtttttggcatattcagagctttcttttttgatttatgtaaagattggccaatgcagtccctaaatgaggcaaaaagccaatattctacatacgtgtgtcactttgagacaaagctcagacttttgccgctattcttgatttaggaaaggcacaggaatctccttcaacaagtggcatgaggcagacatttccacattgctctttcgtactccatgccattcttggattccctttcaaaaaattttgctcttctttacacttcccacccaaagggtatatgattaattttaatatccctgttgcttttcaaaaaagcaggggatttgccaggtgcctttcattatgagtagagacttttttttcagttctgaggatggaatccagtctcacacatgccaagtaaacattggaccattgggttcagtctcttcttgctcacatttacagtgaagtgcctgggtacatgtactcgcatcgtagacatttgttgggtgtctgctagagaggctgctagccagtgggtaaacatcaaaggatatgagcataatggagacaccttgaacggagtgccatattgtcacaaatataacttctcttcacagaaaaaaaaaatgtacagtgcctgggccatggccttggagaacatgtcctaggcattgtcctgcaaggatgattgacaaaggtgtttctggttaaaatgtcacttgagacgtttctgggcttattcatagggcaatgatttgaacatactagagacactgtttttaggccctgattgctgggctgattttatggaattatgatggctgcattctacccaaggcttgctggctgcctagcattgcgggtgagacctgagtgccaccgtcagaatgtactgaacacttgctgtttgccaggcaggaaggaagttaagccctttgtgtgcgttattttatgcttttatgaaattgtaccattctacgacatagttacagttttgatttaggaaaaataatgctcagaagaggcaacacagtgtatccatattaaggaacttatccatcgtttcaggagctagtagggagcagagacaactcggttctaaccgagacagctggctctctaacctgagctgatagcgttatctggatgtcagatggcaattcctctctgtgccgttaccatttgctgcattgtgcttcctccagatggcttaccaaaaggaataaaatctgatatgaaaccttttaaaaaagcagccttgactgggcatagaagtgcattcctttatttaatctcacactcaagaagcagaggctggtgaatctctaagttttaggctagcctggtctacatagtaagttccaggctatccagggtcacttaataagactctgactcacaacaaagaagcaacaacagtaacaaggcagcttttgtctacttgcaggcttgctttcttttccttacatattccaaagtaaggcaattagggaaaatatttcatttttattaattagtatgcaaacttgtcatttttcagtgcttaggatatgccctttaagtgggagtgtgactgttgttttctatccttggggctccccgcagcaagcaattccagctcaaattacattttcatcattaaacacttcattttcagaaaaagtcataagcctaacaactggaactgttggagtgacatttctcacaatggcatctaagtaggaaggacctgaagtaattaacgacgcatgtgatgtggaagggcccatatcatttgaaagctcaggcatcctaacagttataaggcaagaaagtgtgttgcatcttctgactcggggaaagctgtgaccctagtgacttgtagtcctcctgattgacttgattatgtataatagaatcttttatttccttaatgacaagagtctcaaatcctagcttcgaaagggacttttagactatgtgttttaagccccagctctctagcagatcacaatctaaactgttgctgtgaccattactggatattatagcttgtgtgtacgtgtgtgggggctctagctgaggactctaaccagtgctcctctcttacttggcggtgctccatgtgtgttgccttgtcagacacttggggtagagggaggagttggcataatagacatagcatattttatttaagttttgttttaaagccagacatagtggttcacatttgtaatcctagcacttgggaggtggaggcaaaaggatcagaagtttaggatcaacctccactacatatcgagttgaagttcaagactggcttggcctacgtgaggtcctgtctcaaaacaaaacagctcagatgattctgccatctcatagacttggtcattcattttgttctgtagcactgatagggaagcaccaccatttatatgcagagctttcctcaagaacatgaattggtagttggtgacttatatttgaaagtgttatatatttctctctctctctctctctctctctcactcacacacacacacacacacacatatatatgtgtgtgtgtgtgtgtgtgtatgtatgtatatatgtatgtgtatatatatatatatatatatatatatacatatatatatatatatctacaaagtagctttatgagtgactggtataattgtaaaaagtgtatacaacataaagaacataggaatatgtaaataaccattctcctcaagtccactagaatgaatacaggcaaacagcagaatctctggatcaagtccttaattttcttctactccttactcaggagtagtaaaataagcagatgtctagaaatgatccccaagccgggtgtggtggtgcacacctttaatcccagcacttgggaggcagaggcaggtggatttctgagtttgaggccagcctggtctacaaagtgagttccaggacagccagggctatacagagaaaccctgtctcgaaaaaccaaaaaaaaaaaaaaaaaaaaaaaaaaaaagaaaagaaaagaaatgatccccaaggctctccccaaatcctgacatcccgtgaatatgacacgtgacacttgtgattgtgttttgctaaatgtcatggctgagctgaaatgagaggttatctagctgggcccaatttattatatgaaccttttaagagttgagagctcgctgtgtataaatggtagaaggggaagtcacagtaaagacttgagaaggactttctactttgaagaaggaagagcaatacagcaacctgtactagcagagtctaggcattggctagtagctacagaagatgttaaggcttcagaccccccagacacaaaaattagattctgccaaaaccccaggagagcttgaaaatgcattccttgagcctccagataaaagttcctcctacttggcagcttgaaatgctgtggacaacctagagttgagcctgctagcatttttgaccttcaaagcttctagagaataaatgttgcttgaaattgtatggtttaaagtacagatagcaattgctctgagagaaagttcttattccctgctagtggtcttgtaagtggagactgactcttgtcattgagtgatataggggaaaccagtggcaggcctcagatttcaaatactatacaataccttgttgttagagtcactgtgccttatattgtctctagaatttattttctatccaccgactaatagctctctttttctacaacaccgtctttgctcaggagctcagagctaggatgtctgggactgatggacatcttagctctacctatactaccctattattctcctcttttaattctgaagatgaaaggcctgtaaatagactgccagcattcctaactccactgtagcatctgtatcagagagtaaccaactgaaaacaccaagagctttcccagcatctcagagtgccttactatttgcattagtaactagtatatatcaactgattagtataagccaaacaccattttcagttgctcagtaagagaaacagtcttctcattcctgaacacaaattatctagaaatgtgtcatttgatttctaagtgttttgagactttcccggtatcttctgactgttgactttaaggttgattatactacgaccagggaatatagtctgtatgatttcaagtcctttaaacaggttgaggttagatgatgatgatgatcatcatccaagataaggtctataaatacttaaaaggaatgtgaactatgtggtgtaagggtggagtattctgtaacagccaaccggaaccttttggttaatcatgtttagttttagatctacactgctttcccactcaatagttctggcaagtgctgagaaagtacttaggtttccagccgcagttcaaggttgtcggtctttcatctcacactgctgattttgctccttgacttatttcctaataagcaccccataaattgaaatgatcataagtcaaaaatacagttattatacttgacttataaaacatcagtaaccaagtataccaaagaggatcaattgtttaccctcatgatcatttgtctgactgggagccttggctcactgccactgctcaatcttgtgacagagtattctgctacatgtcactccgaaaaataccaaactccatgatctgatatacagtttcaacagaattgctattattttcaaaattgcgtaaagaagaaaaattgtaaagcaaaccactataaattaggaatcctctgcattttcaagctccctttttaattttaaaattcatcatatatcatatataaattatatatatatatatataatgtgcattgattatattttagtatattctgcattatgctcttttatccctcgccccttctaccattcctagagttttgttttgatgtatacacatgtgtgattgttaatgtttattattgttcatttcttagagaaaactgaagctctgtcaagtccaaaaagaacctgggagcaaatggctaactttggtgccgattagcatgctggtccttaggttctttcagtattgcaaatcaaacatctgttacatagtccctgctggcatcctgagtgtctcagctcttctcatcccatgccctaccataaactcctccagctcaaggccttcccttcccccagcttctgatgtctatataaccctgctatttcagctatattctctcttggttttcttggtcctcttgggacttctctcctttacctctcctcttctccctctcttcttcctctcttgctctccacctcatcaaggcctggtccattctgttggtcatgtttagtctactactttctcttcctgctcaggacttatccctgatgcctctggctttattctccttcatactacaataaaatcctgtcttaggatttccattgatgtgaagagccaaggcaactttttttttaaagatttatttattgattatatgtaagtatactgtagctgtcttcagacactccagaagagggagtcagatcttgttatggatggttgtgagccaccatgtggttgctgggatttgaactcctgaccttcggaagagcagtcgggtgctcttacccactgagccatctcaccagcccccaaggcaacttttataaaggaaaacatttacttggggctggcttacaagttcagaggttcagtccattatcatcatggtgggaagcatggcatcatccaggcagcatggtactggagaaggagctgagaggtctacatcttgatccgcaagtagcaagtaggagactatattctacactgggcagagcttgagcacacatatgggacctgaaatcccacctctacactgacacacttcttccaacaaggccactcctactacaaaagggccacacctcctaatagtgctattccctatgggccaagcattcaaacacaagagtttgcaggaccattcctattcaaactaccacacttctcaattatcccttagagtggtcatgtcatcagtttatatagactctctctcctagctgctaatgatttctaataactcctcagctaggggtgggatttcatgcccaattcccctctccatttctgggtgttgtgcatgttataacaacttctgtgagttcctatgtgcagcatcatggaagctagccagccagctatttcaggtcaactcactggctagtaagcttccacctgcagttcctccacaccagccagtcctagggctagagatgtgtgctgccaatctcttgtcttgtgtggaccaagaaaaccaagagagaacatggctaaaatagtagggactcagaagctggggggaaggaaaggccttgagctggaggagtttatggtagagagtggtgagaattgctgagacttgggtactgggaatccacactcaggacctcatgcttgcatatttgcccacttgggccatttcttcaggccacagaagtctatggttttatatgacaaatccactgtctccaatctttccttatgggtaatgtcttacttgttttttctttgtcattaatttttataagtttgagtgtgaaattccttggcaaaattttctttgagtttatcctgttttagattctgcagagttcttgattctggaagtttgtcttttgccaaatctagtgggttttcatacattatttatttgaattactctttccacacttttattcttctggaatataaggacacaagcattagactttacactgttgtcccatgaatgtctgaagctactttctctctgttattcaggctgaatatattttatcgatacatttttaactttattctttcttgtgtcatgcctaatctattactgaacttatccactaggcttttaaatttgactatttttcaattctatacttccctttttattgctattttctaaattttcatttgtttgtgttgcttgttaaagtattttttgagacattttttgagactcctgtctctaccttccaagtgctgacatttaatgtatgtgctactacattcagtcaagtattctttaaaaattatatatatatatacacatatatatacatatatgtgtgtgtgtatttgtatatgcacatgttgtagggcttcttatggaagctaaaggataatttgcaaaagtcatctctcatttcaccatgtgggaatggtgggtatgttaattagcttgataccaataagcatttcataacatatacatacatcaaatcttcatattgtaattctatatagttttcacttgttgtttcatatatccataaaactgaaaaaaagtaagtgcaaaaattgtctaaccctagtaattcctgtccatatcagtgatcagttaggggttagaacatggctaaaataataaacaaacaaaaacaaaaacaaaaaaacaaagaagctgaggctcaccctgtaagtgcaagcactccatgtaggacctgttggtggtatagatagctgcagagctaaaaagcagactttggatttcactgtagtttcttaagtcacaaggggaactaaaataacagatgtcccaatctccccacaagcctaggagtaatgttcatcatctttgggccatggagaagataagatgagtgtgtataagggaacttctgagagggtgcagctgaagaggtggatgcctcgcttagtccatgcactaaggatgcagtctgcttcccagcttctacttcctgccctaccaccatttgtagaaagagctcagcggttctttctgttttgagctgcctgttttgtttttcaaaggtataagcctctctctgtctctctctcttgtcatgcttttcatcagtaccaagtttttctcccaaagacaggggtgagaggggaggaagggagggagggagggagggagggagggagagagagagagacagagagagagagagagagagagagagagagagagagagagagagagaggtgggtgaggggggaagatatgatatgcttctgggagcctgagtacagaaagcaaatgtgctcagtttgtaagctgagaagttgttcaagccaaaccacatcctgccctggggttcaggagccaggtggtcccagatggagatccgggggtcaggcgactgtgtgaaccctgcactttgtgcatggggatgatgtttgtcccccacgtgcccttcctactgagctgcttttttaaggaggcttcccaactcactggttaccagtaaacactgtgctgctgggctgcttcgagttgtggctgtgctgcaaagcagctgcacacaggtggctatgctgcagctcttgaggaagtactttgctggctgtaaataacccatggtcaatggctgagatggctgagtgcagttgctgttatcggtatggtgggagcctcttggaacccaaagatgggcttttaaaaatatactatggaagaaaatgtatttcaacaagatcttttttttaaaataatgactaaatgtacattatgatcatggttatactaaaccctaattgaaactgatgaaatgttaagcgtgaacgtattctgagctgggctgtgcatgtttacatggtatttcattgtctgcagtgtcatgagggtttagtttcggactgaccagacactgttcatagtaaagaaacgccatccaaaaaaatcagcatggacagatggtgagcaaaagacacattgcagttgtttaaagccataaacattatcaagggataactgctaaacttccagtcatgctgtgttgtattggaacgcccatgggcacattgggaagggagtcaggttgctagctgctactctgtaattgctgttgaatggcctggctcacgctcacaattcagtctctaacgatttccctcagccaacaagtcatctgtatctctacaggtttttttttttttttctttttcttttttctttttccttttcttagcaatatttctggttgtttctaaaaaaattgttggcagtgctagggatgggactctgagcctggtactcagtagtaggtaagtactaaacaattgtgctccatcgccaaggcctctgtcctgctcttgaaattccagtaattgccagctaacaaatacagttaccatatgaagtccgcactcgtccgtgttaaatgggtgattatatcaggcttcggaggcaggtactatgaactcagaaaaattggaatgtggaggacatcagcttcgtgtggtttcgaatgttgagaatcattttctgtatgcattcatatttcttccagagactgcactgttatttagttcaaaatgtcacacgacagcagatatctttggtttatataatccaggcaattatggtgtgaattctgctgttggtggtagttaaagcctgtgtatctaactccttttttagcctctgattttttaaaaaaaaatcaatttaactcatccttttattttaaaaacttgaatttgaatgggttccattaacagatatttttaaatgacaatcaagtctagggtactgctagctccgagctgaacacaatccccagcccttaagctggataggaaatcaatttcaggctggttgcaactgcaatgcggagctatagctgacttgtaaacagcccttgtatcaacaaatcacagttgacaagccacagtgaagtgtgtgatcttgctatctaaatggctgccctgattgcaagtccacgtggagtgcatctcccagggccatggaggataattaaagccaccattggtagatgattccagattacctcattacagaaaacttaggcctgccttcattcatttcacggaaaggcaaatggccattcagtttaccccaaactatattattttctttcctttttagttggaatatacaagtgaatatcaaattataaacacaactagaagccattctcctttttaatgaattcactgtggggtcatgcttgtcattcttgggtgtactgtcactgagtttcttgtgatctgtagcctcttccttgtttgtcctgatgctagggattggtaggtgattcctgtcagccttttgtttcccagagtggctagaatgtatcctgtggttgtagaatgagcatgcttagtattcctctggcttaattgaatttaatacatgatccttaaaactaacttgtaggtctggagttattaaatgctttactctttaacagcatatactttatctgccgtggcccgagctagtgaatgatttaaataaagagggagcttctttcttaccaagctggtgccactttcattttcatattgctgctgagtacaggtaagaaggccgtgggcatccaaaggtctactctatatggctgtgtaccaggctagactggaggcagagaagcttagctgggcatgggtaggtgatgttggtcagcagtgagtacatgggcaaagaacacacacccgagaacagcttcggagaactggttcagtttattgcggagaataaaagctatttaaacttttgggctgtgagtaggggctactggggtcaatgtacatcattggccagggtgctgggaatgcctcatttgcatgaagagcaattccagatgatgctggacatgaccttataaagggaaaggaagtttaatctggctataggctatatgacctcctccagtgggcaaaggttggggacacagggttgtgtgcaccaggacatgcagatcccatgtaggggcagaatgaccatactcttgttgatctcaagataaaatttcagaggttcggacatgcctccaggcctgcagctccttaaccctacatatgatcactaggtgttatatttgaatgtattgtatggggctctcatacttgctacctggtccagtttcattttaagccttcagtttttatgaaggttgacaatgatgtttagatattggttcaaaaaagagcaaattagcatgtgatattttcatgttgttgatttctaatcatttgcattttagaatttattcttgttgacacatttttctatttcaactttagtttctttaacactaaaatttaatagtgtagttaaatagtgtctgcttttcagaataaggacaaaggttgccaaaagtgtacgttgtggtaaaagtacccattacaagctgtctgacctaagttcaattcccactactcacgttgtggaagcagagaactagttcctgacacccacttttgtatacacaacacacacacacacacacacacacatacacacacacacacgcatgcatgcacgaacatgtatgtgcactaaagaaaaatgaaattttaaaatgtacagattatttttgatagctcaggtgaacaggaccaaaatattgtatttatatttcagtgcacattggtcacccgcaccttaatttgatagtatgaaatgtttttgagctgttaaactatgtaagagtatgtatgacaatatagcctatatctagccgtttgctacttacatttatcaaactgttaccacattgttgacacattttaaaagtaaataagtagacttacagtttcaagacagagatgtagagagctggacacaggtcccgccacactccaataagattgagactggtaattaacaagagaaccaagttcacagagaaaatggccattttaaaatctggagctcagtaggtgctttctgagacatgagacaggacctgaccatttgctacaggggcagaagccttcagatgccctagaagtagataggaagagtaaattagaaactataacacattgctggggcagggggaggtgtgggctggctgtctctcctgggggaagggttctactcgttcacagacttttctgcaggaacctcacctggagtcataggaggaccagtgagaaaacacagaaagctcacagtgctggcttgggaaccatggagaaatccattcccccttaggagaaaaaaaaaaaaaaaaaaaaaaaacaagaggtacctagcactgctcggaacagcccgaggacagacagcaatggccaaggcatgaccaaggttggatttccaggtatgacatgagtgcttttgaaggtacaagtgtcagggacacatgctggcaagagcagccttacatttgtgtcactgtcctggctaatcttaggaggaaggagtgggtggcttttcttctgcttacttaaatgtcttccttttaatgcatggagggatgactcctcctctctttccttggtgtttttttttttttttttttttttggaggaggaagatttattttataccttctttgtcaccacttcagggcctgggaatgtgaagttgtagttgtaagtagaaacatttatttagccattaaaaatgcagtgcctcttttcataactgtaaagaatttacattgcttcagctgatgagccttaccatatatcccctaggtctatctcttgtccttggtagtggctgttcctatgttacaggtgggaactgaagcctgaggggttacctggcttgacagagattgaaaatctgttatgggcccaccttagtacttgaagtctgccagcctaaccttccaggatttaagtgtatgaactatgtaaaatgatagaccttttaagaaggttttattttagttttattatttctgtgtgtatgtgtgtgggtatgtgcatgtgaacgtaagcgcccatggaatctagaaaagagcagtgaatccccgtgagctggagttacaggtggatgcgaatttcctgacttgggtgttaggacctaaaattgggtcttttgccatagcagtataagtttttaacctttgagccatttttccagcccccagccctttttgagatagagcctcatgttgatgtccaacctgttttgtagccaagctagccttaaactcctgaaccctgattctcttgcctttccttcccacgtgctaagactataggtgcataacaacacattcagttggaaggatggcttttcttaaaaagatttggaggaagaaaataaccaaaaaccaactgttgacagctacttgaattcttatgcttagtaaacctttgtcaaagcattgactactaaaaccacttggagaaattgattgaataagtgaacgtttaacagtgtagcacttgctcatttgtccttaaaacttggaataggtgaaactggataggaagtgagggagggagtaatgactgacctgtaaaaaaaaaaaagtaataaaaaattaaagaaaacaaaaaaatcccagctctccccaattttcttaataaataaatagttaatatcaacattacaatccctatgctgtcttcttgtgataaacatttctacatagtatcaatactgtattgtgaaggcaacattgcctgacactttgctatccagagcattctggaactcaagacttggtatgaattcactatcatgctgggcagtggtgactctcacccttaatcccagcacttgggaggcagagacaggcagatttctgattttgaggccagcctggtctacagagtgagttccaggacagccagggctacacagagaaaccctgtctcaaaaaacaaaatgaaacaacccaaaccaacaaccaagcaagcaaccaaccaagcaaccaaccaaccaatcacattaaggatacagttggagaaagatctggttatattggatgaaggggtgattattgcctggtgatatagctcagtgagcatgtgcttagcattgggttccatccctattcccacaaaggaagaaagaaaagaaaagaagagaaaagaaaaggaagaaagaaagaatttcataagcatcttcatttactgttttatataccaaaaggtgctactacttgataatcacagattattcactgaggaaaataaaaattttatagtatgctctctagtgtgcagtaataactgaacaccaacgggtgcataggtgagatatctggatggttcgtgagtttacatgataggagaggaagaacagtaacactttctttagtgctttccatgaactagaggagtgaggcaagttgcccaggggagcatagactgtagatgttccatatgggtctgagcccaaggcagttcacctccagtctgtgctctcacctccaccaccccccccccagttggaccatgataaagcatgtttgctgtgggtgtcctggactatgttaaaaagacaaacccaaaagcaattaattagcataaggggtacccagagctgtaagccactgggaatcttggctgagttctgtaacagggtgctgtgaattttcttttaaacacagctacatcttgactgaaaccacaacttcctgtgaatgccttatgaagttacttgaagaaaagaaataagcatatgagttttttaaaaaaaggatttcaagtatattgatatatattttttaaataaatgggtgaaactagtagttctcattaattccaagaactacttatcctgccattcctttgtttcacacacagctccttaatactgaaagattttccaggttcttcttccttgactgtctaggacttgaatgtgaccaatggctttagacatgtatagtaacgcaagtgctgatactgccagcacaaatggaaaaacacattactttaattaaaaaaaaaaaaaccaggctacctttgctttacacttaacctgggagggtgggaagggatggagcaggatcgattcctaccatttgttgccaagatcccaggggcctggggtgtatagcttctctagcactgggttccgtccccagctctacacaaaggagttcaaaggggagatgttggagagatggatgacttcagtgcttaggagcactggctactcttccagaggaccttggtttgattcccagcactcacacaatggttcacaacagtctgaaatgcctgttctaggggttacgacaccctctttgggcttctgcaggtactgcatatgtgtggtgcacagatatatgtgcaggcaaaacatccacacacaaaaaataataatttttaaaaagttcccagggggacattgcgatgtgtcttttgatgctgttctaccacttgtgaagggggaagcaacaacccccccataatattctaaagccagatgagggtataacctaacttgcccaacctctaaatgtgccttcctgggatcctgtgaaatgcagattttgatgggggcctggacttggaaaagaattactgacctaaccctgtctcagggctcttagggatcacctgggggagtttaaaaagtggttttccagggctattgaattagagactctgggcatggagccttcagatacttgggtttgggggaagggtggggaggagaggaagcaactaagcaatttggcaataaagctgtcaactttgtttattgggggtggtgtcgaggaggagcggaatgacagcttggaaaacttcactgtaggaatcagatagaaacgtttaatgatgcagtttctggcatcttaagagtttcctctctgaccagaagaacatgtgaaatcttacgagccaccccctcagaaaggagttgagcagttccttatgattgtccagacagacttaaagcagaaagcatggaagaacaaaaagcacttactagttagtttgctgacctgcctagtattagctaatgtctgtgaagccctgcaggactcatccagggtagccaaggcccaaatatggaaaggagaagtcatgcttatgagggaggagctaaaattatcactacaaatgttgaacacatcatttcagcttctgctctggggctgggggtttcattgtaatgatgtgtgggggagccaggggcagctgcaaagaaagccttggggctgtcttagttctaatgagccctggatattacagtgggggttttgtgggctattcctttcatagtctgacggtccacatttttgctaacagaggctttgtaatgagtggctcttcatcattccccaaacttccctgtgactcttttcttgaggtcaagcaggaatgacttagggactcatttctctactttttgtgccttctatgaattatcatgaattattgtttctatttgctgtctatctttaaagccaagcgttagccattgttggacacaatgtcattaatctttgtgggttgttatttagaacaagtggttttgtgtgtgtgtgtgtgtgtgtgtgtgtgtgtgtgttgtccctggggatgtctgccctagggagactctgagcaccgaaggagctctaaataagaggattttctgcttaggctccaactttgacattctgggctccatataatcaagctgtgtctatgctgagcttctggtcatcataggttagtcagtcagcaacgatgtctaaaacttgactctggctctttctcctctgactcctctgacttcaatgacccaagtgactcatgagacaaacagtagtccttctgtagagataaagatcacagcagtgtaggacaggtgtctctattgcctgttgttatgccgttatagttttgcctgaaggagggacagctggaatcctgtttttcccacccattggagcctagtatgctaagggagcccctaagagtctggagcaggcctgaaggaatgccaccacatgatcccctaaggaggaggacttgtttaagcagaggactggaggaagaagaccacaatttcatgagggtttggaatttggccatgtcagtaagatgctgttttttgtcacaagttagggttatctgggatgattaaaaaaaaaaaagaaaagggtgttggatcccctggaactgaagttacagtggttgctgggaatcaaactctgagtctctagaaaagcatccagtgcccttaaccactgaaccttttccccagcctaatgttttcttgattaatgattgatgtgggatggcccagcccactgtgggtggtggcgtccctggctgtatataaaacaagctggacaaaccatggaaaggaagccagtaataacatttcttcgtggggtctgcttcagttcctgcgttgagttcctgtcctgcctttccttcatgatggaagagaagctgtaagatgaaatgaactctttcctacctttcttttgctcatagcatttatctcagcactagaaagccagcagcagtagataggaagtaggaaaagtgggggcaggagatgagaggaagtgttcatgcccttgtaagggatttagaggaatcggggaaggactggagaaagggtttctcataagggcctggagaaaatgttctggcaacatatgtcctctactgcttgaatatctgcatccccaatagctttccaaacagctttgtgggatctaacttacactaatttacacaccgtaaagtgaactcatttgaagtgcctcattcaatggattttagtgtatttggagttgtctaatgatcatcacaatctaattctcaaacatttccagcccccctaccaaaggattacttgtgcccacttatggtccctccccatttcccatgcccaactctaggcaatctttgtaattcctctttgtaaaacattaagggggatgttttcagtgactgttatatttactttaaggaatctcttggacaaattgtaaacttttatttttcgtttctccattacttctcagtccatccctgttagcatgctacagatttcacacaacagaaacctgtcccggactgtcttaaacataaatcacttctcttacataattgagatgctagaggagggtggagccctggggcagtgtgatctacagtttgatggggcatcagaaacccctgtttggggtccaaggagatagctcaacaggaaaagtgcttgccatcccagcttgatcacttgagtttgaaccttggaacccatataaaggtggaaggagttagctgcttccataaagctgctctctgacatccacacgtgtgtgatggtacatgcccccccagtctcttttaataataatacaaaggagagacccttcttcttgccatcactcttctatgacattgttttggaagtagctgtgttcccttggaccagcttgaacatgattagaagatggctgtcattggtaattgggccctttgtttttatccatagcctatgtggaggggctgggagtggagagttcctgtaggctaactagataaacttagttggtttgtgtgtgtgtgtgtgtgtgtgtgtgtgtgtgtgtgtgtgtgaactcggaatcaatgcttggtttaggattgaataggctgctgcactcccagatgctctgtgggaaggggaattgaatctcctgggatgggcaaccatcagtcttcacggagggttactgagcaaccctgttggagtcttgggccctcgcttctttttaactggagccctttctacgttaagcagaggcaaggtggtaatcaaatttaaacttgttatccttggacagctagactcactcccaactcatcctaggcgaccagtggtctcaacaggtcagagaataagaacactgtgctagcattgttaaaagtaagtccagctttatgtctctggaagtcatccgttgagatcttacacatttaggagtgtctggtgattgagtacatgaaattttatctcaggataggtcactagtgtgggcaatatccaggggggtgttagtgttaacacgggtggaaaaatcatttcagtcacattagggaaatctttgtgttgtagggtagaactagttaagtaatacataactagcagcaaatagtagaaaaagcacttgtacctagttattggaacctccactttgaggaaaaagaccctctgaatatgtcagtattatagctacaatatgaaattcaagtatagctcacacatcactaagccaaatagacattctgccagttattagaactttattaaattctgcttcatgtgtactttaaaaaaaaacaaacaagggtggcctttacacggaaaggtaggttatttgattatgagctgtagttcagaattgatttcagggtaaggtctgtccacatgcactgagattcgctgctgcagctcttaatgatgagaacggatgttgaagaaagcaaacaccatatgccctttgtttccgtgcatgtctccttctggaggcctgggtggagtgtctcagctgtctcaaataatctccattttgctcttactgcagactgcagttcccccagcttgcttctttctgatgttaattatcatttcttcctaatgggttggctcttcctcctctttagtggtaaaggttcccctctctcctgtgccagagattgggttaattttgaaaaatgcatttcacttgatttgtgacagaagtaagagagtgcagagaattaaagaaacaaaacaaaacaaaacgcaccagcctgagtgtgtagtgggaggggcaggaggcttgactatgggacaggatgcttagaataattctgctgccaagtgaatcagaaaggcttgcggttctcagagtgcacggaactcactcctgcccgggagtgcagacagtccaccagaagtcaccattccccactccacagaatggagctttctgcagccaaagccccaagccccacagacttgcctgagagtgtaagtaggccataagtctgctttgattgttatgtctgcatcttttgtagtcttttttttttgttgcctgacaactttgtaagcccagagggagacatgaggggggagtctgctctgcagtctagtacttcctcccatttagatccaggtcttagttctcttgtttctggtaaaaggaagtttttttcttttcttctccccatgtcaccccagggacagacagacaggacttattttgaccgagatctgtttgtagcagtttgtaaaggtttgaagccgacttctcttctacttttctctgtcttgccttctctggttgtgatctatagctgaggtgtttccccctgagggataaccgtgcatagatgggccccattcaggaagccctagcaagtgtccctttcagcagaaagaagttaggggaagggttggagggcagaaaacgtttccgaggcagccgaaagatgtaggagtctgggaacaaggctggtgtaggatctgacttgcctgtggtgtcaagcgctaaagggggtttcagggagacaagatgggaagcaggagagaaagtctgtttggagtccgacaggaggattgtctgttcctagttgctaatccgtatcagactatcgaaaatccccattcaggtagcctagtagccttgggccactaagaaaactaaccttccaagtcttactctttttttcacctggttcttgttggcctggctcttgatggtagcctttcacaggtgcaagccgtgtgacgggtcccatgggatgccaccagtgctgctgttgggctcatatcaggggtagccccaaaggccttcatattctcttagtgtcatagattttaccttgcagctggctcctttgccttgcttaagaccatcgctgttgttcttttggtcatggtctggtgacccccaacacccccccaaatgtccatcaggttcctggggagagggtaccagtggatcctagggcctgaggcctgagttaggaggtcatgtaatgagtcgtggtaggagagagagaattcaaaagtctttctgatttggctttgacttttgagcttcaggagtgtctctattacccagggagaggaagacaaacaagaaaaaatgagaacttgatgaccattgcctatcagttcaccaaatatctgattccgaagtccactgtcacgttgcctgtctccctttacctcctttgtgagtttagcaacggccaggcatgtggatcagttcccaatgcctttcagctgagtggggggtgtcttctacagccttgttaattaacttcactggctgttttatatttgctccaatgtgagttcattgctaataatatgttgctttgacagcctcaagtttttccctgccttttctttttttgaaatgtcttgtattacatttaagccggagtccattgcctttagttctcaagactccccacttactgtgtgtcactaagctaattttgagttttggaaccaccacctggactcttggttggcgcgtaatgaattaagagaatcttttatctgaatgttcattagaactccttcattgaaatccgattttttttgtgactggtttttgccgaccttttcagccttagcaagggtcaccttcctgtttggagattcccttccatcaaagatttccttgtgcctagccccccgctgtgttctttcctgcctctagacccaggcacttgtggttctccaggtcaggaatgccctttccttgctatctggctggtctagctggcttttcttttgggtgttacctggagcagcagcgctgctgggcttatcttttccaaagggacttcctttctttctctctttcacatcaccatgattatttcttggggagtccttggagcacaccctataaaggttttgttgacctgttgactcacttagcacttgctatctcccagactagaaatttagttcttctaagtcaggaactcagtttgttttatcctgagggctatcctcagccctgaactcaggtctggatgtacgataaacactcagcaagtatttgtcacataggagggtttcgtgaaggagctttagttagtttgtgattgttgcaagctgatcaagatgggtttgccctttctgtagccgagcctcccccactgcctgatgaatctgctttcaaaagagtgtaggcacttggggaacatggagactccaggctctggtcccctctctgcgagcccttggcgggtatcggactcaccctctgttttaagcattattattattaatttttttgttctcaaaatgaaaaccacctgtctttaaagtgatttgcttaaaacaaattcttcatttctttactaaggcgtttacccccagcccccttctgcctttttccatctcttgccaagagtaatgggaaaaaccctattatcttggaaagtggttttccctctggtcagaatccaaagccaaatgatttatcaccaaatgcgggggcgtggaggggggggggaagcatggcttttccctgcctcactgtgtgctcacaaatgttagtggtttgttctcctcacagtgtcagctggtcatgcggctgctcagccttggtgctgcctttttctctgtataattcctttccgtttctcccctgctggtaaagaacctagttcagggtactgtataaatggaaacaaggctggagtccgtgtccaagcaagtctctgtggcagcctgctcaccacatcactgacatcttcacaccaattctaggagtagataatgttaaccccaccctagagttaccaaaatggaggcgaagtgaaattcgatgacttattcccaggcacatatgttgaaatcagctgggattagaattgactcagtttgccttttaactctacttgttggcatactttttaaaaaaagatttaacttatgggtatgggtgttttgactgcatatattctgtgcaccactcgtgtgcctggatcctggagggagccaaaagatggtttcagataccctggaactgacttcaccgagactccattttggtaagcacaagtgcgcatgtgcttacatgttaaagctaaaggacaactatgggtgtcactcttgaagcaccagccatcttgtttgctgagtaagttcaatagactggcttattgatgagcagcagggttgtgtttctctctaccttccccgtgccgggattacatatagatactacaattggaccttgcttttctttctctttctctctctctctctctctctctctctctctctctttctttctttctttctttctttcttttcgagacagggtttcgctgtatagccctggctgtcctggaactcactgtgtagaccaggctggcctcgaactcagaaatccacctgcctctgcctcccaagtgctgggattaaaggcgtgcgcttttcttaagacttttgggtcttctaaactgattttgtgcccttctgctcagtggttactcagtttgaaagacactgctgggatggtataagctatgtttactttagctacaggcttgcaccatctaagccactttaaaattattttgcaacagtatagcgtgcatataaaaaacacacacgggcatatgtcttgttgaattctcattcaccaagcatgcctgtgtagccagcagcacatcgaaacacatgctactgattccagcttctttgaatcaagacagaggagtggagtacaacagaaatgaagagtctgttggttcgttctgaattctatctgcagaacttatttgctagatcctcttttggtggaagtatgtgttttatgtttctagcgatggtgcttggcttaacgttgttgatctcacaactgctaaaagagtagcctccctgatggctgtctgaaattggcactaaaggaggagtggggtaaggatgtgtctaggaaaatgtgaatgaggaggaagggggaagggcaaggccccacagttaagtatgaaggcacttgggtatgagaatttatgcttctggtactggagacgaactttactggaatggagggtcgggagagagaaaagtggggagagcatttgcgatcaagagtcccaagtccctagaggttaataatcatctgaataaaataaggaacatttacctctcctggtgagtgttgacctttaaagaaaattgtttgagtatgctgaagaaaattactgatttcttggaaaaaaagtgcaaatgcatctaagtatgaaagcaagtcaaagcaacttggcttttattatgtatggggctctgtacagcggtttttataatcactcacagcatagactttgttgtaatgggatgcatgtagaaatgaaggggagctgacactctaatatgcttttaaacaccgagtagtactaggttataatgtattattaattagtgccttctgcaagactccttctgtacagctatgttttatccaagctgaaagagcctctctgcatcaggggctgtgggataataaattgtttttgtctctgctgattagataagttgtacctcttggttcatgtttgcaaagcagacttttaactgttctatgcttggtctggatttcctgggtttcaacctcaaatggtggcttgtggctttgtgtgtaattcagcacaccatgccagtgtgtatgggcaagacaagtcttcagaattaaacctggggaacaagatgaagaaatccaccatttagaatggcagcatctgcattacccgtgtcttctctacacagagcctgaggcctgggtcaagggcttgctgagtgaatccaagggggaaagcgctgtagccatagctgtcagttactagggctgtgctgcaccccttacttgtttgtctgactgggtcatcacggcaagccttccagatagaaactgcaatttttcttctcttcagagtaaccttagtcttatgtttggggacaggtctagtgtacagcttgtgtcttagccttgacagtggcttcttacactctcaaatggcctgattctgagttgttctggtttggataaaccgataaagaaaatgtgttagaggagaaaccaagccacatccctttctatagtcacttagctagtagaagtcgggatctttcctaggagtctgatcccagggtttataatggaaccactaaattattctgctttacaatttaagccaacgaagatgcacaaaaatctctcagtgtatggtttttggcttctttttgggtcaagttggactctgtagtaggtgatgtgacccaaagaaggaaaacactgggcaaaggctgattaaaatcttcagtgagctttcatttcattggtaagcctagactgttaggacatggaatgaccatatatatcacttatatatgtttgatgcttagcagtttataacgcccccctttttttattgtgttgaagcttcttgtaccctctgggtaataggtgataaaattcccaacttagagaagggcgggaggtcagtagtgtgagacagtcgcctgtctgcagttgtacagcaaaaaaaaaaaaaaaaaaaaaagaaatggcaggtccatccagagtcagctcaggtgttctggttggtgccagatgtgcctcttgtccagatgttctcagtcattaaggtatgacatgtgtagaggagttagcctgacaaagggtttcttagccactgctgacttttgaggacagataagtctttttctttggagaaagagagagctttgtcctgaacactggtcaacagcatgctgttttctacctgctaaatgctaacaggacaagtggttaccacaaaaagtatctgtagaagtttgcaaatgttctcagtggtacacagttgccccagattagaagccactaacctaatgcagtcactgcatttgaaagaggagaaacaactttgcaaatgcttgaaaagacctgtctcctttcctctctccagtttctaaagcattacaaaaaccatttaaaaaagcagtaaaggaggaagggagggagagacgtgtgtgtgtgtgtgtgtgtgtgtgtgtgtgtgtgtctgttgcacataccttttgttgaattccctttgatgaaagattattctatctgtaaaggaagaagaaaatcaacataatcaacatttttctaaattcaaaaagcacacaactaaaaatattagagatcagctaaaatacaacacataaaaatctataattctactgtctagaaataatgacaatttatattttatgtctttttaacattcatgactaaatatatactaatgaatacaaattttcaaatacttttatgtaaaatgctataaaaatcaacttttaaaggttgaatagtccacaaataatattcttcatgtatctgtaagataggataagagcttacaatgactacaacatgtttcattgtgttgtcagtactgttaattcaccttgtctcttgtgaatatttgatttgtttccaattttgtttttttaccagttcaagcaactctgtgaagtgtttttgtacatacttaagtcattcatagcttctttttccataaaggaattataatcactgcaaattctaagatccatttagaaaggaaccctatccatcacattctggattatattttgatgatgctatatatacaccactggaaaaatttgattatgcactaaacttgaagaatggactgtggaaagttctttgcttttctaattaaaggatgactaataagaaaccactgagaatccatgccttgttcatgaaaccttctttacagtaacatgctacttcctgaggagcaatcagctcggcaactatttccttgtgtgcctttaagaatgcatagttacaatcagagagagagggggggggaggggggaggaagaagaggagaagggaaaggaggggaggaagggagggaaataattaaaagaatacatactactatggggggttggggaaatggctcagtgtttaagagcatttgctgttcttccagagggagccaggttcaaatcctagcactcacatcaggtggctcagaactccagtttcaggagatctgatctggcctctgagagcactgggcgtatcgtacatgtggtgcacagacatacatgcagacaaaacacttacatacaaacaatgcaaatcataaaagaactttaagactatatcctcattgcccatgtatttttaaaaaaatagtttgaaattacaaatttataaattcattgcaaaaacatccaaaagcacagaagagcttaaattttcctactgttccatcccttgatttttcattttctagaattttcctatattaaaaaaatgttttaaaattcatgaactgagcagcaatatgcaaggtatgagccagctgactcttttcacttaatatgttttcctgctctggcaccttcttctatttaatcagtgccctagttgagctcacttatagtttttcctcctgaaacaaatcattaccctttatgctaatttatccaagggtgagtgtgtactgatggagttggtagattaagagcctgtatccctagcagttgtgtttggtattattacatttcatttccaccaatagtgtatatatagtttgacttctttccatggtacatcttctctggccagcatagctgttagttaataaattagcaacacaaaggtagaaatttctttgtgttactagttaggaggggagaacatctatttttatgacccttggtttgcagtattgcatgtgttcagagggatgtatgtttactgattttcttttgagattgatctgaaactggatttgactttaaaagccattaagaaagagtcttgtgtataaagtttggggtcagtgcttagagagtcatctttccagtagtatttggtagcatatctcaattggcattgaaggagttagaaatggaccttcataacttaagacgttacaatgtcttttcaatgggtaccaaatataaactgtaaataaaaattaatgtaatattatgtggtatgattgtcttattatcagcttagttctggtactttattttccataatgtcttttctgatatttctccattctacagcatttccactccacgttgacatcttttacgctgttctttcacaaaaagtgattgctatagttgctaagattgcatgtaaggtcctttactgctttgttttttcttttttcttttcgaaaaaaaaaaccagatttgtaccccaatcaagtttttcaaaattatatttttattaatgtttgtatgtgtgttcacacaggtacacacatacagttgtcataggatgtctggaggtcagaagagaatttcaattggtcactttccttctaccttgtgggttttaggaattgagctcaggttatcaggcttgacagcaaatgccgttattacggagtcatattgcccccaacctctatcaagttataactgacacctggcttctagtcttcaacactgaaacagagggcttggtatgtgagtgttttgattgactcttcattccagatttctccttatttggggattgctgtgctcggtaaaggaagactctcctggatgtcctcctttgctccctagaatagtccttgacatagtatctattttatagtaaaaattatatatatcatattatcgttcagtgcattgctttcctgctcagggaagagcgcaagaaagggctgtctttcaatgatttggtatttgaagtggttttggatggtagaaatttggagaaggtttcttgagcttcagtgtgcacaagcagctaccagaacccctattaaccttgtgaagggcccatggtctctgagaaattggagttctgtccttgacaatggaaatacttaatatattgttggtgaggagtttttgagttagctctgggaaagctatactgagatacagagaggaagcaggtctcagagtgcctcttatgttagtgatcctaaaattgtgccacttctagggatattttcttgtttagtaccctagctaatgaatggtaaaagtggattcttttctctccttgctagccctctgagggattttctttgagacctgctgacacaactccctcaagagcttccaaagggctggcttaaaaccataagataacctctttacaaagaaaatttaaaaagctttttattactgctaaagtaagggtttcctgagaatgaggcaggaagtatcatcccagcaaagtggcctttggacctaattggtgatggtctgctctgtgagctttgtgaccttttccttaaggggatgtctgttctccgctaggtcatgttcctctaaattcatatggaagccagtatctcattgtgatttcatttagagataatagggcatttcaagctataagatggccagtgtctttctgagaagagaataggacacaaagagggacagcggaagtgtgtgtgcgctgtgggttgatcatatgagaacacaacaaacatgtagccatctatattatccaaggataataataataataatgataataatccaaggttcattacagcctcctggattgggacataatgcacttctgctatgtaaatattgattggatgtgacttttggtgtggtgtgaatactcattgcacataatatccattgtgtgagcctgtgaccaaaggcttggcagacactatttagagaagaaggatttattctagctcatggtttcagagagttgccatccatcatgatgaggaaggcatcacagtgtggctctgtccacagcagaggaagaatatggtggacccttgttcatatggcagtggaccatggagcagagagtggtcagaactaactaggggatgggctggtaacctttcaaggctcaatccttgggatctaacttttccactaggccatacaccttctaaagactttaatggcccccacaacagtccttgtagctggaaaacaaacactcaaatcagaagtccgtggacaccttttcatatccaagccatgaaaattattttgttctcatagctttaaaaactgcacagattgagtggcttaaccaatgcagcttttccagtggaggtctaagtttggcatcaaggtctaagcaggattgcttcttcctgaaatctcttgagagactacaccatacctctccctagcttccaactcttttctggtattctggcttatagctacttctcccttcatcttcatgtgctgttcttcccatttacatgtctatgtccaaattatccccctttcccaatttttgtcccctgtttttggattgggtctcaggctgtagcccaggcttgcccgaatttcactttaggatgaccttaaacacagcagtcctgctgcctcagtttcccaaatgcagagctttcaggtattaaactatcacgcctggatcaaagcccccttctttttgtgaggatttttataagcatgcattaacagattagggtccacactagtgcactcatcctaactttatcatttgcaatatcctgcttctgaataaggtcccattattcccaggcactgtggactgggacttcctgtagaagaatacagttcaacctgcgatagagtttgtattccaactcaaatttgccatctgtgtacctctgcctgtgtctggagggtttcttacctggttgaccacccctgcttggcatgcaggtttcagctgagacaccactctcaatataaattgattggatgaatgaaagaaattgcagagtaaaattaaaatgtggttgagaatcatggcgaacataatttatccttacaaatgtgagagagttcttctttactccacatcagcgttgcttgtgactctcttgtatatattggctgtgtccccaccacagatgctatttaaatatcattttgtgcctgtgaattgggatgtcgggcaccttccgagtgtcatgatgtttcctgttctgtgtatagagcatgccaagaggattcaatttgttggatttagattttttttggcattgagtcacaatttgattatgatttgatgataattttaagggcaaaactggctagaactttctttgaggggcatgttggttgaaaaaacctctgaatcttgagcaaaggaggcatttactaatgctagtcaattagtatttagtgagcatgcacttataatagctgctacataatttgcaaaatgcagtagtatgggtaatagctgtgggctccagcgaggagttcatatcaggcaacaggataaggccagttgtatgaaaatgtggagtagaaatggggaattggcactcttttggggccagaatgatctagaaaggctttgtagaagagttagctgggattgtactttatgcattagagactccggaagaggtgggagaataccagtttcaatataatataatataatataatataatataatataatataatataatataatataattatatcataagttgtggtatatagtgagctgttttgattttttttcctgttcactttgtttttgttgtttctttttgagattagggtctcaagtagctcaggctgcccttgaattagttatatagccaatactaaagttgaattccggtcttctgcatctgcctgtgaaatgctgagattatagacagggggcactatacccaggtattttgtttttaataaagttagttttcttacaaggtatgcatggtagaaaactattgtaaacatcatacattcagttgggttatataaattatagtacatccatataatggcacactctacaattagaacaaacaatgaaaaggccaggggagatggcttagagctaagagctcttgctgcagaagcacaaggacctgaattcaaacctccagcatccacataaagaggttggcctagctctaggttaagagagtgagcctctctcagggaacgaaggtggaaaaaggcaaagcaggacacctgatgcccttctccaaccttcgtgtgtgtgtgtgtgtgtgtgtgtgtgtatgtgcatctctatacatgtatgtacacatatcataatacactgtgcacactgatgcacacaccaaaaaccaaacaaaaaaaatgatacttaaaaaaaaaaaatcaatatgaaaagacctcctaaaggggttagttgagaaaagaaaggtgtgaggcagtgtgaaggatatgctagtgtttaggagttgcttaaaaaaataatttagaaatggtagtagtaatttccccaaattactaagataaggaataaaagctaaacatcgagtgtgtgtgtgtgtgtgtatgtatgtgtcttttagtgttatttgaatgatgtaaatgtattctctctgaaaaattaaagaagaaaggtatgatgccaaaatgatttggtcatagtgttgctacccttaagttcacttgagtgtctcagcttctctaggtggctgggatataatgaattagaataaccaatcacaagagatctcttttgtctagagcatcttaactagctttttattgttttatttttgattatcactacaaatatttcaaatagatactgaaaaacatagtcaaaggagccactttctccctctcccctaccctcagtaatcattttggagtcctcggtactccttccttggtattctttccctatctgctaatccccactatttggaaggcaaatagtgcctctctggttatgttagaggttgaaactccctagtttgaaagcatgaaatataaagttcttaaaaatctgaaactttctgagtgtcactgtgatgtcatgagtggaaaattccactgatgtcatgtgacaagcaaccaaatgcagaggcactaagagtttgtaaagtttccttcaagctatggccacaggagtatataaaatacaagtgaagcccaagaaagcttttgttctgaaatcctgtccaaaaaatacatgaatcttgtgtttagaatacagcaccatccccatcacattttgttgtgtgtatgcaagtgttaagcattttggataagggacacaaatctatatttagaattactactctggcctgtacagtctcactctggttccagacatacaagtaggttgatgcttgaggtggtaaaagctccctcctcttttaaatggaaattggcctgtttcattaagctcatatgatttgatataaatttttaaaatttcataaaatacacagaacgagcagccttgcccagttttaagtgtacagttcagtgatgtgaagttttgtgcctctaatctctagaaccttctgaccctataaagccaaaacactgcatccattgaataaccccctgttctgtaccccagcccctggcagccaaaattctgctttttgtccatttgtaggtacctcacacagagcgatcatagtaggtaggctttgtctttgtgtgctgggcttacttaatttagtagaatatcctctaggttcatctttgctgtagcacgtgactggatgtgctttgatttttaaggacgggtaatattttatgaatactcagtttatgcgcatcttccataggttgtatggataaaagaattccatgcatcccaatgagaatgcattagcatgataggatccactagtgacaataacaactgagctgtttgagaaactattttttcttttagatatggtgttgttctataagtctggatggcctggaactccccttgtagaccagactgttcccaaacttatgccaacccttctgcttcagcctcccaagtactgggattagaggcctataccagcatgcctggccagatcgaaaatatttgtgctaaatatttcaatttagaccaaaagacctcatttttttccttcctttgatcaaagatacccttttctctcaaagctctgtattgacttttgtctctcactacatgaggctatggatttagagagatggggcaaacctacctttgttatctgtgcagtgcttagtgtggagatcatgctcagtaaatggttgttataggaacagggttgcattgattggacaaaggtatgtaactgtgtctgtgtgttgaaccagatgcagttttaggctccttttggtcccagtcttgttttcgtccattattaaatctgatgatgaacatttcagactctcttgaagatggatttgagggatgaggcacagacatctaaagagacatcttttcagtgtgcctcaacttgttccacagaaggggtcattcacaaatagaactgtttcagaatatagtatttctcagcagtttggatttttgtacttcctctttatgagatggtaatattttttgtgtaatagcaaagttgccatctaaaaattatctatagcatagttcaattgtgcaccacatctcttaggtacagagagctagagaacaaacttcctcttgacatcatcatcatcatcaccacaaaggattctagtgaaagacctcacacgatgaagtgtcaaaagtataataaacagctgggaaaaatgaggattctggaataagacattgaaatgcaggttagaaagcattggaggagattggatctgggttttaaatctcgttgatttgctgaactttgtgccagtttgtacatttttattttgagcctagtttccaaaagtctcctgttagcaaccagatggttgtcaaataattgatctgggttcattttaaatccatttggggaacatagtggcctggattttccagtagaaggatttattaatcctgctggcttttgaatgccaatactcttggaaattgagttccctaatgtcttggaagtaacccctggaaaattggaaacagtgaattggttgcatgatgtacttggaatagaaaacctaaagccatggatacagtttatgtaaattataaatgtccagcctcagacatagttcaattagatgacagttttgttcagtttaaggtgtgcaaaatttgcacatatttgtttttaaggtgaattactgcagtaacaccaggccctgaaaacacatggatccgattttagtcctcatttctcataaactagttcaaaactgtagaatctgacattctatgtcattggtgttttttggtgaaaaacaatctttttaaaatgcagcccttttttttttaaactggggaaatctgccctgccttttggagggtgctggcagcacagcatgctgggctgttgaaaacaattaagaagactgagatcagtgtgagagagcctcatgtgctagtgaggcacccctgacaatatggctgctagaacggtgacaagacagtggcaaagaacagctgtgccgtggaaaggcattctttcagatggccctcaaattggtattttatagaatgtctaagtgtctccaggaaaattctattttgaaaaacattctgtagcttctctgctttggcattttttaaaatattactatttttaaaatgtaggtgtatgttcatgtgtttgtggattcacatgtttgtggatccacattcatgtctgtatatgtatgtgcaggaagcagaggacaagccctagaggtcattgctcagctgctgcccaccatgtcttttgttttaggcagggtctctcactgacccagaactgagcaattaggctaggctaactggtcagagacctcagggatccacttgtctctgcttccccagcatcatggttccaagagagcataccgcgatgcttggctttttgctttttaactatggcttctggaaaactcaagtcctgtcctcgagcttatgcaacaagcactctgctgactgagctctttctcccagccctggtgtgtttttcaggacccaggcttgctgtgttgctcagataggttttatatttctgaacttgactgatccttctacctcctcagctactgtgtctacagagtgtgtaccactgggcacagggttgaagtggagctctctgtttgatgcctgcttgtgtcaagttttctttttttcttttcttttctttttttttccttttcactcccaccatcgtggctattgaatcactggccgatgaggggtgtgacctgaaatctgagtggagatttcagtggggttatatggaagggtggttttgtttcctcgacctgccacaataaattctataagctgggaagctaaacccaacagaagtcttacaggtccagagggtggaagtcccaaaccaagttgtcttctgaatgttctagggaactgctcctggatgctccaagaatgcagattcattttcatcaacctgacacaaacctagatgtcatctaggaagaggaaatctcaactgaggaattgtctccatcagtctggcccccccccctctctctctctctctgtgtgtgtgtgtgtgtgtgtgtgtgtagaaattttcttgattgatgatagatgtggaagggcccagtacattgtggtcagtgccacccctgagaggtaggtgggttcttggttctataagaaagtaggtggacctgggcactagaacacaggtagccgaggaagtcagtaagcagcatccctctatatggtctctgctttagctcatgcctctagattcctgccttgagttcttatcctacctttctctcagtattggactagaacctgtaagttgaaacaaactcttttctctcctggttggttttggtcagtgttttatcacagcaatagaaaaacaaacaaacaaacaaaaaaacaaaaaaacaagcaaactaatgtgcccaacctctgcttgtctgttgcaccaaccgtgctccatcttcatatcaccttcttgtgtgtatcttctccttctgcatgccttgcataggaacacttgtcattgaatttagggactgcctaggtgattcagaatgctcttttcatcttaacatccttaaatgtatctgtagagaccctttctccgaagaagggcccatgtctagagtttcggaatcacataggatatggtgtatctgtttaggggcatttccagtcaccctactactgtaacagtgctaggatgtcgtcagaaccttgagcaggaagtacaagggagaaaaaagtcctttactggtaacacgcgaaaatagtttgtacttgttttatttatttacttatttgtttatttatttattattgtgataaaatgcatataaatattctgattcttttcttttttgcactggtatatacatacatatgtgtaagattttgcatgtgtgggcgcacatgtgcaagtgtacacacgcaggcatgtgcttgtggaggccaagttgatgtcaggtatcattcttaattgctcttctatctgctttttaaaaaataacttatttttgagagtttcatatgaatactgtatttagataatttcccctctccctaccctccatccattttcatccatggtccccatcccatctcaaattcatgtcctcttctttattattgttacatatatgcattggtgtctaaagttataaatacaacctgctgagctcatttagcattttttatctgtatgcctgtttagagctgaccaccttcatcattgaaacagtctcttaaaaacagatctcaccgatatcgctagttttactagccagcttgctctgaggatactctgtctctgccttgcaaggctggaattacaggtgggctgccacctggcatttacgtaggtttatggggctctaaactctatctctcatgctttcgtactaactactttaaccaccgagccaacttgctagccccaattgaaaccatttttgagtgaacagatctgtggcagtaagtatatttatagtgtaaatccaacaaaaccatttttctttaaaatattttcatcttctcaaactgaaaatgtgcctcattttctgtaactcaaagtattgctttaaaattatttcaatgtctttagttagaagtgttgtgtgaagattaaaaaaatcttttggtcattcaaaaatcttttagaaagtatctttctggaagcatgtttaaatattacataattcaattcaagtatatgatcttatttattaataattttatttacatatacagttatcataaaatgttttagaacatcactagatgagctccttcgttgtcatttatagtgaattctcatttttatccccagctcagttgcttgatatgtgttttcatcgatctgccttttgggtagctgtttcttataaaattttatttaaattggaaatactttttcttaattgcaagacacaaattttgtcaccaaaatctgttggaaacacaggtctagccaggatttgggcataccaaatcacattttaaaagctatcccaggggattggctcttgtgcatatcagatgtatcaatgcactggatacaccattgatcccttgtccatctaacgtactatgagcatccccccatcgtagcatcatttctgagaacactttaagtcctagtgttagaatatgccatattctatttaattagctatttgatgacagatgctgctttttccatctgttttgctcttcaaaataaaaagtatgatcctcatgtttttatgtaaatggctatatacagtttgatgtctatggaaattttgaatgcacttctaggatttctagagcaatatgtctagacatactactaaaatttagaaagcacagatacatgctgatcagtgtagccagtcatttaaagcaccattttctcctggaaactggacctaaagcagaggagatgatgcagtctcttgactccccaaccagagatgttggagcatctggttaattctcatctcattcccttgagaagtggtttcattgttgggtgaaataaattaatggatgaaatggtatcacaaagggaagaatagagttgttctgagacaaggtctccctgtagtgcttggggtgactcacatccttagactcagagggaccttctacgtcagtatcagtctgaactatacaagggccaaagaactagatctgcgcataatagttttctaatctgttctttcttccctaaacttccattagttagttctactcttgcaagcagccatatattttgtttctgcttatgtgaataccttgtaggtggaaggaaacttgtggctatgggagcaatgtacctttctcaaagcacacagctagcattcagatatcttacttctcgtaagagtcatagtttcttcagtagttactaaccacatcaagccctgcattcttggggaatatagatgggtatgattgagacttgggaatcctcacatttgctcaatttcttggctcatgaggtcaagggagaactgagtgtgtcttagaaggtgaaccttaattttctcctgttttctttttctttttttttaaacaattttttaattagatattttcttcatttacatttcaaatgctactcaaaagttctctataacctccccccctgccctgttcccctacccacccactcccacttcttggccctggcgttcccctgtactggggcatataaagtttgtagtaccaaggggcctctcttcccaatgatggccgactaggccatcttctgctacatatgcaactagagacacaagctctgggagtactggttagttcatattgttgttccacttatagggttgcagaaccctttagctccttgggtactttctctagcttctccattgggggccatgtgttccatccaatagatgactgtgagcatccacttctgtgtttgcatagcctcacaggagacaactatattagggtcctgtcagcaaaatcttgctggcatatgccatagtgtctgcgtttggtggctgattatggtatggatccccaggtgaggcagtctctggatggtccttccttctgtctcagctcctgggcatatagccagatgttccaactggtaataaggacacatgctccactatgttcatagcagccttatttatagtagtcagaagctagaaagaacagaggaatagatgcagaaaatgtggtacatttacacaatggagtactactcagctattaaaaacaatgaagtcatgaaattcttaggcaaatggatgtatctggaggatatcattctgagtatcggagttaggtatcccaatcgcagaagaactcagatgatatgcactcactgataagtggatattagcccagaaacttagaatacccaagatacaatttgcaaaacacatgaaaatcaagaagaaggaagaccaaagtgtggatacttcatccctccttagaatggggaacaaaatacccatggaaggagttacagagacaaagttctcctgttttctatactaccatattgtctgaactttgtgattctgtaatagttcctaaggagacctagctctttctttcccaggaggtagtggaagaatcctgcctctcctctggtgctcatctctgagaactcagagttagccagctgctttctgagaccctgggctctcctgtatcctcattccatggagagccatttaagcttctcttagaaagtagttcttcacaccacacaactgtagtctagcctgtggcctcttattcagtaggttcagcttgatcctagagaatctgcttttcagcagcttctctggagctgctggtattttaggacatttttttattggatattttctttatttacatttcaactgttttcccctttcctgggatcccctttggaaaccctctatcccatcccccctctctttgcctctatgagggtgctcccccaaccacccaacgcctccagtcttcctgccctggctttcccctacactagggcatcaaacaccctcaggccctcctcccacagatgtccaacaaggccattctctgccacatatttggccagtgccatgggtccctccatgtgtgttctttggttggtggtccagtccctgggagcttcagggggtctggcctattgacactgttgctccctccatgtgattgcaaccccctcccccagctccttcagtcccttctccaactcctctatcagggaccctatgctcattccaatggtaggctgcgagcttctgtttctgtatttgtcaggcactggcagagcctctcaggagacagccatatcagcaagcactttccagcatccacaatagcatccatgtttagtgtctgtatatggtggggcagtttctggatggccttttctttagtctctgctccacactttgtctgcatatttgctcctgtgagtattttgtttccccttctaagaagcactgaagcatcaacattttggtcttccttcttcttgggcttcatatggtctgtgaattgaaccttgggtattctgaacttttgtgctaatatccacttatcatgagtacatactgtgtttgttcctttgtgactgggttatctcactcgggatgatattctcaagttccatccatttgtctgcgaatttcatgaagtcattgtttttaattgctgcatagtactccattgtgtaaataaacgtaccacattttctgtatccattctcctgttgagggacatctggattgtttccagcttctggctattataaataaggctgctatgaacatggtggaacatgtgtccttattaaatgttggagcgtcttctggttatatgcccaggagtggtatagctgggtcttaggactttgttttgttttggtttggtttttttgagttagcatacaaacaaatgggcttcatcttgacatttttataaacacacacacatgcacacacacacatgcacacgtacacacacacaccccaagttgtaatttacttgcatttgctttcctatcactcccaccctcccatcttgttcctccctctctcttttgctggtcttcttctttctcccttctacttttgtgtcatatattcatatacttaaatctagatttcacatatgagggaaaacatacactatttgctttttattcattatatttttgttccattaattcctccaaatcgtcaccttctacttttatgatgtatgtgtgcatgttgtctctagattttgcatatcagggaaaagaggatatttgtcttcatgagtctggtttattttacttaacatgatgttccacagttctatccactttctttcaagtcacacatttatgtttactatggcatgtgtgtgttacatattttcccattgttcttttggtggacactctggtgagtttcagatcttggttcatgtgaatggtagtacatcagtaaacatggatgtgcgaatattctgattcagaagccttttgatatatacccatgagtgtggcagctggctcatatggaagtgctattttctgttttctgaggaatctctctactgattgccatagtggctgaactcgtttatattcctaccagccgcagtgaatctccactttgagaagtgccctagactgcctcatatttcttctttgacccctgaaattacttctaaataggtgtaatgtgcaggaggttttggggccaggggttctgtccagaacctggcagcagtatctttcacaggagtgatggtggtagggtgtttattctctcaactgcatctgtgaaggaggcttcagttaggtccttcaatacagaaggaacagcagctcatccaaattactgtaccctcccccatctgtaacttcacctgcggtcaagtatagtctcaagatattaaatggaaatttccagaaataaacaattcataaattttaaattgcatgccattctgagtagcgtgatgaaatcttacaccatcccactccatcctgcttcatcctgcctgggatatgaatcatccctttgtccagcttattctcactgtatatgctgctacctccccattagtcactgtggtattgattaccagattgcctgtcatggattcacgggacatgcattcaaggaaccctgacttcactgaataatgtgccttaagcatcaatcttttgctccagtctgttatagttatgctattttatattagttattgtcaataatctcttactgagtcagaatttgaaactaattctgtcattggtatttttggggatggtatggggttaccacagaatatataggattggtactattcatggatttgagtgtccactggagacttggaacatattcctctgataagggaaaacctttgtacttccagtgttggggatgtggttattgggtcctttagggcaatggagaatttagggagaatagacccagatccttagggatttgcagtggttctcgatctgtgggtcatgactcctttggcaaccctccatctccaaagaaatatttatatcacgattcatgacagtagcaaaattacagttttgaaatagcaacaaaatggctgctgggtcccctcaacacgaggaacagctgtgaccctttaatactcttcctcatgttgaggggacccagcaaccattttgctgctatttcaaaactgtacttttgctactgtcatctatatatattttggagatggaggaagaatgacaagcactggcttaaagagtgttccagaaagtgaattagcaggtatggtccctcgacatcctgggcacacccttgtattttggttcatatggggctgctctgaacgtgtgtatcctttaagccctggctctgtgttgacttccccgcttcctgtgtccctgaccctccagctcctttgtagtacatagtctcctcagtcagttgctggtaggattggcagtccttaatgaaatgggggcggactgcgcttcctcaaaatgtgttttgtgaggacttacttttgctttgactctccaaaggtttaagagcaaggaatgttagctgatgaaggttgggagacagaatcttgatttaactcagggtttggtgctcgtttagtgctctctcagtgggtctttagagtcttggtggtggctgtgtgctgtttcaatacagattttggtggcaggtggttggtagtttggcaaggatcggaagaattgttaaaatatgctgaacaacaagggcctctgtgaaaagggggagggacattcaacatgctaggctatcaggctagatttagatttaattctattgttctttggtggagggacatcactagttggtggacaattcatcctcgtatccacccttcccatctcattgagagagttacacctacgtggcagtactgtgtgctctctcctattctttgtgtctggttctttttggtgctggtgactgaattccggtctcatgtatgcaaagaaagctcagtactaacagtactacatcatcagccacaccctctgctttcatttctcccccagcatcttcttttaggccctactgtattttttgagtaagaacatatcagcccaggccacatactaaggctgtgtcagatttcctccaatagcacaagaccattataagtatactgttattttaaaacttctggctttaggtcatttcgaagaaagtattatcctgaggtctttatttcctgtaagctaaatggaacagctaaatttgggggggaagggtggatgaatttttggcacatttgatcgacctttaggctagtcacatttgtgctaaatactagcagtactccctgtggacactttagggtacggacagcatttactcttgccagtttgtacagggtagaattactaaatatcaatggggggataataaatgtgaagtagcttgcaaatatttttatatcatagtggttgcagtgaaaacatagcttctaaggtgcttttctaggtgtaatagaggaggtaattttcttgacagccatttgagtggaatttttagtgtttaggtcattaagaagcatgaatggggttgcatctctgtaaaggataggtagacagggcagagctgcagctgactggtgacatccagggcccaggttttctgaatagatccaggattaatttattgcgaggtttattaatggactggagttgacactggactaatacagctaattttttccatttagagttaatgttcgcactaaattttctccagtaatgaatgatttagaggaagctgtcatgtcaggttaagatatagtactaatatttcaggagaaacattgaacaaggcatgatgtttaaatcaatagatgaaaatgtgaggtaaaactttccagaaaaggcttatgggcttaataaaagcagtcaatggaaggaaatcaagcacacccaatatctacatttgtttagaagccaacttgaacaggagagaaatgttccatgtggcatctgctttcctggtgtatttggagctgttgacagtgacgaggcacttatttccataaggctgataggaatggagggggcagggtaagcatcaattgcagaagtgcttttcttgatacaagcaatgcattcattttttcttttaatttcttaaccattctttctgggtttttttgggatgcatggaaggtactcgctatgtatccctggctggtctggaactcactatatagaccaggctggccttgaactcagatatttgcctacttctgcctctagtgctgggatttaaggcatgtgccattgggcctagtagatgacaaattcttaatggaaattctgtcactgtactagacagagtgactgtcacagagaggataccactgctgagttatagatttgctcactgcctaccctgttcagaaggcagcatagataaatttgcagacagatggtctcctagcaggtcatcctttgtaaaatagaatggcccttgtaattatttttagattttctttatagtttgagaatataatagcccctcttatttctataggatatatgccaaggcaagaccacaatggatgtctgtaactgcagatagtttcaaaccctatataacatatattatcactgacatacatatatacatacataatacctaatatatacatgccttgataaagttgttatatgaaattgtcttaccttttcacttgaagcactttgtaacttatctttgaaatatcagaattgccaacatcaccactcttgggcttttgagttattattaagtaaaactggatttacttgaacataagtatatgatatctatgcagtcaatctgatatctgaaattgctactgagtgactgaagtgcaggtagtatatacagtgtagatatactggacaaaggaatgatttgtatcctgcaggtttagcaggatagaatggagtagtgtaagactttatcatgatactaaagaatagtgtacagttcaaagcttatgacttgtttatttctggaattttatatcaaacattttaggactattgttgactttggtaactgaaatctccgggaatgaaacctcaaataattggtgactactatgtagttttaaatatgtagaaatgagcaatttttatgtatattaataagcttaataaattcttaaatggaaaagatggtataaactagaatttgctgaggtttcttacatgttagttgagtgttactgacgatcactcaaaggatatgtagagagatttatttttcttgtttctcaaatgatcgtttataacaggtaagattaaaaattcagggcacatactatagagtaggaaatcagtattttagttatataaaaaggggagaaaagttaagatcataatcaagacctcaaaatgaacagcaaacaagcaaaccaaaactacagttcaattgactctgacgttttgcctttggaagatcatttgaccttgatgacaatgtgactactaagttcccgtgggtctgccttctcaactcgtgtgccctttgtgaatgctgaacagctgttacttcccctttctgtgcaagggtagcactgggtgacaggttgttcttagggcatcagctgctccccagagccacatgccgcagggagccacacggggtagtgatgccagctgggacttggggactgcataccagccagagtctggctgtttatttaattcatctgaaaatgattcttcaagggctggaaaaggcatagggaggtatgggggagggaaccacactgaattgtttgataaaacttgcatttgagttgagatatgagccagacttgcaaaagcaacagataaaagattagtgaatgcagatgactcacttaagtacatagacctgtgacgtgatagttatcaaaattaaaaatatcctttttttgctgagtttgaataagttaaagtggggtagacttgcaaatagtaggctgtgatctaggctcaaagagttctgaatgagtgatagctagaagaagcttgaggtgggaccatgactagagcacagctattaagattacctgtgctgtcggctttggggcccagggcacctgtccttgtgtatgactcttctttccacgtgtctatttctagtctatgtgtctgactgtgtgtctgtgtcagtgccacagtatctgttttcctgcctgtgcctctgtctgtgggtggatttgtctatccttctgttgttatgtttttgtctattggtaggtttgtgcctcttgctctctataaatgggctgtcccaggaacttcccagacagagcagactatgctgagacaatgccacattgatttctgaccagatacaaaagatgactaactagagagcagaaggggagcttgtggggtgaggggagatggtttcatacttgtattaaatataccattatgaataccagtaccatatactacttcatgagggatgtccctcatagtgtgtggggaagatgaagagaaagggttagctggaagttgtggaatgctgtttagtagagggctcacatctcctatcaaactagcacacttctcattttgtattatctccatcgctgctcatctccatggcatattccccagaattctgaagacttattttggctttctcttgtgaaaaatccatttctcccaggggttattattgcaactccagttaatgttcacactcatgttcagggttgaaaagaagaagaaacaggagtgcacatgtgtgggtagtgacttaggaagttgggggaatagcccttattagatacagagtcttctggaattggaaaaatctggcctcaggctgttttttgccttgttttttgattgctatctttcctttgctatcttgatggctattttcttctgttttctttgattctatgttgaggctttcagtgtttcacaaagctgttagagacgactgtgtactcccaagcttcttagcaatttcagctcatttctccttactttctccgaagctgaagtgactctcatattgtcaatcataatttgagcttttataaaggacattatcactgataattgaccaagtttcctatatctgacgagaggtcgaaaattgggttatataaagaattccaaaaactccataatatctttccccaagaactcacccaaataactcaatttaaaagtgtgggcagtagaactacccagacacttctctaaagacatacaaatgtctagtggtatttgaaaaagaaatgctcaaccaaccagtgaaatacatcactggtcaacagagaaatgcaaattgattccagctattatggagaagatacaagatgagaagtgtaggcgttgctgtggagaaaagggaacccttgcatacagttcagaagaatggaaatttgtacagtcattagggtaacaaggatgaaggttcctccaaaaacttaaaaatagaactgctgtatgacccagtgatgccctccttccctgggtgtgtatctaaaggaaatgagatcagcacatcaaacagacatctacattctcatgttcattccagaaccattgacagtagccaagatattgaatcaatgttaagtgtttgctaactgatgaatgaaaaatgaaaaagtgctatatacacatgatggaatactactcagccttaaaagacaatgaagtgctgtcatttataacaacatgtatggatccttgagatcattaatgctcagtgaaagaggccagtcatggatagacacactagcattgtaggctctctcactcattcatggaatatggaaaggctgatctaatagaatatgagaatagagtggtgatgttcaaagacttagggaaagtgggatggtgggaatatagtaatcaggaggcactaagctgcagtttgataggaacgtaagtttcaaggattactataatagatggtggctttgtatgtctcaaaaccataaaggactttgaatgcttttgctgtaaagaaataatgtttgagaagaagagttatgaatatgattataggatatagacatatatcaaaatatcaaatcctgtcccattgacatgtacaacttttatatatctatgggtcaattaaaaccggaagtagcctgggggtgtagctcagtactagagtacatcctggtttggtcctcagcaccacaaaggaaaaacaacacacacacaatcccaaaacttttgcaggcacttctcattacttccctcattttttatccttccttcgttttaatcaatatatggaatgtatttttctaccacagatagagatactttccttattaaataatatatgtattttacatttgcaagatgagttcaagaacttgaaataaaaatgaagaccagtccactatcctacttcttagaggcagacccagttgagaactcattttctatctagttgtagctgtagataggtggttttgtgtctctgtgtgtctcatatgccttattcattcccttgagacagggtcttggaatttgaagcttgtcgtttcagctaggctgcttgaccaccaagttcttgggacctacttgcctttcgtcaaggggccggcttgtacttgggtgccagggattcaaattgaagtccatgtgcttgcaagtaacagcaagtgattgcatctgcccctcccctggtctcctcagcccctcccccatgtttgttccttttttgtcaaaatggaaccaagctctatattttgtaattctgtagtttcaagtgtggtaaatacatgtaaaatggtaatttgctttaaagtttaacacagtgggacttgcctacaatcctggtcgtagtgttttgcaagcattttaaagttatagaacattctccttaaagtcaaaagagccagaggagtaagatcagaacttgacctctggcctccatgtgctcactttcacagacatatatacccccaccatgtgtgtgtactcatacacccacacactacccacccattttaatggttggccattaaaaatataatttgttttatagtaatattttttaatataatattaataaataaagtaaaaatttctttctaattaataaaaagtttccacatacctacaaaggaaatcttatcgaaggtaaaacgatcttactaatttaaaaaaatatacctgtgtgtacttgaacacacggacacaaaaatattaaaatgtcaggtcctttgcctcttcaatctggattgatgtcgcctttatttcaaatgtagataccacaagtaagggttctgtcttttccttaaagaagaacacaggtttccccccacctcccagtgcttggaaatgggacctagggccttgtacttgctaggcaagtgctcttccactgaacccctagcccgagaacctagttctttgcttccagtagctaagctctgaggaatcatttgttgtacccaggaatatccatagtgcatgccatttggctgtatggtgcagtcaggaagattttagctttaccttaaatgacaactggggttgtgtcttgtctctaagatggggtatgaattttacaatgatgcttttaattttgatggaacctcaaatattgccatgcacttcttcaagccaccttggagccttaaaatacttaaatggtatttaagcttttggaagtgccctcttatggctacctaggggatgtatagctgagggccccaaggagacataaagcagtaagattgggggggtattcagttctctgattgtgatcatgcaatttagggatgggttttaaatatgtaaatattttaatatatggtatataatatattatacattacaggtaatatgtattttgtatattatatgcttgactgtagtcagctggaaaattaataactgtggtgctcctgtgtgtgatataaaggcattctgcccttttttctgggttcccctgtgttctaggcccagagcacattccaacctaaaaacctcttccagagtgggagaaaggattgtaggaaccagaggggtcaaggactcataggggctcacagagattgatccaccaaccaaggacctgcatggtactgacctaggtcctctgtacatatgtgacacttgtgtagcttggtcttcttgtgggactcctaacagtgaaagcaagagctttctctgacagtgttggctgcttttgtgactcttttgctcctactgggctatctagtttagccttaagaggaggggcgatgcctagacttactgcaacttgatatgccatggctggttgatagccatgggaggattgtctgaagagaattagaagagtggattgagggtgggcagaagtacggaaggatgtggaggataggagagaggggacaactgtggcagggatgtaaaatagacagacagacaaatggaaggactgtgtgggcagggacaaggctgatccttagaagatgaggacaagttgaaaacctgttgtacagctcagcttccaggcattggtggaaaggagagtaacatggtaacactcattgttctgttcacctgttatttatggggaacatcccagagaggagagcttatcagaggctcatttaaaacatgtaacccagcatcccagaaggccatgtctgcttttctgccactgttcagagatggggaggtggggctgacaggaaacttctacatctatttttaagctttgaagagaatttttataaatatgagctgctgctgcttcttttgaaaaaaatccctttttactctaaaaataatgtgctgggaaaaagtttgtgaattgtttattaaagggagaattgaacatgtgttctaataaataaaaaataatcatagttggacagatgggtgagaggttaagagcactggctgctcttccagaggacctgggtttcattcacagcagccacgtggcacctcacacctgtctgtaactccagtttcaggggatctggtaccctcaaacagatgcacatcaaaagtgaaaaggaaccatcaaaaacaatttaaaaaatcacctcatacctactgtctgaatgcagatgtggctttttaggaaggacatcatttttgacattttgacacccatgctgggatggaagaaaattgcattttctcctcctgacctaatctttcatactcgccaaatcctcctcatttcttttgagcgagttggcatgttgttcctttgggaagacagtcctcatttctcccaggcaggatgagtggttcatagtgtctgttcttcccagttcacatagccacacctgcctttctttatcacacttcatattatgtaataacaatcgctaacatttactatatgccaggcattctgctaaacttggctcatgtgctgcattgttagcagcacttaagtactactcagaaattcagcagcaagtactagaagccacagttagggcatctcactcacacccctttaagagagaatatactattattctaattttaatatcagaatcattgtaggctgaataatgaatggtctgccaatatgcccatatatagatcccctgaacatgtgaatatgcatggcagaaaggacttagcagatgtactaaaagtaaggatcataaacattataattataataaaccattatacatatataattataataaagcattgtaattatagtagttcttctaaaagagacaaacgtggacaagacaaataaaaagataagattgaattagagctcatcagaatcttttgtacatcaaaggactcaatgaacatagtgaggtggtgactcatggcatgggaaaaaaacctgacagatgttaacatccagaatatgtaaagaactcatatagcttaagaccactgctaccccaccactgctgctgccacctcctccaccaccaccaccaccagcagcagcagcagcaacagcaacaacaacaacaacaacaacgacaacgaaacccaattaaaagatagttctctagctggtgtggtggaatacgtctgtaatttcagtagttgggggttccgataggaggattaggaaggaattcaaggtcatctttggctacaaagcaatgttgaggcctggcctacctgagatcccatctcaaagaaagagatagttctctaaacattgccaacaggcatatgacacgatgatcagcaccacttgtggtagatactaaaggaaggtaatgtgtgttctaatattctctctctctctctctctctctctctctctctctctctctcatacacacacactcacataaacacacacatcacatgcatctctctctctctctctctcacacacacatcacatgcatctctctctctctcacatacacatacatacacacacacacacacacacacaacaagaacaacaacaaaaaacaaaccaaaagccctggcatggtgatacattactataacctctactcttgggaggcagaggcagaaggatggcaagcttgaaggcctaggataacaagtccaagccatgtctcaaaaccaactcagaacaatgacattaacaaccaaagctcaagggccaggagtattggctcaatgtctttaatgttaacactcaggaggctaaggcatgtggggctctgtgagtttgagtccatcctggtctatgcagtaatgagttcgagtccggactgggctacgtagttaagtccctgacatcaccaccaccaccacaacataatgaaatcaaagtaaattaaaaagttctctgccattcttcctaaaaatacaaatacatgttctatgtgcacaattcattaatgcctgccaggggaagagaagtgggagcccacagggaataggtgctttgcttttgcaccatactgtcctttactacttgatagtttactttcaggaacaagtacaccttgaagattattaactccttgagtgatttttatcaacatgtgcatagatcatagaatgctgaaagacagcagtaacttgtcccacctctctggatttccatcttccttctctgaggtggccactctcctgtcctagctgtggcttctggtacctgctgctgtgtttctgagtaagacatattccttattatctcttacattgccgatgccaagtatcatctgtgcagttttaacgaagctgaagatttggttcacctctttaaattcccatcttctgtatactctcctaacctggattctgctagactcttcctcactatttttaatgtagtagtgtcgatgtcaactaggaagcaagactattctgtaattaattttctcatgtaacttgtaactttctctagagagaataactcactctcatatttgctgtcatctaggttttcccataccttgttgaactgggcagctttataaaataaaataaaagaaagtgctcttcatccagaaatttttctctatctcctgattcctctcttcagggaaaaatagcacacacattgagacccgtccagcttctgctgcattctgaattggctgctgttattcctttcttagtctgttggtgctgctttttaaggtgttgcttgtttggtagccaggaaactcctgtcgtctctcttatatcgactgtcttgggtctagcatccttctttctgtcttgctttatttacttgctttcatggagacagagagagagagacagagacacacacacagagagacagagacagacagagagacagagacagagagacagagacacacagagaggcagagagagacagagagagagaccgagagagagagagagacagagagagaaaggacacacagaagtcaatttttgagagctttacaagactaactgtgctagtatcctatgctagttagttaaaactctattgcagtccacctccctgttcctaagtggggttctccatcttgttgtgccttctttctcatggtctcactgggcttcacaaataccttcatctctccctgcaactaagaaaatcaaggcccagaggttaccacattagcaatggtgagccagaacgtaaagtccagtgtcagctgccaactccaggctgctgcctttctgcacacagctgctccttaccagagagagaaataccagtggcaggctccaagtgccgaacttcgtgccaagtgcacagccatggctgcagagtgagcccaattctaggtctccatttgtgtctggctcctgacaacttctagttccagacagctacagctgcagttaaccatggtttgctacaaaacgtttccattcttgttgcctgtgcatatgcgtgcatgtagatgtgtacatgtgcacagatatgatagatagagagagacaggggtttatagttgtgttctgagctctttcatatgtttaaaatgtcctgactttctctctctctctctctctttctctctctctctctctctctctctctctctgtgtgtgtgtgtgtgtgtgtgtgtgtgtgtgtgtaaggttagggtaattgtttttattgttactacatttgctttcaagcactataagcatcccttgcattcttttggtgaggaatgcctcatttcttaggagtttgctgttggaggtgcagcttggcatttggtctttttgttaagtgaagttgggtgactgaccacacatagggtaattagattaacctactcctcccctcctctactgaaacaatggaaaacccagtattgcgttggcacatactttccttagattaatgatcctagagtcactgggtggaaacttgcctggctccctacagctctgagaactgaaaatgcccagctgtctaaaagctttaatcaggaaatgagcatgaaatggcattgttataggatcgaaagaatgtattctcgatgattgagctagcctggatgggaatgtgtgtaaacattctttcaccaaacagtaaacaggtgtttttatgttggtaaaaaaaaaaatcaagaatttaattacttgggagtggctggcaactcattggctctcacattgtgctggtcgctgctcaaagttgatactacaattttccttgtctcttctgtttcaattacttatggagcaaaaggagagctgatgtaggaagcagttgagttctgtgtgcagagcatggtttgtgactgctagcacagggactcagctataagacaccttcaccaactaaccccttgtctgcatggaatttaccttctatatctgtcaaagccagacaataatggccccacttctcagtgatgttgtgagtattaagtgttttattccatgtatgcttttagaacagtatgttgctcatagtatgctcttgtttgttccagtgtgtgtggtgtgtggtgtgtgtgtgtgtgtgtgtgtgtgtgtgcatgagcacacatgcataagtacatgtgtgtgagtgcatgtgtgtgtgagtgcatgtctggtcaagaggtcaagatgtgagtgtctttctctttcattctccagtttgtattttgagacagggtgcctcacaaaacttggaagtcagcagttggctagattgcctgagcacttagctcctggcatccacctacctgtgcctaaccagtaccaatcagcattataggcacacacacacacacacacacacacacacacacacacacacacacacacacagagacacacacacacacacagacacagacactgctgtgctttgcttttaaacatggttggagggaagtcaaactcaggttttcatgcttgcatggctaaaacttttatcaattgagccatcttcctagcccctcataatttattcttcataactacagccatattccctcatctttagaagacacagaaaaaaacgaagcttattttcagttttattttaatgtactagttttccccattagtccacatatggcattgtgtatctttaatcccagcatttgggaggcagaggcaagcagattattttgagttctcagccagccagggctacagaatgcgaacttgtctcagaaaaccaaccagccccaaaccaacaataggggatggaagatgattcagaactatttcttccccttaggtactcacagagtacataaaggatagacatacggtcctatacttatcatgcaggcagtgcctgggagaggggttctaccaccgggccatgggaacataggctgtcatcattaaagctgttaaaaagagtagtagtggtccttgaaccttggctgatactccctctgcctccttttcttcccaaagcaagtatattattctcaaatttgttcctgcatctgagatgatggcttcagaggccaggtatgatattacacgacacatttcaaaatctttccagaacataacattgatcaggaaagtgtccacaccataattcaatttgaagtcatataattaatcttttggagcctaataaaccagtccaaactatttagctcttggttccactttgggcgttcaagaaactctgttgtatcagtgactgaaccatagttaaggtttagtattgcttttttataatcattttattttcccagactgctgttaagccactggttttacttacaactcaggagacttgtgttgtgtctggtgctgcacacctatgatctatagcactctgacatctgacgggggaggcttccaagttgaaggccagaatgatatgtgtaacaagccctatttcaaagcaaaccatcttgattttttttgttatactcctgagaaaacaattgactttgagactattgtaatttttctcccagttcagttttcacgtctctcctttttgatgaaatgtgtagactggagaactttctctaactgtgtatatgttatcattactgttgacgctgtgggtagttgctgtggaacaggagttctggaaggctgcggcagggggcagagcttatatgtagatggcctgtctagtgtgtattaagcttccactgtgatccagccatgcccctggtggtggtgggggatcaaaaccaactgaccaataaaccaaccaatcaaccaaaaatgaaacaacagctctagagtcatagtgattagctaaacttatcaggggctagtttaattatttttgtttccagaaaaggaaaaaaaaaaaggtaacattccgtagtctgggtgagaaatggtagccctgcttcagttactaatttttgtattgatgacacgactaactaggggctggaaagcggatggctgagtcagctaggtgcctgttctgcaagtgtaggacctgagctcctagcccagcggggtagagtggagacaggcagatctgtgtcagccagcctcaccaataagtacaccatgggttcagtaagaaagcctgtctcataaaacaagggagcgagcaatagaaactcaatgttgacttctagcatatgcacagataaacacagacagacacataccagaataactggcacatggcaccagtaaaaagggacaaaaatatatgctttatctgtctcttggctttcttgttcccatccctagaggaagccttgggtatcaatttactttatgtgggatccgtattacacattgaggtgtgcgccccaatttatctaaatgtcagagtgcattcttatgcttcttgacctagaactgtgtcttggcgagtttccttattgataaatacaagcaggcctcattcctggagaaaattgcactgtgagacttcatggtcacaacctgtctactatagttctgttgctttaatcttttgctactttaaacaatgctgtatcaggtaatcttgtacgcatgtcatgttgcacatgtgaaagtatacttgtagtttaaatccttccgagtggaaataccatgtcaaaagtcataggcatttagatgtttgataggtaattaccacattgcttcccacagaagttctggtgatttatatactaatttatgttctcattgagaagtgtgagagacactccttttctgtactcttgccaacaggctattgtcaattttttttttttggttggtgccagtctgatagattaaaaatatctcattgttattaaaattgtgtctatccttgtctagactgtcaacttctggagaagtttgtacttgcagtttcccaaatttccagttctttaagggaataccagctgtgtgctagtcactgagacgcattctatgcaaacagctcctatcctgagaatggcagactctatgtaaacattattgtgatgcagtagacaggggctacaactgtaggtatgagaacaatagtgagtcctcctgggcactgaacacgcttcagacattgctgactgcatgccagtgtgatctccatttctcttatgagtacaattaagcatcgtttgatacatttgagtctttgacccctagcacaaagagctgttctttactgttttgttggattattcatctctttgctactaatctggagaaggatttctctttatgtagcaggtaatattcaccagtttgtcttttgccttggttgatgaacttcctcttgtttgtgttttgctgtgttgcgtttacagttttcaaccctttgtcttgtgggatctggattctatataagagtgtcaaattgtcttccctcatttgaattataaaacaattcccttcatgttctcttttagtgcttttaagatgaatttttaagaatgaaaaaatccatgatcacagttgaagaaaggattattatttgctttaaaaatgagacactggaggtttcttttttctttctttctttttttaaaaatattttttattaggtattttcctcatttatatttccaatgctatcccaaaagtcccccataccctcccacccactcccattttttggccctggtgttcccctgtactgaggcatataaagtttgtaagtccaatgggcctctctttgcagtgatggccgactaggccatctttttgatacatatgcagctagagacacgagctccgggatactggttagttcataatgttgttccacctatagggttgcagatccctttagctccttgggtactttctctagctcctccattgggggccctgtgatccatccaatagctgactgtgagcatccacttctgtgtttgctaggccccggcatagcctcaaaagagacagctatatctgggtcctttcagcaaaatcttgctagtgtatgcaatggtgtcagcgtttggaggctgattatgggatggctccctggatatggcactttctagatggtccatccttttgtcacagctccaaactttgtctctgtaactccttccatgggtgttttgttcccagttctaagaaggggcaaagtgtccacactttggtcttcgttcttgagattcatgcgtttagcaaattgtatcttatatcttgggtattctaagtttctgggctaatatccacttatcagtgagtacatattgcatgagttcctttgtgattgtgctacctcactcaggatgatgccctccaggtccatccatttttctaggaatttcataaattcattctttttaatagctgagtagtactccattgtgtacatgtaccacattttctgtatccattcctctgttgaggggcatctgggttctttccagcttctggctattataaataaggctgctatgaatatagtggagcatgtgtccttcttaccggttagaacatcttgtggatatatgcccaggagaggtattgctggatcctccggtagtactatgtccaattttctgaggaaccgccagactgatttccagagtggttgtacaagcttgcaatcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttctggtgcttctctgccattcggtattcctcaggtgagaattctttgttcagttctgagccccattttttaatggggttatttgattttctgaagtccaccttcttgagttctttatatatattggatattcgtcccctatctgatttgggataggtaaagatcctttcccaatctgttggtggtctttttgtcttattgacggtgtcttttgccttgcagaagctttgcaactttatgaggtcccatttatcgattctcaatcttacagcacaagtcattgctgttctattcaggaatttttcccctgtacccgtttcttattcatattaccttgttatcactcctaagtaaaatttgcatcttgtcaagtgagatactgaagatgcttcagtgaattctagttatgtctcagtgtatatgacatagatctcatgttttctcaggtttggagatgaacttagccatctttaccatggttggtgtgcccataacaatatagttaattggctattaatttgctaagtattcattaagagccttctacagcatgtccaaacacttagttagtattgacactgatacagtggtactcatcctatatgtctggcggttgtgggcaaacgtaaagatactggctgtcacataggtcattggaacatcatgaaacagtgttctctattcatgacataaaaatagccctttacatctttgtctagcactgcccctccttttgatgacattcattcctatcctataggtaaagagattctctgatcttgtcattttcctgtccaggttaatttgggggagataacactgtaaatatataatatcacaaatacccagttgaagattgacatagaaacatgacagtaggtattcctgctgcatcaaaatgtctttccttgttagctttaagctgaaaatgaaattggtacatttataattgcatgtcaaagtgcttctctgagtggcagcatagtttgtaaatatgagaaagccattgtgggatgaaacatccacatgctttcattatgtaattttgaggggcagtgttgaaatgtttctaacaaataccaaataccaatgtgcccaccatcctgtcatatcaaacactcatattttgttatatttacttatgtatgggtgtctacagatacatatgtatcacatatatttctctaatgaagcccgtatatttcatggtttgacaggataactcttgccttttcttttcctccctctcccgccccgcctcccgccatacagttttttttttttttaaagaaacactctttctaatccagctgaagcttttcctgtcctattggttttgctcttaagagtccttgctgtgtctccccaggtgtgctgagacaactagcatttgatgagggaagccacatgctgggaacacagtctgtatgccaggaacacagtgacaggatggcctcatcagactttggtgtggaggagaaaaccatgtggcagggagcagggtgctatttctaggcttctctagctggttaaagttgtcttggttagtgcatttggtgtcatggtttgttttcagtgatttccttttaccttcatccagtaagtaattctgagatgtggtttccataaactaatgcagtgtgtgttgggggtggtgcacacagctgtggtcccacttacatgtctgactcagaaggaagcttttccttcaggaagaaatatatagaattgaaggaagatgaccagggatgcctgtttccctcattattatttgaacactgtggggacccttcccaaccagatgtagccctcccattccaaagggaagtcccaggacacacatcctgagccagtaagtgggatgctgagctcctgagcaccccctggtgtccatggcaccagcttgctctgtttgcatctattactggcaaccagagagaaggaaatgttataagctagagggacagacagcagctggagaatgaggatctattgagctgattgtacaaataagatgagatgtgtcttggctcacttcctcaatatgctgcatctggcttagtgtgaccatccgttaccttaatgttcatctcagaaagctttgcactgcctgagaggagcattaaaatatgcaagtacttacttgtcacgtttctggtcttctaagacaaaatattagcatgtttagaatgaaagattatcttctttgggtttgagtactcacgttcttctttattgaaataacctacagtaaaagtacagaggcttcagaagtgcagttcagtgaattgtttagtatttatatgcctgtgtagctcactattacccaaaccaaattacagaaccttctcatcctcccaacaggtcattcttgcttcttcttcctcctctaccctgtaggaacctctacaaaggtgaccactattttaagatctctcaaccagtgattagttttgcctgttggtggactgtaatgaaattttacagtatgcaatattttgtgtctgtacttagcattattactgtgaggttcatttgttgtataatgtgtagggtgtgtgtgtgtgtgtgtgtgtgtgtgtgtgtgtgtgtgcatgcatcatgcatgtgggtgaggttagaggaagatgttgggtatcctactgtattacttcctatcttgagtccctggagacaggaccattcactgagtctggagctaggttggtgactagcagaccccagtaattctgtttccatcctatcccaccaccattctgggtttccaggcccacgaagtcacacccagccttttctgttagtgctgtagattgtaactcaggccctcatgcttgtacaataggtgctcttacccgctgagccagcttcccagccccactgtagttttttttttttaaatagcactcaactattgacagcaaataatattttgcacagtagttctcaatccattagtttccctcaagatacctctctgatgacacttttagcattagacaacttttgcagatggcgaaagggctgcttagagatttgaagcattgcttccaaggttctgctcctgatctgtgatgccaggactatttctaactttctggatcagagcattcaatctctttggtcatcatgaagcctctgccctaccctactctctctcatggatggtagaagacacaatgaaaggatgagaaggatgagaaggggcagagttctccccggaatttgcctttggtaggtgtttgaccatgaagtgttttggctgaagactgaccaagcaatttaaagagtcaagctagtaaccccgaggacttgaatactgtgtcatggatgggagagaaaaggagaaccaactaggcagccagccacatccaggcagctccacttattggaaagtagactattcattctggttcagcacccagttgcatacagattatgtgttggctcaacaaggtggctctctgcaggcccctaaatatgtcacagaaaagatttctactatattaacacagttggggctgttattctctgaaaatgggtcagccatttcagctctgcaaagtccaatgccccggggagcagtggcagtctgaggagttctctatttccttatcttgggcatgcctcaaaggcatagctctaacatccttgcactattgctgtcttgttgatgaccttagttttattgtgcatgtcatatttccattgttaagtgttttcactagggtttctactgctatgataaaacatcatgaccaagaagcaagttggggaagaaagggtttcttcagcttacacttccacattgctgtttatcaccaaaggaagtcaggactggaactcacacagggcaggaagcaggagctgatgcagaggccatggcttgttccccatggcttgctcaccctgctatcttccttccttccttccttccttccttccttccttccttccttccttccttattggatattttctttatttacatttcaaatgtcaccccctttccaggtctcccctccagaaaccctcatcctatcctccatccacctacccacccacccacttcctccttcctgctctggcattctcctacactggggtattgagcctacacaggaccaagagcctctcctcccattgatgctgaacaaaggccatcctctgccacatagacagctggagcaatgggtccctccatttggtgggtccctcatctttggttggtggtccagtctccgggagcttggggaggggagcaggtttggtcggttgacactgcttgcttgcttgcttgcttgcttgcttgcttgcttgcttgcttccttccttccttccttccttccttccttccttcctttctttctttctttctttctttctttctttctttctttctttctttctttctttcttcctttcttcctttcttcctttcttcctttcttcctttcttcctttcttcctttcttcctttcttcctttctttctcgagacagggtttctctgtgtagccctgggtgtcctggaactcactctgtagaccaggctggcctcgaactcagaaatcccacctgcctctgcctcccaagtgctgggattaaaggtgtgcacacccggcttgacactgctttcttatagaactcaggatcaccagcccagggatggccccacccacaatgggctgggtccttccctactgatcactaattaagaaactgtgttacagacagatcttatggaggtatttttctcaattaaaatttcttcctttcagataactctagtttttgtgtgtcagggagggcaggaacatggaggtaggagttgatgcatagaccatggaggaatgctgcttactggcttgttcctcatggctagcttggcctgctttcttatagaacctaggacctctagtccagggatggcaacacccacaatgggctgctccccgccccccagtgatcactaattgaaaaaaaaagccttagagttggatctcaaggaagcattttctcaactgaggcttcttcctctccgatgattccggttgtcgatgattccggttgtgtaaagttgacacacaaaacccgccagtacattaaggcaccggatttgagaagagaatctgggtttcttttccacctaaagaggtttgctgatagcccctatctcttgtactgtatttaagtggtactgtaatggctaatttatacatgatgacatgtgcatataaatctccacaagcctttgtagctcatagttctacccagggtgtagcctctaactctgagacactaggaactagcattttaacaagcaggcttaattatcacaaagctgagactaaggatgggagactatgaacacccagtctgggggaaatctagcatcctgcaaacttggctcagaacctcggagagctccaggtgtggctgctccatctggcaggcaggaattgctttagtgccaagtgtaccatcctgttcaggaaggaattctttcatgtgcatgataaagggcttggtagattggggcctagataatctcaggtttatgggtagaggtagagtgaatccattaagcatgcagacaggcttccatcatctctagagcctcaggcagaatgcttcaagtgccctccctatagtcatggcactggctccttaggggaggccagaagtgtcattgtacatctggtctgtgtctacaagatgactctgcttctttgcacctttgtgccttggtctgctcttgcattctgtgtctcaaaaggagcaaatggaaatatatccatgaaagaacttcacaagtataaagttgtgttactgggaccttcatcatctgtttttagatgatcccaataggcatttgtgatgtcagaattcagtgcaggtacaatataggccaacttgcatttgcatggtaattggtgccatgggggcaggatgcacaccatgcatttctagctagaagcagccatggagacttgcagcttgctgtgatttaaaaatttttgaatgaaaaagttagtcctgtggtttttctgaagcaactagagatttcagaagaatgacacatcagacgtttgttttagaaataccccctggttgtgttgtggagactaaattgggaggggggagattggggagagactgagtaaacatgtaactgaagcagagctcagagaagtgtggctgaaagttgaaccttgaggctagtcaattggggttctaattctgctcatttatttagttctctgggtgtattattctgtgactgggacttgtatacagcagagacactgctaactagatacaacctctatggagggctttggcacattgtgtacagtcatatcaaacctatcattttgacttttagcctacaactggtggtgctgataacattcacaatgccatacaacagctaacactattctcaaagcctcaaacaagagctctatgaatattaaataataacttccaatttcctttcccctactcctatgtaacctctaacctaattcttgaatttacatattttaaagatctcatagaaatagaattgtgtatttatccttttgtgtctggcgtatttcacttagcatgttttatgttcatctgtgttgtgttgtatatcagaaattcattttttaaaggaggagtactattctattgtacagttgtacaacagcctgcatatccatttatctgttcataacccttgagtttctttcttattttggctaaattatgctgggattagcattgtcatatgcttacatgcctgcatctctgctttcagagttttttttttttcttttttagtatatccctaagagtagaattgttgggtcctgtggtagtctctgtttaactttgaggaactactacagcatctttcaccattctatattttcttcaaccacgcagaagggcttcatttcctccaaatccttgtcagttcctgttgtctctttctcaccttctctttccccccttcccctcccccttcaatgcaagctgtcttagcaatttgaaggggtaccttactgtggatttgatttccatttccctaatgactagtgatcacacatcttgtcacaagcgtattggccgtttgaacttttcctttggagaaatatctaagacttaaaaaaaaaaatctttgttttcaagataatagaggaagaatggagagaaacagagagaggaagtggtcaaaccagactgggagacttgttagatagggaggggacaaatgctgactttttcagcctgggtaagtggacagataatgggatgccaactagaatagaactcccctatgagaagcagtagttggaggagggccttccacagcccgcactgagccaaggcgttgttcaggttaggagctcccagagtttgctgccttatcatctacccaattgtttttgttttctggaaaaagtgagtatcttccacctaagaaacaacttaagaactttaatcaaatttgaacaagcatggggcgggggtggagagacaaaggattgtggtgtgtctaggcaagcttctagctctatctttctgttccacttgcttctgataggttggtccttcacaaccaggcttcatgatatgctaccctacagcactgggacctgtgcactgttgagaaccctagcttctgagacttcgtctactgatcatcttagtgaccacaatctttgttctccttgttacctcatcccagatatatgctgttaacagaagggtagtattgctagcatggtccactgaatatcttagaattcctccatagcaaaggtagatggttgttgttagcaaccattagagaaataagtgtgtttgatggcttcttctcttgtcttcaagagtcatagccggctggcagccatcatgtggcttaggcagacagtgtttgcagattgtcccctgatgccatctgcctgtggggctacaggaaacaccagcaactgctgttttagcaggtgctgggggcggctgaggtgggtgtccctgtatacacacacacacacacacacacacacacacacacacacacacacacacacacaagtacatgtgagcagctttgtgtgatatgcagaggtactgctgttggtgtgggactgagctctgcctccttagggctcagggatgtcagcccaagccctcagcccggcacagccctagctcacttgttggtttccggtggggccctggtaaaggagcaacagagggtgaggctgttgtgaaggaagctagtgattggcttaggggcagaggcaatgttttgacaagcattgttgttttctatctacctcagccttctgactcattttgtcaaggggaccaacctaagttcttaacccgttgatttgaaagcatacatgctttatctaagcctttcctgtcagtcagtcttatttcaggtctagcccctcagctttagttttgtccctaagttagtatgatcatgggctcagagatggatagatgtgacttgctagattttgggcaattagtgattttgcaaagaattatccaagttatgaaagcaatataaaatgtatgttgagtatcccttactcaaagtacttgagaatagaaccattttagttttaggactagaggggaggtcttttcatatacctaatgagatactatacagttaagttccaaatctaaaacaaacacacacaaaattatgtctcttatatacacataggctgagaacaatttggtacattttcagtacacctctggttgtaactgtaaccattcacatggggtcaggtgtggaaacctcaaaaagttttgcatttggagcagttcatgttttttttttctttttttttccattttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagttcctccattgggagccctgtgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttaccagttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcagtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaacttttgagtttcattaggccccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttccttaatttctttcttcagagatttgaagtttttatcatacagatctttcacttccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctcctggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccagttcatgttttataaaaggaatattcagcttgtaactatatttgcatcaggtttaaaagattcggatctctctctctctctctcccccctccttctcccccctctctttctacacacacacacacacacacacacacacacacacacacacacacacgcacgcacgcacgcacgcacgcacgcacgcgagcgcgcgctccatcattctgttttattcctttaaaaatatttcgttttaaattttttttatgtacatttgatgtttggcctacatctctgtgaggatggccgatcctctggaactagaattatagacagttgtgagctgccatgtgggttctgagaattgaatctggatcctctggaagagcagacaatactcttaaccaccgagccatctctccagtcccctgttttattcctttgatatagagtctcccattgaacctggtgctggctgatggccagtcccatcaattgtcctgtctcttccccaccccctaatgtgttgctggagttactagcacacattcaaccacaccagactttttacatgagttatggggattctatgtcagcttttcatgcttatacagcaagtactcttactcactgagtcattgactcaacccaaatatccagattattaaaattgcatctatcaatcgattatatggaagacagagggcaaatttctggagttggttctctcccttaccttgtgtgtcctaggaattgaactcaggtcacttaacaagttcctttagccattgagctctttctggccccaagagtcagatcttcaatgagtctggtaagagtccacctacaggaaagtcagcaagcgtttactgttaaagttcggatatttcaggcttcgtctctgtaacaacttcttaactctgaaattagagcatcaaaccagccatacaaaatacacaggaatgcatttgtgttataatgaaattttatttacaacctataatggtgggctggagtttgctgacttaaaacaatagtcattattatttttttaaattttattggttattttttaatttacatttcagatgttccctttcctggtttttcctctgaaatcccccccccatactatcccctctccctctgcttctatgagggtgttcccccacctactcactcactcctgccttactaccctagtgtcctcctacactggggcatctattgagccttcctaggatcaagggacccccctcccattgatgccagataaggccatcctctgctacatatatgactggagccatgggtccctccatgtgtattctttggttggtggtttagtccctgggagctctgggggagggggtctggttggttgatattgttgctcttcctatggggttgcaaaccccttcagctccttcagtccctcccctaacttctccattggggatcccatgctcagtccaggggttggctgtgagtatcccacatctgtattggtaaggctctggcaggggctctcagaggacagccatgcctggctcctgagggggaaaaaaaatctcgtcaagtagaggaagcaaaggatctgggagggagagaggagggggagagaaaatgggggacctggtttagatatgggaggagatgggggagaagtacagagggtcagggatttgaaaggaggtgtgcagcagtggggacagggaaactgggagtagttggtggccattatttttatctgtcatttagttcttatcctcccctccctttaccccctctctggtcaggaattaaaaagcttgagagacttgaggactacaaatgcatttaaattatcttttgagtttagtataattatgagcatggtgatggtttgtggatgtagttttgctaaacctttgttgagaagaatagaaatcagagcttttgaagtagggcatattcttggttgaggcttggcatagttgaaaaaagtaaaaagaagccataatttagagctatgtgatggcattcacatctcagtcgttctcctgatgctcacatggaatggctccagttgtataagggaacctttctacactaggcattattacactttataggactaggtgtttctttaacaaatataagaaggaaataatacaaattcagacaatggtgtttgacaaatgttgtattgtggttatatatggtttattaccagagataaagaggttccccaaaacttcaacctataaatactttctccccttcccatatctttacaggaaataaagaaagatatgaagaaagatcttctctctaacaaagctccagagaaacccatgcacgatgtatccagtggaaacgctctgctttcttctgaaaccattttaagaaccaataaacgaggtatggcaaagtgggagacctttctccctacacatgggcacatttgaaaacccttgtatgcataatgtcaaattgagcattaccgaaaagctaaggaatttgtctttctggttttcagtataaattttgtgtgtacatacatacacacacacacacacacacacacactcacacacaagtggtaaaaagagttaattttttttcagaagaaagttgagcaaacttgtaaatgctttttctaagggtttagctaagatacaggctgatatgagtatgtccgtccatacccacctttgaattataatacactctattagcatctgtctctttaactgtacaactccctaatgtatttacaaggagggatgttcaaagatatagctagtatatcatctaatccgtaaatctttatcagttttgttttcccctttgttgagacattaagtcactttcacatactagtttactaaaactgctttgttcaccacctgccctggtagtaactattttttttgaatgctaggaaagagaatctaagagttcagagaagactctactcagttctgaactgttctgaccttagggcagctagggcccacagtaagctgagcatactcacaaaaggttagacttcaactgccctcttttcctgggcttattacatccttaaaaaggaattgagagctcttcaaaaccagcaggaagaagtgaattagcaaagagttccgttaacaaggggaaaaaaattgcaagtttacataaccacagggaagaacagctaatctttcataaaatttagacagcatgagaatttgtccaataaactacccattgatcctactgctggtgacattggctttgtgtctctctcccttcctggctcttctgctgacccctccagctgccctgggttccatttcctattttgaattattcacatgaaatattggctagacgcccaagttggttaccaactataggtctttctttcttccccttcttttttttaaatctcattgtatcaaaattggggctttcccattttaagaatttagcttatgttactataaaactatagtcttcccaatgtgcctcctgaattctttttaaaagtattttttatgacacaatctcacatactatgtcttaaacagtctgactggccttaatttttgcccagcctagtcctgaacacccccttgtctcaacttccaaagtgctggtatgacagcctgtgtatcctgagctaacaacctgagtctccattcttgcacatacattcccaaagctcagaggaggctttgactgtggaccgaacgaagagctggagtcctgtggcttctgtgagctgtaaccttcgtatggctcctctcaagtcaataggtccagcgattccatgcagagtgactactaagtcaggtttttctggtcacccctggtattttatcaagtcagtatgggacttagcataattaattttacaagataaagaaataattaaagcaaagaatgaaggtaattatctgtatggcttcagtgaaattacctcaactaaaagaatagaactttgcagatacttgtttctttagaaccgcaactctggcctttgagatccccaaatgaaatctcttgttcactagaaaaatgaattccaagggtatagtttatttgactttttaaagccttctaccttagccctacagataatttaagacaaaacttttatagttggggcttttccatgctaaatgccagtaactatgagacctgaacaggcaaaggcaccctgtaactaggaaggccattacagctcatctccattctgttccagacttcacactgacctctggggtcacctgggccaaacatcagttcccagctgaagggaggcattgtgtaccaggatgggtgctgtttggtcctcccccatcccatcaagactaacactattttgctcctccttataataaacagtgtgtgtggtggagactgactggccttgtcaggccagataaatagttcattgtactgatctcaaaagctacgtttctttcccacccaaaaatcaatgaaaaacaaaaacaaaatgcccccccccaacacaaagatctgaggctaaatctgtgagggatcactctagttcctcctaaacttctgtgtaaatttttcaagcttttggacttaagttattgaagtccacccctccccttttgtttccagcaagctttgttcttaaaacctttaggatgttgcagtctgtcagtatctcttcatagctatgatcaaaagaggaactctttcttcgggtttgatagtctgttttgatttgctaatgcgtgggatctttccccaggtatatgaatctactctgtaatcccaccttggaccctgtgagaattcagcagaaaacacaaatcccttttaactaagctaaagatgggagggctcttttctttctatgagcctggtcatttgattcaggcctggaattggtttaatgaggaaagaggccatttgaatctggttctgactctgaacttgaaccctgtcactggggcccgagcttgagacagacttagctgaagatgtttacccagctgtatgcagctgttactgtagtttgtgatattcctcactctgtggcagttgcagacagactgggtttcggacctgatgatctggagtaagcttgccttccccctgaacaatggcagaagaattcagagtctaagggagacccctcataaccccgagaaatggtaggagcacgggggatgaataataggacacggctagcgttaattgtggcatttgcagctactaaggctgatctttgcactgacagggttgactcgttgggctgtttgtttgagaagaagggagatgcagctagagttcagagaataagccaagcatcccagctggcgtggcagccatcagctgcccatttgagcctctagaatattaagtaggtggaccctgtttccacctcaggtcacaggtaacaaaacctttggcccagatatgacttcttattttgtaaattttttttctgtcgttaagcccatacagaagggggatgggctttcccaaaatagaccgtgaatagacaaagggaatgtttttgtttttgttgttattgttgttgctgttgttgttgttgatttttttcaatgttcaaaacgtgagttgagaagcaaaattgaaaaaaagggaagttttaacagttacaagcaaatatgttctccaagatgaacagttggttttgaacatcggaatgctcttttctacttgaatccaaaacaaaataaaaatcatttggtttcatctgtagaaggaactcctgatcagctttctccacgtgacgcattatatatccgagctgtagtctatcctttactgacctaggtgaaggccaggtttatgctgggcttctggcttctattcttagcaggtcaggcagggaagctgtgtcttagcattcccttcattcctgcctgtgattttggacattgttccttaaaaaaatttttttgatgaacaccagtgaacactctataacatgtgattattgcatgccaactgtgcaccccatctagtgcctggtgcttgtacaaagactagaaaacaagcaggcagccctgcctgcaagcacttcaggccacatgggaaatgttgagagagtactgtccattccttacatccctttaaaggacaaggtgggggtatatctcttatttacttttgtcattcttaatgtgaagccactccgtgggtttctggttggctttatgtgtccttgtttctatttccagtttatcatgaattcagtgtttggtaagtgtctattgtattttgtgcatttcttatcctttgctattactactgttattgttatgctcttctgatacaaaatgtattttataatcatctttttaagccgctctgctactttggcatctgccttctgaaagataaactgcttcttaccatctttatttaaggttatgcatttgcactttagtaccctttccagagataaacgctcaaggatctgacagttttaaggatgttattggtaacaggtctagctctgatgctgggaggtgagatcatctgtctcacatgagattctagagaggatgggggtgggggggacggttgctccctgtactgatatgtggatctgactttatagaacattgctctgtgagttctgttctggtacatttaatcctcccgacagatctgactcaaagccttccttagtggaaggaccaaataaatgctctgcccctggtgacacactgttgctttaaagatccgcatggaaaccttcagagttcattttgcatgtggatgggtggtacttgcatgcccttcacattaatatgggcctcacgtttgccacacagaagtgctctccatttgagactactacctgtagctatccaaagaatttaactaatgtgtagccttcttttcattgttgtatcagcaatagtcattttggtccctaaacagatctggccaagtgaccactctctcctgtcacttttcctgaaatggaaatgtatttttttttaaggcttccatttcttcatcatttatcttggctgcctgggataatacaccaatggagcaattaccccttggactgattcatgagactctgggagagggggagagcatgtgcatatgtgtggagatatgcacacgctagcatggaaagcacatcatggctcagaggctcaatggcatggaaaatatttttggagacaatgtctccttatgtagcccaggcttacctcaggctctctagcgattcccttgtttcagtctccagattccaagcatgcaccaccatgcctggctggcatggctcttgaaggccttgggctctttgttgaaaataatctgtaaacaaaggatacaaaaagtgtttgtggatttagctcagtggtagagtgcttaatgctggtctctgttcttccctttgggggaaaacacacacaaagcaaaaccagaagagctcatttggcttcctggtgatctgttatttaaggtctatgcaaaagctgcggttttgctggtagaaaggaggaggcctttttcctttcaaatgtgaattttcctgtagctaactagatatctgaaaatgtggcattttgtgtcagattctccttgatctgtttaaaatcccatgttgatctcaccggaagagctagcttttatggactgacaggggaagagttaacaggaggtatcaatgttgtgtggaaggtattggttatcaccagagctgatctttcctaaggaaaatgagaagctggaagtgagggcgtaggaaagagagtcacttcatagcatgcacacctgcatatatatctgggtatgcatctgcacttcttccagaggcctccgttctgagaccttgtaactaatagccctggccatatttttaggatgcttttatgcctgtgttaggttgatggtgtataatgtgttattcttgctcattcattagtgagtagtcctgccagcctagggatacaactgtggaaggggatagaaagcagctctctggagggttgtagctattgcacatctgtgctttgtgtgtgtgtgtgtgtgtgtgtgtgtgtgtgtgtaagtcattgacaaaattggtatttagaattgttcttctattatatataacccttgaaacccctgtgccctgtccccaatacgttaacactacgtagagtgacaagtatcccaccacactcatactggatttccacccaagtcagtccctaaaagacacttgatatgggtttgaagtggtggtaccacctggtggctttctgaggaaacttctcctcttgctcacctttgaggctgcctttggctccccagaccctgtgttcgttctcatttcatccacctcagacccacagcttctcattgtaggcaaacattcccttcagccctctgctttcttgtctaagatttgctaattggactcagaatctgtttcatgatctgaactggaactttaagggttctctggaaagtcagttgtgttggatggtgttttgctggggcaaacatgtgaaggagtgttttcctgaagtggacacaggtgaaagactaaggcagcccggtgaaggaacgtttcactgaaacagaacaccaccaacataactgactttccagagagctcttaagtttccatgtcaatgatccttgctttattctccactaaccaggtttttcttcaattaggaattatatatagccagaatcttagaatcttggcacttgggaggcagaggcaggtgatcaatctctctctctctctctctctctctctctctctctctctctctctctctctgtgtgtgtgtgtgtgtgtgtgtgtgtatgtgtgtgtgtgtctgtctctgtctgtgtctgtgtctgtctctttgtctctgtctctgtctctctgtctgtctctgtctctctctctctctctctgtgtatgtgtatgtgtgtttccatgttttgtaacaagatctcacaatgtagtccagctggcctagaatttactgtgcagcccatgctggttttgaacttctgatagtcctcttccctcaaccttctgagtgctggcattacaggcatgaggtaccacacccagctctttttgataactattaaaaaacagagacacctataggcatgatttttggtgcagatattaattgagacaaaacaaagcttcatgctgaaatccctataggcgagccaaagcctcctcctcatggctccaagtactcttaattacttcttcacatcttgttgaacctgtgtttcctctaaggagcaatattttttattactcatgttgttttcagttgccagcaggcgatggaaagggaaaggccagctgtctttgctagcttcatgttggctggtgaattctgcttacagcctcttcatgcctggttcgaatcatccccagtttgaatgttagggaccatgattattttgataagtaaaaaatgtctggtggtagatctcatgatttttttgttgtttgggctttgtttgcttgtttttggtttgcttgataaaatggctgatgtaccttatttcagctggacctgtgggttagtctgggaacttaatgaccgtgtacaacttagttcctgtgggaagatgcatttagacttaccaaccctctgcagaaagcacagcagacacctaaatccctgtttgatttttcatacttctggcaatgaagccttaacttgggaaagtcattagggatcgtcagctcctctgcaacaagagcaaacttgagccgcacccagcaacatagactctggcataatccaatcagagcattgtgctctgggggcaggactgctgtacattatattgtaccatcatataatagagttcttagtttgtctaaataagctgtgttagggctggaaatatggctcagttgatgaagtacttgctacacaagcatgaggaccagagtacccatgatgatcaacatctataattccagtgctggaggcagaagcatttcagggccttgctggccagtcactctacatgattcagtgagcttcagggtcagtgaaagatgctgtgtcaaaaaccaagatggagcttgagtatgcttgtacctgcctttaaccctagaacttctgaggcagaagcaggcaagtttgtattaggttgaggctcacttgatccatatagtatattccaagccagctagtgatacttagtaagaccctgtttcaaccaaccaaccaaccaaccaaccaaccaaagtggactagcgatagaggataatcttttatgttgacctctagcctccatgcacatgtgcatgtgtaactgcacatgtatgcacatacacaaacacagagcatctatgttgtaaaatgtagtactgttgtatgtttgcatgtggtaggaaggcaatcttgcaccaagtatagcatatttaaatggaaaccaggctagcatttccaatgttgtgtagagttccaaccctaggaagtgctttacacaagaggcaggagatgagacagatgtgcagtgagggggaggaaattacctgtctgatggtatttcagctgtactgctgacaccctcttagcgactgccaaacacattaacatactgcatcctctctgatgcactatggtaaagaaacctgctgatctgtgacccgctcactctagctagcactcccctgtgagatgtgctaggcttccacagcagggcacagtgtttgctaatcatctctaaaccaagacccgggggattttaagtcagagtggaaaagagagaagtggctgacagcacttctaaagctggtggccctgaaactggaattagatgtcgtttggaaaggacagtctctgaagctaggagctcagtgtttaggttttgcaagtgacaagcggaaaggaatctctccctagtccttcagcaatttgtggggtcatgtgttctgccattactgttggtatcagaaagagtcagagagtagccagcagtttcccctgtgtggtcctgtgtgtgagaagggacatgtgtgaggtggaatggggtgagaccggccagcatggtccatttatgtttctagacgtgcataaatccagcagcggcaaggccttgttgcagagtggcttttggaagacccccacactccattcctgtggcatgggcaggttctgtgaaacttgagttctgttgtctaattttcccatgattaaagcaaagccactactctttgttaattccccaggcaattctgagtgttgaaaataaggacaaaggataggtgttgggctggagagatagctcagtcagcaagcacaagggcctggtttcaatccccagaacccatgtaatgaagcttggtgtggtggcatgcatttctaatgccagtgctggagaaacagataggtggaaccttgggctttgttggccagccagcctagcctacataaaatgttcctggtcagtgagcattccaggcctgttttaaaaatgaggtagctggtacccaaggaatatgctcaggattatcctctggtctccatatacctgaactccatatgaactcaaacaagcatgcacatacatacatacatatatacacacacttacaaacacacacacacatacacacacacacagagagagaaagagagagagagagagagagagagagacagagacagagagagacagagagagacagaggaaatgagaatatgaatggatattagttagggagaggccatgaaataaggtagaatctcttggtagatatagtagtagtaattactaaacatgataactcatacgtaagatctccagagtgttgggaagacattagagatttgtggaaagtagtaatagagtgttgtccacaaagcagccaatggtcagacacacattgaatactcttcaggatgggccagatgctaggctgtaaaaaaaaatctcaacaaacttgaaaaaattcacatcataccaagcatgttgtctgaccacaatagaattaaattgtaaatcaacaacagaaggaaattgggaaaattcacaaatctatgaaaattgagcggcatatttctgaataacccatgagtcaaagaattcacaaactccaaaatactttaaaataaatgaaacaaaaataagataaaagtgaatttcctaaagattagcattgtcaatatctatatttaagaaggaatcttgaataagtaacctaactttgtaccttaaagaatgaggaaggccaggtatggagtgcctgactttgttcccagcacttgcaaggcagaggcatgagggtctctgtgagttcaacactagcctggtctacagagtgagttccagaaccgccagggctacacagagaaaccctgctcgaaaataaaaaacaatgaggagagaaaaatcaaaatgaacaggcagaaagatgaacaaagactacagtggaaagaaatgaaatagagaatagaaaactaacgtagaaaccagtcatacagagcttggttctcagctggacgtggtgcctgcctcatagctgtaatctttgcacttagtaggtagagtcaggaagatcaggaattcaaggttaccctgggctacatagagaatttgagtttaaggtcacctgggctatataagattttgtctcaaacaaaacaaaacctatagtaaaaggaaggaaattatggactagttgacacaattgatagatgtttaattatagcgatcaagagagaagttctccatcgccacatgagaaattagaggacatacctgtcaatcttaagagacattaaaaggattgtaagggactattatcaataactggtacattattgatggaactttaaagttggataaccagtttggagaaatagtgtggatcacaatgatcctgcctttgcctcctgagtgcagtttaatttgcctagatctcaaacttctaacttctatgtaatccagaaattgatgcccaggtaaagcgagaagatacatattcatatgcacacatacatatatccatccatacatgcatatatacattgtacttgattattcctagcagcattattcataaacaacccagatgtttagcagctgatgcgtaaatgaatgaacaatctttggtactaaaccatggatgaacctccaacagctgatgctgagtgaaggaaaccacacacacacacacacacacacacacacaagatcacatattatttgattccatttatgtgaactacccagaataaacagattcctagagacagaaagttgattaaaaccggccgagaccctgggaatgagggaggacacctgctaatgagcatgaagtttcatttggggatgatggaaatgttccaaaattagattgttgggttggctatatcattctgtgaatatataaagccaatttaattatatacttgaaaagggtggattttatgttacataaattctcaatgaagccgttaaacatggaaatcagcacgtgaagcggtgttacagtgcagctccctggtggtgcctggctctctagctgcttcttatcttttcggtgctgctatgtcccatcccccagctgagggctgcaatatgccatttcttttatttaagtctttaaaataatatatttctcagggaggctttatatatatattttttattcaatcagttgcctaggagatagtgagtctaggggatcaaaatgacactgttttgctagagatgacctaaatattagataatcgattcaagaagggcagagaactgactgtggcctcctattgttcatttcttgaggaaaaaaaatgagattgcctgtaaatcaaaagccaaacctcttatagtctacattctgtgcttcctggagagagtctgtgtcagaaaggcaagaatcccatttatgtttccaattttttctcgccattgtccctaactctgcactatttgtgctcctaagtctttatctgaggcgctgatgatttctttagtaaagatgcttagatgtggaattaccagacaaaaccatgcattcattgtatggaactttgatccattattattcaattcattcctgatgcttacaactattatacccccccccacacacacacaccagatgtgggggatgctttggaaagctgtaagcctgtacttctctaattggtagagggtttgattgtttttgtttctgtcacttattagtagtctttgctgtttatacagagatatttctagttttcctttttaatatcactttctcactcatggcccattatgcttcctagtctgatcgcttttcaattttttctattaatgttataggatcagtacatttgtatacatttaatctatagaagcatacttctcatatagagaagtatatttaatgcttttatagttcctctaagtaaattcccagctattttttgtagtagctttgttattaatttcaaattttatctgcatagaaatttcaatatatgggactagtatacaaattgattattaatttggaacaggcaccttttcaggatcatttagagaacagctcttccctatgggtttttgatacttcatttatcatataccactgtttccttggaccttcagtttaatgccattaacttgtctcaacattcttacatcatatacttaattatgaggctttctaatacatctcagtatatagtgtatcacagttttgtcttttctgttatcactcttcatttggaaagacattgatcttaggctaggaaaatggcttgtcagtaacatgaggacccgagtttgattctcagaacccaagatttaaagcatccacgtgtggttacatgcacttataatcctactgttggggaggcagaataggtagatccccctggactttctggtctagcctagtttgtgccttctaggctattgagagacctttcttgaaaaatacaaggttgatctcttccatatgtacacatgtacatgtatgcccccccccatacatgtgaatacacacacaccaataaagtttttttttagtaagggtagagtgtgtgtgtatatatatatatatatatatatatatatatatatatatatatatatatacatacacacacacacacacacacacacacacacacacacacacacatatatatatatatatgttttaaacctcagaaggtggatcagtcaaaattataaaatactggatttgttttttattttcaagataggattcctacaggtggacctgactctcctggccttgaactcacagagatccacctgcctatgctttctgaatgttggcactaaagacatgtaccaccactgcccagcaaatgctagggttttaaacagagctttttagaaacacaaatctcttagcttggatagaactttgcaaagtgcatacatatgcatacacacatacacttgtgcaaattaatttcacatgtgtgtgtgcatgcacactgcatcccaactactataaccccatgagaagtgttaagggaagtaacatagttggtccattttaaacaaactttgttcttgagctccctgaaggagaaagctacatttcatttctcttggagccaactagacctgttgaaggaattgtgcactgaaactaagatgcatcaactcttttgggaaaagttagcaaaagcaaacatattagaggatcagcagtcttactaagttatttgtgtagaaaagaagaagctgttaaggtaattaatggctgttgagagaggtgcagtcagtctcctccaggagcgaaccctctggtaagttattcttagctcagtggtaagctctgaacatagttataagagtaacactcaatggacttatcaggttgtgtgtgtatatacatacatgcatttctatgtatgtctgcatgtgtgtatgaatatgtgtgtatgtgtaaaaactaaagaaggagaggttgtgaatttgagagtgcttggggagcatgagagggtttggagggggagcagtaatttttaagaatttaaaaagaagctgttaaaattctgccattcataaaactgatctttggtccctgagtgctgagggagaggagagatttagtaagcagatggctggtaaagtgaggctaaggagcgaacctagttcctggcctgataatggtggttggttagcagagtgggcaaaggtaaatgtagttgcacaggaagaagtctgaactggaagtcacatcactggaggcatgtgatggctattggagccaatgatacggtaaatgtttggagaggaaacaccagaattggtcacatttacttattatgcctcaagatactagtgggagaaagtgtccaggccaaggaaaggctttaacttcacgtcattattttgttgttatcattattattttgtgtttgtgcatatatggtatatatcaatgtgggtatgtgcatatatgcatgctggtgtgcaagttgtagaggccagaagtcaaccttggatgtcttccttgattgctcctcatcttattttttgagacagcctctgacgaaacctgggacttgtcggtttggctcagctggctggccaattcgccacctggtctgcctatcttcatttcctcaaggttggggctacagacagctctactgaccctagcttttacgtaggtggtctgagttcaggtcctcatgtatgtgtgtgttaggctccttgacagctgagccatcttcccaggtccatgtcatcattttaatgtgtatttgatcttataccttcttccagggtattctaaataaatgtgaatagttcatttaatttcataaacagctacatggacactctgctcttttcgttggaattatgggtcagacttagatatcccctttccattctgagctttgccctctctaatgtttgatctggtgatgtttgtcatcgcctttgtcaggaacaggggatgtattagtttaatttctattgctacaataaacaccatagccaaaagcaacttgaggaggaaatggtttatttaatcttacacttcaacatcataatccatcatcaagggaagccaggatatatagtcaagtaggaacagaggtagaaaccatggaggaatgttgcttactggcttgctctcaatggtttgcttccttttttctataacctagtaccacttgcccaggggtaatagggcccacagtgggctgacccctcttacatcaatcattaatgaagtgactatcccatagatttacttgcaggccagtctgatgggggcacttccttcttgtgggttctctcttccccgatatgtataggatcagtacagagaagggaaagttaagcaagaggggttgggtgattggatcatgtgattatgacagctctggttgtcaggagtctggtattggcaccactgagcaatgcagtcaagtctgataattggtgtttctgcctgcagttggcttcttgaagatttgggatgtcacaacctctataggggatgatgccaggaaccctgctcctctccccatttctcttccccttggctctctctttcaccctagggatagcttggatggattcttgaatagaatcattctttacaaaggaaatagtataatttacaaaactttatttttaaaacaaaaggatcaccttttatttcttttgatccatttcgggggcacattttttgacagagtaaagcaaacagatggcatagcacactcttaatagtaatttattcttttaaaatactgttcaagaaaagaaatgataccagttgttttatgcttgacttttaactttaaagcaatctttgataatatcaccaggagattagtgtttgtttcctttgaataaattagtttcctttgtaattcactctgactaaagcattgtgataaaaggtaagacatttggaattatatacagaaagggaaaaataacccaattttctggagtatctggcatgccatgaacaaagattaaaaaccatgaaatgtaagaaatgaaaaggctgtaatatatatgtttatatataagtacacataccacacatatccgtaccacatgcacacacaccacatacgcacacaccccaccaaccacacagttgtaacaatttatacttcccttttgtccctctctatgtacaggtcactgtaatatttgaaagactcctgtcacttagtatgtaaactgtattgctatgcataacatataacatatggcttaaattaaaaaaaaaaaaacttctttctgctttctgtcttggcagtatgccatcctcctttctcctctgtcttactctatttccctctccttaactcattttctgggttctgacctgttatatggtgggttccttgggtgtgtatgtatttgttccattggcttttatttatatctgtatagagagcacagaaataatctggaccattgaaatccagagatgacccactaaacctttttgcagtgtagctctaagtctgttgttagagatacataggatgtaattttatattgaccttgtttcccactgatcctttctggagaaagtgttcatagatttaaaaatgactaaacccaggaagcaagaaggaagaaaggcaaggatcagttgggtggtttgtcggatcgatcaatctctccatctgcatcataaattatcaactgtattgatctattcacattgatgtatgaactcattctgcacaaagcctgaaagaaatcgaaaatggaaaatgatcatttattagacctgatgagtgtcagctttgaattggaacaaaacaaaagcacagagatttgaatgccttccctttcaatatcacatggccataggccatcagacctgggtgaaccagcaaggctgggtaacatggcaaataccttgttctgttcagaatctcagaatacgactggaacttctgtgagtccagaaattcatttatatattttactgttcttcattcatacttctacctaagtttgtccagagaccttcatgcatgggcatgaaatatctgtgcatacagttctccattttaccagtggttatggattctagtgacatctttctaccttttgtttacttatcttaaaaatattgtgtgtatttttgattgtgagcctaacctttaatggctgagccatgtgtgtagggcatatacccagaagatgttccaaatggtaataaggacacatgctccactatgttaatagcagccttatttataatagccagaagctggaaagaacccagatgtccctcaacagaggagtggatacagaaaatgaggtacatttatacaatggagtactactcagctattaaaaacaatgaatttatgaaattcttgggcaaatggatggatctggagaatatcatattagtgatcacaaaagaagtcacttgatatgcactcactgataagtggatagtagccctgaaacatagaacacccaagataccgtttgcaaaacacaagaaaataaagaagaatgaagaccaaagtgtggatacttcattcctccttagaatacagaacaaaacacccatggaaggagttacagagacaaagtttggagctaagacgaaaggatggaccatccagagactactccactggggatccatcccataatcagctaccaaacctagacactattgcatatgccagcaagattttgctgaaaggaccctgatacagctgtctcttgtgaggctatgccagtgcctggcaaatacagaagtggatgctcacagtcatctattggatggaacacagggcccccaatggaggagctagagaaagtacccaaggagctgaaggggtctgcaaccctataggtggaacaacaatatgaactaaacagtacccccagagctcatgtctctagttgcatatgtagcagaagatggcctagtcggccatcattgggaagagaggccccttggtcttgcaaactttatgtgctccaatacaggagcatgccagggccaagaattgggagtgagtgggtaggggagcagggcggggggagggtataggggactttcaggatagcatttgaagttaaataaagaaaatatctaattaaaaaagaaaaaatattgtgtgtaatgggcagtagtagtgcacacccttaatctcaggaggcagaggcaggtggatctctgtgagttcaagaccagtctggtctacagagtatccaggacagctagggatacacatagaaatcctgtcttgaaaacaaaacaaaacaaaacaaaacaaaacaaaaactttgcatgtttgtgtgttgtgcatataagtgcaggtgcctacagaggtacaggatgggatcagattctctggagctggagttcaaggtagatgaatggcctgatatggatgctgtgaagtgaacctaggtcctttgtaactgctaagccacctcttagcccctccttccacctttgaatgcatgtatcagtttcttcatctttacaattgatggtgaagtttctaataactttaaacttggtagccatttctagtttctgttcctgtctcccttcgaacagaaccagcacagcggaccatggctatggtggtgtttatctgtagttctcaaaacactttcacctgtatgccctcagtctggcctattaagcattttgaaatgttccacagcttgagggtcctactcctcatcttgcaaactcttctcagtgtctacaggagggaacattaagatgccatgctacccccatcctgttagagggagcaaatatttgctgtctcagttgagtgtctacatgtcctgtccaaattttttgaagggtgttggagatttctggttgcttactaggacagtttaactgtgagttttggttgagaaatgaagttaaaatggtgtttctgcttttgataaaacacccatatcactcactccacatagcaggggtttctgccacacactcttcactctgctttattgtacatagctgggcagggagtgaaatgtgcatcctatttgcattctgctctgcactcctcagaaggctgcctcaagaggactttcacaccatctccgtgttgattgggtgtaggatgacattattcatggggaattgggttgaattgctatgtgccagtctagtccctcaagcttcttagatgatggctggggatgggttggtaagtaatatgtttcctttagcatatttactatttcaaaccaaggctaaaggaaacacataagaaaggagcaagaaggaggcacacatgcatacatattcagagcagtattcacagtagacaaaagatgtctgttcaaggatgaatagataaacaaaatgtgactgatacatgcaattaaatactgttcagtatttaaaggggggtggagattcaggcacctgctacagcatggatgaactttgagggcattatgctaggtgaaataagcaagcccctaaagacaaacatgaaataattctgtttatatgaggtgtccagattagtcaaaattatggaggtatgagccggaatggtaatttctaggacctggtgtcagaatgggaacttattgtttagtggatgatattgagtttcagttctggaaaatggagggggaagattcatagatagatgatagtaaagacacaagagtgggaatgcagttagtattaaaatgtataaagaaaatgactagaatggaaaccttatctaatatatcctttaccatggaatcatgactattgattggagtcgcatgactattcagtacctgtatacccacaatcaccagctaagaaattttgtcaacgattctaatgtcaggtttcactttttttaattaggtattttcttcatttacatttccaatgctatctcaaacgtcccccatgcccccaacccactcccacttcttggccctggcgttcccctatactgaggcatataaagtttgcaagtccaatgggcctctctttccagtgatggccgactaggccatcttttgatacatatgcagctagagtcaagagctccggggtactggttagttcatattgttgttccacctatagggttgcagatccctttagctctttgggtactttctctagctcctccattgggagccctgtgatccatccaatagctgtaatgtcaggttttttattcaaccacattgtgtatgtcatgggaggagataaggatgacgatggtgagagagttctatgctaggagagatttcctaagttgtttgtattaggtagctaaagtaaatatactactagtagagaattagtaactgttttttgagtcaggatctcaagtagttcaggctggcctcaagcttggtttgtaaccaaggataactttagctttctgattctcttgcatctgtctcccgagtgctgggattacagaagtgcttcacaaggaccaatttatgtggtacaaaactggggcttcatgtatgctagacaagcattcttaccatgtcaatagagctacaggcctgcttctatgaaattaatgctttctatgtcctttaaaattggtgttttaaggaggttagggagatagattagttgataaagtgcttgccatgcaaacatggggaattgagtttgtatctccagcctttatataaaagccaggctcaccagttccaatggatgcatctacagaacagctcctgttctgagggctcatggaatatttgaggaagatggggacaaaaggatcataagagctaaaggatcaggcagtatgccgaaagactgtatcacctagtaatgtctcaccagcatgactctccaaatgtgactgaacaaagacaacaccagtagacatgtaaaaatggacagggtaagagcaaaaggcctcaaccctacacaaagataagtaagatatgctcagagcaggagaaatagtcatcctcagggaagagtatactaatcggttatccaatgccaaatggtcagccctgaaaggatagacatataagtaatattatatagactgagcaggttatatttggaaatacatatgtatatatgtatacatatatgcatgtaataacagttaactttctttagaggccatgaatttgaaagagagcaaggaaggggttctatgggaagatatgaagggaggaaagggaagggagaaatgttctaattatactcttaaaaagtatataggcagcacacattgtagttaatgttttttttttttaaataggacataaggttgtgtgagaaggaagtggaggagctgggaggagctaggggagggagtgaagaagatcaaaatacattgaaggaaattctcaaagaacaaataaaaagtaagaagcaaggaactgggctctacttctaggacctctgtactggtagcctactccctcctttatctcagttggggaccctcgctcatgagctgctgctactgctcagcagggcagtctacagtccctcctcaggaagacttctctagaaacatcatcacagagacagaccagaggtgagtttccattgagtagcctgtctaattgacaaagcttgaccatcacacccctttgggtctaggctctggactgctggatgcactcgccaggaaattcttttaggatcctattcttgagaatctagaatttaagacgtaagtaggtgctgggcagcaaggcaagccaaagagagctttggactgggctgttcctgctgccaggggtgggggtggagagggatgtcatgtccaagctgatgattcagtcttagcaatgcttcttgttcttcctgttaaaaatatcaaaaacaaacaaataaaatctcagtctctaatttagatcctttttatgtcttatagatcaggcaagctaactgatccaggggcctaatgtggcgaaatctgcccgcccccgttttttaataaataacattctattatatttggtcctccagaagttggtatgtacaactgttttcactacaacaggggttatgtagcgtggtccacagagcctcacgtaatctctggccctttacatatcacatttgccaacctctcttagaaaaactcaatttctgccttccagaaagtttgcttttgcaaaaaagatgtctactcatgtgtaatctagagacaactgtataatctggcctgttgaagtaaagacatttaactgtttaaaaattattaagtgctggcaaaaaaatagtattgttgtggggataattgtacatttatttttgtcccttttatggttttatctgtcgtttctttttactgttccacgaaggaatcgtcactgcttttctagccttaagacttctagattgacacttcctagaagcacaaattctaaatttacactctccatgacacttggttccctccttctgagggttaaaggtagagatcagttgggaaaactgaaaagtctgaatgtgtattaccattttctgaagcacacctttgggtctttcctgtacttataaggaaccaggaggtgtttaaagaaaggggaaaaggtctgtttgctttgaacaaataggtacatgctggggacccttcactgcttgtgaaagacaaggagaagacagcaaaggaggtgggagaaggtgataggaaggcagatagagggactaactggggaagaaagggagccagctgaagataggggacatgggtagggtgggggtggcaagtgggggaaggaacaaatgagaacaaaacataatggcccatctgagtgaagatggtatggggaaacccattcctttgaatgttaatctaaaaacttaatgaaaaacctaaaacaaacaaacaaaccccacttcattcacagccagcccttttctttcatattcaaggctctttcagttgctttgaagccctctctgttctttgtgctattcctccagaggggccttggaggaaacctatttgcagccccaaaggaagctctaagttctgcatggttttgttactctgagcagcacaaccagatgctccatccaacagctttggtgctttgtcacttagtctacactgtcatttcatctttctttgagtttgtagattttcttttagactcatactaaatgttcttaggtagaccccgtataaagaataatctccaaccccttccctcagtcatactttctgggaaacatctagttcccgatgatccccatcagctgctatctacctctgcagagttacattgatataagttctaagaagctgtgggcatccagtaaggaagtgctaattgcatacgagacaggctgattcagtacactgtagcatacacattgatatccttttgtttttgtttaggaacagggtcttgagccgtgcgatcctccctcctcatcttcttgtgtgccaagaaacatgacagtgttttgttttgtttttaggcacagatgggggaatcctactgttcatttttttattataatatttttgttcgattaaattagaatcttaaaagtctttttgtattgatccacttagatttatacactttccttaatactctatgtagtatacccatgatttaactaatcggtcccctaataggaggacatttagaatgtttctgatttttcactgttttgaataatttagcaataaacattttgcacacatccatttatatctgtagcagttattttttgtcaacttgctataaattatagtcacttgggaggaaggaacctcaattgaagaactgaggtgatcagattggtctgtgggcgtgtctgtggaacatttctttgattaatgatagatgtaggaggacccagcccacctagagggatgctacttttgggtcctggggtataaagaaggcaggctgagtgaaccagtacatgttgctccttcatggcttctacttcagttcctgcctccaggttcctgtctttactttacttgatgatggactcataagaggtaataagcccctttctctccaaattgctttcagtcagtgttttatcactgcaacagaaaacaaagatattattccaagtgttatctatagtataacttcttaaaagtggagttgtaatttttagatatttttttttcttgaaagaagtaggcctttggtctctgctgaacttactgtccctaaaaccctttaccctctagtgataccatagagctaaggccttggtagtagtcaggcagttcctccagcaaattctgctgtaaatattgagataacctttctctcctttgtgtatggtgtgtatctccgctatctgacagaagacagggatccccatgcagagaatggcaatcctgctaaacagggccaagagccacaggtttgtgatgccctacaggtacacggaagcactggtatctctttgtccccaagggcatggcaggcatatagtgctttctagaagttcagtagctagggaaaggagtgatgggttgggctgagttgtgtgggggcagtggcgattgccagcatgaaaatgagctgttttggtctccgtggaagaagggagcacagccattgcacttggctttgatcaaaagtgccacatgacagagtgatccctcattagctgctgacctgagtaataagaagacacttggcggcccccaatgcaggagctagagatattacccaaggagctaaagggaactgcaaccctataggtggaacaacaatatgaactaagcagtaccccggaactcttgtctctagctgcatatgcatcaaaagatggcctagtcggccatcactgcaaagagaggcccattggacttgccaactttagatgccccagtacaggggaacgccagggccaaaaagggggagtgggtgggtaggggattgggggggtggatatgggtgggggacctttgggatagcattgaaaatgtaaacgaggaaaatacctaataaaaataaataaataaataaataaataaagctgctatgaacataaaaaaaaagtatatgtgaaaaaaaaaaaaaaaagaagacacttggcaagtagcctcatgaacactgtgcccacgaggctattttagatcccgattcgtgaggtcacctgaagtggttctttggttgtcgtgtgcatctccattcacctatgagacattccagtgaacagattccaactgtatgtttactcctttatttgataattaaaaaaaaatgttcttttgtgtttccttggaaaccacaagtttgaaagcaggaattaaagattcttcactagtgaaacctatagaccctctcataaaggtggtgtttataaactaattgaatctgtaagattgcaaaggaaaacaaccacatcactgcagttatccaaatattgcagaaacatgtgatgcgtgctcttggttgatgtgttaaaaagtcagatcccagtgtgcctagaagggatcatgtatggaaatgaagtagaggtgagtgtaaatgacacttcaagagagccgcagttgtggactgaaaatgtctgtgatgaataggaaagaaagaaacattcataggtgctgtcagtctccagaaagtgtgttgcctttgtttatgggaataataaaaagccccattttagctagaggatggtaccatttttcttcctgtctaagtttatgcatttattagtgctagggatggttgtggacatgctgtgcaagtgccccatcactgagctgcattccaagcccctatacaaatttcagatttccctgaatcatttgtaagaaaattcaattacatttattcatgtatgtcctggtggtgtgctgagccggcccgtgtgtagaggtcagcagtttacttgagggaataagtcctctgatttcccgtcacctacttcctggggttagaaccctggtcctccagcttggcactaagcaccttttctttgttgttgttgttttgttttgttttccgagacagggtttctctgtatagccctggctgtcctagaactcactttgtagaccaggctggcctcgaactcagaaatctgcctgcctctgcctcccgagtgctgggattaaaggtgtgcgccaccacactcggctggcagtaagcacctttactccctgagccatctctttggtgacagacccctttgtttctgctcaaagaccccaattaaggacctctgtttatgtgaccctcttagatcccaaggaatgagttttgaggctttaagcctttattggtttcaaaaaactcatcagcacctaggtctccctcactctctggaccccacttctttgtttctgatagggattagaagggaatccatgttacaaacgagtcagctttaacaaacaaacaaacaaacaaacaaacaaacaacaacaacaagtcactactcatggcagagatcttcctttcctccaagagatgcttatgtgggactttctgtcacccatcttcctaccacagtgccatttgttggtactttaaaaactgggacattctcgatttgattatgctgttttcctctcagcttctctaagattcagaaagagatatagatcccagatgagggtctctgggatttttctagatgcctttcacaatttttaaaatgttcatcttttctgttgcctcctcctctgtgcctccctccgtcatttcctcctcctccttctcctcctcctccttctcctccttctcctcctcctccttctcctcctcctcctcctcctcctcctcctcctcctcctcctcctcctctattttttaccataaatgtttggatctgagagatccatttgtcagcagcaaagactgaaaacaccttaaaatatgttggagggcagagtattggggaaaaggccttgcttatgcccaacaaataacctatatttagaatctttcctcagtttttcctttaaaattcttattctcatttcgcttgaatgactctgcatggagcatttaaaagtagatcaaacagaactctataaatatgttgagttcttttgggcattttgcccaaatcagccttgctaaatcagagaagagcaaagtgctttaatatgttggattttcttccctgcaaaaatccagaatttttctcccaaagactagctgcctaggccgaggaaaccttcgtgaagtagcctttgagtgggaggtgctctgaaaggctaaagccaaggcctgagagtagctggaggcaatcaacagaactggtgtgcttagagacctcgctgattatgttttctcagtgtgatgcgtttatgcctctctgatgggaaaaaaaaaaaaggctggtgaaaagaaaattggttgagctggtataggtaatttaacaaagatgctttctactagatttatgaatgtaaaaccaaatgttacaaaggatggagtcaagtaaaaggaagccctcctgtaaagcaggtctctgcctatcacacccatgttgtacacaaggaaactgatgccaagggcctatggtagttgtacatgggagccctctggctctgtgtctctactaccttttgagctgcaggaatttttgacatgaccataatgcttccagtgtgaactatgtgtctatgagcaggaaaatcacagctcatattagcctttcacagtattttacatagcatttttataagatagttgaggtggaaaacatttcatgagttcttcatgtgcatgacaccagaattacagatgtggcttttgaacatcagagtatagcatggtgtagtccgtagtccctggaatggacagccagaagcgtcaggagttcaagatcacctttaacagtacagcaaggtccagatcataaggactaggctgcgtcaaaccctgctttaaaagcaaataaacattaaaaaattatctaagcaaacaaaaataggacagatcaagcaaaattggtaatttcagaaagtcagttcaaaagattgttgttttctatattcttctagaaactcagggtttggttttttttcagccaattgtcctttaggagataactaggctagccttgaacttgagatatagtgaaagaagaccttaaatttctatcatcctgcttccacattctgagtgctaggattacagatgtataccaccacacccatttttatatgatgatggggcttgaaccaagagcttcatgcatggtaggcaagcattgtaccaactaagttatatccacggtgcctaatgagccagctttaagactatttccagtagtattgttaaacagggtatcccagtctataatgtctagggcagagaagggactagatcctggagttgtgttctttctctttttctagatacacagcacctgggcccacatactgagttatgagtgggtatttatgaagaagtagaatcatcataaccataataagacatatgtgggagtttggtaaatgagtcaaatttattgaaaaaggtgagcacaaaaaagccaagaggtgtcatattgaaagggtgcagacaaactgatgacaagttgatgctttcaaataaggaaaatacagtggagcaagaacaaagcagaggtggttagggaaatgtggaaaagtggcctcatgttgtgcttaaagttttctcttcctctcttttcctcccattttgtctttggatttccattgctgtgaagagacaccatgaccatggcaaccctcataagggaacgtatttaattggggttggctcacaggttctgaagtttagtttgttatcatcgtggcagcacacaggcagacatggtgctggaaaagtagctgagagttctatgccaggatccataggaagagacactgggcctggctggagcatttgaaaccccagagactcccctctggtgacacacttgctccagcaaggcaaaacctcctaatctttctcaagtattgctacttccagatgatgagatattcatataaataagtctatggagcccattcttttttttttaagatttatttatttattatatgtaagtacactgtagctgtcctcagacacaccagaagagagtgccagatctcgttacggatggttgtgagccaccatatggttgctgggatttgaactcaggaccttcggaagagcagttagtgctcttaacctctgagccatctctccggcccctatggagcccattcttatttaaaccaccataactttcctcttctctctctctctccctctattctccctctctcttccctgtccttccctccgccttcaatccctcctctcccccttctttgtctcccttctctctccttaccccttctccctgtcccaccccccctctctctcccctccctcttctctctctcctttctcctctctctttcttctctcctccacatcccctttctcctctctcttccccctttttctcctcctcctccctctcccccatgcccctttccccctaccccatctctgttattataaaaatatgagtgagtaaacaggctcagaagatagacggggctccccgtgtcctgtacaaggagggcctggccaagtagatggagagtaatcaggccaggaacagcaatcttggattggtcccaatggaatcttgttgtctccttaggacactaacatcagtatgattggaatactgactagtatgagctatagatgtggagttctttgagttcacgtctcctgttttcttaatgggtttcttgtcatagggtggccttacccccttgtcattcagtccatgaaataaatgcatctttttgtctgattcaattagtacttatttacttgtgaaataagaacttgccattaatgtaatttaagcatgttcagcatgttaagcatctatgaagatgagcttcacagaacaaggtaattattttagcacataactgatgttgtttgaaatgagacctatttcagcatattatatgttctttgtaaaatcaaattgatatgcaaacacacttaactgaatctgtatgcctccctcccaactgctgtcattacttgcttacacaaacatgtctatatacatatgcattattaattacattatttattcactttacatccctctcagtgcccctcagtcaccccctcccagaatttttcccatccccctctcctcttagtggatggggtcacccctgggtatccccccatcctggcacatcaagtctctgtgagactaggtgcatccttttccactgaggccgcacaagacagcccagctagaagtacatatctcacacataggcaacagctctcgggatagactccactccagttgtttgggacccacatgaggaccaagctgcacatctgctacatatgtgcagagggcctaggtatagcccatgtatgttttttttggttggtggttcagcctctgggaaccccatgggtccaggttacttgatcttcctatggagtttctaacctggctatctaaaataaatgttttctgtcttttggaggacctatgcatgatttcttgtttatagaaatctctgttctactgtttagtatgaatacctgtgcgtgtactataaatggataagaggaaacagaaatagattattctatacgtttgcgaaggttttgtgctacatgctggtgaagaatgacccctcacacaacggcaacactccagtgtctgccctgcttccatccccacagtgtcaacaattcaagatgccacttacattttttccttttctttttaaagagtatgttactaagcagccctggctggcttggaagtaacagtgtagaccaagctgacctttagcttgcagcagccctgtctctgtctccaaactgaattgctaggattggaggtatgtgctgctgtgttcagcttctaccattgtgttttaagcagacatatagtaggttccctgtttagcaccacaatgaagcattatctctccttttctctaccatttctctccttctagtccttcttggactgtctgggaatttgccttcataaaaccatgacccataggtaatatgcgttgtaagtattcattagttgactgatccattcatttgtcagacacactctggactatacactgggcatcaaggataagtaagagggggtcattggctccaaaggaggtagcagatttcatggtgctatggatatctacattcttgattgtattagcctttcttacctggtatagtatttcttccattatcttttaatgctttatgtctgcacttcccttctcttgggccattcaactaatttagggctatctctccaaagcctttcccacatctcggatactagctaccttcttctgaattgttttccttatcacctcgtattccatgcttccctatccaagcatttttttctgatttctcatgttccaaaaatgaaatccttatacttaacacctagagtgccccattgagattctggcttattcttccttcttaactgtctcttggattaatacctaactcacatgccttagataagttaaatagtctttcactacttgtccccaaaggtgtggtcaacagcctgagcttcatagggttggtataaggaattgaggaaaggcacttaggccttgagggggaatacatcacataggaggtattagatgctcatttccttcactttcaacatgatgaagttggttttccttatataatgattggctctgtctgtctcccttattaccttctagagctcaaaggccctaagagatgaatccccatggcttttacatttttctcttgggacaaagcgagggctagcatagcttttactgtttgcttcacaaccattgtctttgaagtaacaggcaaatggatttcctggtttctgccacataaagctgttgactgtttataccccttggagaaaaaagcaggctcatctctggggactacacggtcctggcagtgctgattacacactccatatttcccttgcaacagtccagttgcagccaagagggctttgcaaagcaagatctaggtagacccttttattctggagtccgtttggcttctaaagtgcccttctcttactctgggacataccacattcaaacagtctgataagaggcagtatttctagtagaggccatggtgcagagtccacagcttttccctttcatctggaattcacttgatgtacaaagtgccatgtttagtttatattgctgttcaacactgcaataagaattctgccttcttataaagaagctctcagtttaagggcagcttcttcaagaagcctatatgctgctcattaacttgggaagttattggaaactccctttcccagattatcagttagtgtctgataatgcttcatgccagataattttttaatcctcttgttcctagaagtacatcttcagagctcagaactacttagtacaactgtaccaaatgcctgtgaaataaaaccaatatggcagcattcacctgggttaggataatactgtcaggtatttagtcatatgacttccttgttggagaagatgcccaacatggcagcacagtaacatagtaataatggaaaaaatgcatttggcttgatggtctttgaacaatacatctgtctagatgtctgtccacattggctgcatgttagagtcacccagggagcttccaaaaattcagatgcccagactacattttagacaattggtatctgaatctcaagacatggggccccaacgctgatatttttctcttttttcccctcaaagatttgctcatacagacttcaaattacagaaaagctgacaacattgatatactcacctagataatccggttgtcacccccttttgctttttcttaaataaattcagagtaagttacaaacatcgggttactgtccctaaataccttagagtacatttgtgaaaaatcaaaggcattgtgctgtataactgtaatagaattaacatgctcagaaaaagtaacattaatgtaaaataattatttagaattagcgcagactcagttttccctaatactccccataatgctaagctttaaaagcatcaagaatcaaattatggaccatgcatatatcatgtcttttaaaagtttacatataatgtttatgtatatttatgggatacacaggttttgtttttttagtctttgttctgttttcttttaaaatggattcccctcccccacataatatattctgataatggtttcccctctacttctcccagttcctccccacttctcttcccatctggatcctcaccctttctgtctctcatgagaaaacaaacaggcatctaagggataataataatataaaacaaaaacaaataagttggaatagggcacaccaagcaagaaaaagagccaaagaaagggcacaaaaattgcatatcacatacatacacatgtgttctctctctctttctatttctctctctctcttctctcatgtgtgttctctctctctctctctcacacacacacacacacacacagagagagagggagagagagagagagagagagagagagagagagagagagagagagagagttgcacatacaagaatcccatttgtgggaaatcagatttgtttggtttttttttttttgagagtatagtagtttcttacccttcagaaatactttgtgacacagactttaataaaaggaagaaaatcaggacagtttttgtagactgtagttccttggaaactttggtctcctgatggctagattgaagccagtatttgtgcacagtattctgtagttgcagctggtcaggagtcatgtcagcttgctccttgattggtgaagcaatcaagaggacgtgcgtttttgtaattaaaggtaacttgagggagatatctagaggttctgtaaatatcccagtcctcagtaagattcgcccagtgctttcaggagacattgattcttgccagagtcaagttgctctgatgtctacaaaatggaaatcatgtgtgcttacattgctttatgttattaatcaatattcttttgttacagaaagagctttacttcctactccttaactctctagtcttatctacctgcctatctagcttgccacctgttggaacatgtcagacaagttgtaatacacttctcagtacatgatttcctgttcccttgggagacacgggaaggcctttagagctggtgctgtggtctttcataaaattcgatgcatctggtattttcttcttgccagcgctgaatgaaaacattttctgtggagatctagttcctcaaagactgccatttaggaaggcatcagtagtttcctgaaaggtcccaaagagatggcagtgtgtagtcaagactgagaagcaatggcttcacatcgtccaaggagtgattgtcagttcctgtgaggtgtttttctattgtctataacttgtggttctaagtcattacctctgggttagatttttgtgagcattatcatatggagaaacagcaagtttctgaccctaccacagaagttatgttcagtaggtctgccctgtactttaagatcctggtacatatggttctttgacagtactttctcttttataatttggttactaagtaactctctgtctttctgtctctctgtctctgtccctgtctctctggtattacaggcatgtgttaatgtattaccacaccaaggctgtctgcatactaagcaagcacactagtaaccgaactacatccttagtacccacatatcaaataatttaagcctatataatttactgctgttgggaaagatgtgaactctcaaaaagtagattttgtgagtgtcagatattgtcaattgacccaaagactttctgttcatgatgttatttgttatatttctgtggccagtaaatagatttggtctagtgaaagtttcacatgccacaagactgtaggataaaggatctaagacatcagtgtgtgccttattctgggactggagtcatggtgtggtttctaatttcagcaacttcagtcttagagaaggggactatactataatgtctccccatataactggtgcatttcttttatgtgggggtcctgtagggcccagttcctagtagctgctggaaagttttgtgatttgagttttttcactttttggttttaactcttagccatgtattatactagctcatccagattattattgttgttgttattaataataataattattatttattttggggtatgtggtgtgtgtatgtgtgtgtacgtgcatgtagttttgtagagtcagtttccccttctatgtggattctgaggatcgaaatacttttatccactggaccgtttctctgacccctatacatgattttttttaaacctcaacaaagagctgagatttattttaagaacagccagctggatgggtagcagcatctttagaattatgtcgccaggtttgaaaacaaagccttctacttataagctgtaaaacctctggtgaaataattgattgccatgtcttcctcaaattcattgtttataaaaagaaagcccgtaatctacctagagatcaatgtagaaacaaaatgacatgatacaggtaatgtatctaatagtcttaagcattgagtataagtgctcagtatatgttagctggtattattttattaaccacgtttgttaggaatgtggctgttagttctagcgagaaacttgaggttgtgcctgctttgctatatgtctgggtccatgttcttgcatatgggcacatattcatgcatgtgtattttagggccaacatgctatcaggatattaaggagagatggagcaaatatgcactgtgatatttttccttatctttacttttgggtaagcaatgtgtgcatacatacttgcatgtgcattatgtcctttcctctttccaattatgcatgagaagttaaagtgaccttgccttggaaacacagaagtgacctaaacagtggcagtgctgttgccatgaagaaggaaaaacacagatgctccactctctagtttgtctaacatagatgtatattgttggtcatgtttattatgtgtgtcacaagttggactgagcaggaagatggtggctgaaaataagagtccaaatcccaggtgtgggcaaatcatgcttggttctaatcttcagggaaaaaaaaacccaaaaggaagtgatgtcattgtactgccctttcaaggaaggccatgattcactagtaaatgtcagtgaaatagtagggcaagaaaaagtggtaagagaccctgaaacttcttatgttatcctaggtgaatgcagtgtgtgttcctcctcatacccaaactgggttttaaagccagcactcaagttcaggtcaatggtgtgcagagctgaggtccagagacacagaaggccgacagtttgggaactttttagggaaagtcagagtgaagagctggtataatatcacagtgttacaggaagcagtgaatacagactgcaaagaatttgagactagtgaattgattcgcctcatctgggactggagagagacctctgaccgcaaggcaaggaaaatactgcctcttactagcttagcgattctgagtaaatcactggtcttttcctcctttgcaaaatgattgctcatcccaacccttttatttataactcctgtggttgagatacagtgatatggggacatgggcatcaggaggtggggtggcccgtgcctctaatcctagcacttggaaggcaaagctaggaaggtcttagatttgaggctagtctggactacttctggagaccccggctcaaagaaatgaagacatttctcaaaggaagagatggtcttgagctagcctattatagagaaaataagactttctgcatgggttcaagtcaggccaccttcagcaccagctgcctctgaatctttctttttgtcctctagggcttttcttgcaatgttgacagtgtacattataagattttatggcaccagtcaagtaacctccgaaccatttaagaaatattggctagctgtcagagagaaattagcgaatgcatcattcctttggtaccatggaagattttatggtctctaatgcatagatttagatgaggtgaagccagatgagaatgttccaggttctgaatctgttggaatcatcttttccctaagaatatatcaccttggcctttgccatttgtacagtgttaagctaggtgctatgttttaaattttcaaaaacatttatttgtgtggctctgtgtgtgtgtgtgtgtatgtgtgtgtgtgtacactcactggggtgcatgcaggtacttgagaaggccagaagatgttgggtcttacactgtgattttcatttaataatctatgtcttctgacagttatatgcagggcaattcttttcaaaaatgttgcattttgaaacttgttcattaactaatgagtttccataaggcttttcataaattcttggctttgattcaaccactcagccctgctgctctctcccgttcctcctccccattaaccctttaaccctcagtatttcttatttccctgtcttctcttattcctcatgtattttactatccttccactcattttgaaagttgggttttgagtgcctatgataccatcttcatttgggtcagctcccccgtacccctgatttccctactcctcctccctccttgcttaagcctttctgtctgcagtattccatttgactacttcatttaacatatcatcgaccgcccacacacaccccctttaccaattatatctaacatttatggctttggttagaaccttctgggccttttggtgctatttcactttggtctggatttggtggcttctgtgattgtatcacttttcaggcatttgttatttcgtgcttagagttgtattgttaaagttaatttcaacataaaaataggtaatgggcacctgattctatggctcagtgcatagaggcacctgtcactaagctcacgacttaagctcggcacctaggatctacatggtgagagaactgactttcccaggttgttttctgacctccatgtgcatactgtggtgcatgtatagttctcccaccccctgaaattaaataaaatgtataaaaacaaaccatagaaaatgaaaacttacaaattcctaaaactttatctcaagggatgtatgtggggaagcaggggagggagggcaaaacatccctgtcacccagattttctttgctagaacaagaactatgtgcaatttagtgtctagtacctgatttgtcttctgcattgttgggagctatagagcaatagtggttgtttttcatttttgtttttgaaataggatcttcctgaatagcctaccctggcctgaaacttaggatctcctgcctcagccctctgatcaatgggactacagatgtgtcccatcatagccagctttttgacagtatgcattgcactggaataccagtcctttagccttgtcctttggagaggcaatatgcttaggtcctctggcccatgcagagccaggtcctccttccaaggttacacgattcagtcagctaacaggacacattgctaccctaggatgttcctgtgagctctgagtttgttcttatcaagattcagtagcttgtgactttgtgcaaaaaggtagagatcattagtttagtggctgaagatgtgattagacgagatattgatcctgaacttctgccctcttctttgtgttccaccctgttcttccttagggaggtggtacagacatagaaaaatgaaagtggaaactgggccactggcttttgaaaaatattgatcaggaagcccatagatgtagttccaacaccttcctctttgtatgatgtcattcaggggtgagggggtagggctaatgtgctctgtaatcatcccaacagggacttcctttttacagggaaaagcttagaaaagaataagagtctccagaggcaacacccagaaataatgctggcctttctaaatgcacttctttgaagttgttgatcctgttgattttctaggccatgtagtggcgtgaagaaatggtgtgaggtattcagttgtgagcaacaaacctctgagcaatgcccatctcggttcgtagtcctcatacaccaacccctggcttccaccaccactattgcacgtcatcccacatgcatgatttttgctcccacagtgcacataggcagtatggatgtcctttagatggtagtgtctatatttgtaccagctccaagtcagaggcccccctggtgggacccattgtattgatggcatggtataacattcagtgtcctctaagtgaagtatggctctgacttttaaccttgacttgcctgggttgcttctgtggaagcagccaggcatcttgcaaatacatcccctgggacacaaatggctatgttgaaccctgtgggacttttgaaattgtaccaagaatagcagaaatccaattggctttgggttatcaggcttgaggtccactgtgttgaaagggtgatgattagtaagagaaaggccaggccactttctcatttgctttgcacacttcggggtgtgggggcggggggaagtgctctttgccttgctagcatcaaaagtagaccatcctcctttctttagcacatcacatcagctttcattacaaaccaacagcagcaaatagaaagtaccatctatggaagtgcgtttaaggcaacactgtgttccagtgctccaggatggggggttctgccttccgtgccaatgggtcagtttctcatgtccatgggtttctgacccagcagcttttcaaaacaccaagaagcattgctctgctttctaatgcctctctaagagaccaggactgctgtgcctctagctatgccccgggaagcatatttgagacaactcagcttactttgcctgcatgcctaggaagtctctctttaaaaccttagtatgggatgtgggagaagaactgcatctaaatattttgcttttcccattcaggagaacgacggagacgccgatgccaggtggcattcagctacctgccccagaatgacgatgagctggagctgaaagtcggggacatcatagaggttgtaggagaggtaagcaagtagctcagctgacaccgttgcctcatgtagctatcagatccacctgtgtgcccaggcatgaagggccctggctacctgtgctcaggcccattgaccttagccatggagagtcaaacccagagactaaaaatcatctagttgagtctcctagggaaagtggatccttcagaggaatttgtttaggccagatgtgtggccatctgaagccattgtctttgtgctataacacacagagtacctttgaaatttcagtgctgtgtcatcaccttccctgtcgacttttggactctgagtgatcacaatagcagagacccatctctggagtaggcactcagttttcattgtggagaatactgagttgagagagaataaaagtggcatgtggcatttattggaagactaagtatgtgacaagtctgataagggtttttctttgtcatgttcttgcatggcttggatactagaaccctgactaggggtagcaaggggatgaaggaatggcaaacacagagactcacaatataattttggattgaatagcctggactctatggagaagctgcagctgctccccaccccctgaagaaaacaaagcaaagcaaagcaaagcaaagcaaagcaaagcaaagcaaagcaaagcaaagcaaaattcagtgcatttattctacacagttgagcagggaagtggggttattgcacatagctgaacaaggaggcagggtcattacattgcagataaagaaggaactagggttattacatacagataaagaaggaggcagggttattttatacagctgagcaagaggacaggttaagcaaatctcaatagatacagtgtctggagaggaccagtctttaggccatagcatgggcaagggggaagaaaactacagtggtcgtttctgtacccactgtcagcatttggactctgaccagaggaagatattgtcatttctatgagtctcagctggggaaggttttgccacttccatggcctgagctatggggtttttgataggcccatgctcatgccaacagcacacattccctcagaacctccctgcagtcactttgttgttgttctgctgtggaacccaaggcctcactccaagctctacgaggaagatcttcacacgttagggcacttaatcatcctgatcactttatggtgtggatgagcaaaaaccctcaagaggtagcagaggcaaggctaaggggcaaagcctactctattgactagtgacagtctcagtttcccataccactttcccctgaatgtttgctcctatttaccccttacttactatctagcattactggtagaatgttcctagagacactgagtgagctgcttgcactctgctccctcatgctttggggatcttgtgccttggactgttagaacttcatcattcattctggttcaacatttgcctctttatatagaaagaagtaaagtgccacttgcatgtatttttctggatatcagttgacattacaggtgctcatgatttatagaaaacagggtggatgttgaggggggtctggaagtgagctatctatcgtcagggtagtgctggcaggtctgccagcagaagtcaggtttctagattctcaccgaatcctaacctgccctcaactccccactaaaagatctataatatgagaaggttgtgccaggagaactgtgaaagaacaaagcttgaataaagactggggtgatgagtaagttgatgaaggcttggatacttgagtaacttggatgccaaaccctatagtgactggcacagcaattaaactgagacctttgggattagcttttctagaggacagatcattggcatctctgctagtcagttggtattatagcctgataagaatcatttgtagtgctttcaggtttctaacttgtataacaaaggtgtgtgtccctagagaagtcactaatggggctcccagcatggcatgcttttaaaaatgtctgctgtcaagtaggacacttattgaaacttagatgaataagaaatgaatggacagctgagcagaacatctattcactgatggacagatttcttaagatcagacctatggaagaaattctatgataaaaaagtagacatgagtaataaaaatgttaaaattagtgtatatcgaggtaattaaacaaagaaagagaacaacacacagggaaactgtattgttataaaatgttataaatgtaatatataaaaaatatattaaggtgccaggcaaggtgatacatgtttttaatcccagtactctacaagtagaggcaggcagatttctctgagttccaggccagcctggtctatgtagaaagttccaggccagccagaacaatatagtaagacctatctcaaaaagcaaaaatgaacaaaaatattatgaagctgttagaccaataccaaatgacacaggaattttccataatcacaaatcccataaggaaaaatagtcccttttaaaaatttttattgttctgagccaaggattctcttggtagctcaatgaatcctttgtgcttagattcctcctgcctgaaactgccttagaatgttggattacaggtatgtattaccatgtcttgccatggagaaaaattttaaatatatgaaaatatcccaccctactatttattaaagtgtaaattaagatagtgattagtagatttcagcccactaaaagaatatttactggttggactgttgtcagtgcctagtataagtggtgaatttgtatagctatatgatatttatatgaaggtatgtcaataactaaaatatctcatccctaagaatttatctgctgaaaatggttaacaaaaatgcatatagggactgtgttaattgtagcagtgtttgtaataatgaaaaataaacaaggaaaagaattaagttgtattatttacctagaagacatgaagccattaaaatggttcacacagaggcctttaaatatgtatttattatgatgttttgcactataaatactggctatctttctctaagcagagagttttttaaaatgcaaagactctgcttttatgtgtttttatatttgaggtacctggaatagtgcttgaatcctaatatgtaccttcaaaaatgcttgctaaataagtacgtgaataagtagaactataaaataggggtttgcttttgttttgcaaaataaatgaacagatcagaacacaaaattgccgacacgaggatgtaatcatgtgaaatagatctatattcatgtgatccaggattgaaagggagcaagaattgaaaatggccttgtcatagacaatggttttcctttactgtcataacaatactttaagaacacaaatcaaaggctggggagatggctcctgttaagagcactaactgctcttccagaggtcctgagttcaaatcccagcaaccacatggtggctcataaccatcaatagtgaaatctgataccctcttctggagtgtctgaagacaacaataattaaaaaaaaaaaaaagaaaacaaatcaagaacaagacacatgaccaatacatttcttgagaaatgctgaacacttttgcctgtcagctgtgaggaaaggaaccactgcaagggaacaattgctgcacttgtgatgggacacaagccactgaccccacatgcagtacttttctgctcatttgcagttggattctagactgcatgtgctgatctcttcatcaggaaaaggggcgggggaagcatagagtctgaaggctagcttttaatacatttttttcaaaatcatatcaaaacttctctattttttagttgatttgagatctcatagatttcttttttaccattatcagtatataatgttctacccttttctctaataatgaatgttatatataggcttataggcataccttctatgattctactatactagactgaaatgaaaagtgttccgagtaaacaaaaccctttaagtcatagatacagatgaaggtaagaaaacaataaaagtcttgtgatactgttgagtcaaccaatctgttaatgaatgtataacatcttagggctggagagatggctcagcagttaagagccctggttgctcttccagaggacctgggttcaattgccagtacccacgtgatgtcctacaaccatccataactgctgtcccagaggatccagttccctcttctggcctccaaggatgctaagcatgcatagctatatgtgaagactaagcacatccatacacatagataaataaaagtaatatttaaaagtataacatattgtgcatgtacatattataattatatcttgattgattgattgattgattgattgacagtgttgagttatataatgacaattcacacctattttttttgggggggtccttgacagacagctctgaggatcttgatcatgtgggctgctttttagaaaacaattgagtcacagaatttttaaaatgatatatgtgtatcttaatatctaatattaacttaaaatatcacaatctatgtttatgttcaatacaatgttttaatacagagtcaggcctatatctaatatttattgtatgtatgtatgtatgtatgtatgtatgtatgtgtatgagtgtggccaaggtcttttctgtaagtatgggttgctggtttgagctccttgttttgtgcatccacggtgtattgtctatgacctgcactgatttctttaaagtgtgtcagtagcaatgaaaatgaagcaatggaagtatattgtccttctgatgatccatagctccccagcctcaggttttttgctccctaacttggcagctgtttttcttttaaccttcaatttgttacctttattctttctcagcactaactttgtcttcacacacccaggtttttgcactatctaacccagcaatacccttggcaggcctaaaaggtttagaaagaaataactttgggcccctgtaggagaaataacaggtacttgcttgccagaaattaactaccagcctgcagccctcagccttggtgatggaagagagcaagggatagtcctggagtggacaaagtgaaggctgtgctaaggagcctcccaccccccttctgcctcctggctggggcatcctcagtttggctatatagaaaagccatcatggtaaatttaaaggaaccaagctgtcaacttggaaagagagtggcaagctctaaattcctagattgattgacattcccccttacccctacagattgtgatttttaaatgagtcatgaatatacacgtgggtcattttggttcagagtgcagaagacagaaatgctagtggggctctcagtgcagttgaacaagcaagctgtggggacaaatttacaggggcaaaacctgggttcctctggaattttccctttttctttttaacgactgcttctgttttagtttggttttgtgtttgtttgttttttccctgtgttatctggaatctaaggaaggagttgggttttttgttttgtttttttgttttttgctttttttgcttttttgtttgttttgttttttttcctgtatcgactgaggctggtctcaacaaatctctcaaagtggtaacttgagtaatgttctgaaatttttttgttttatgtcggttttttttgtgattaattttagaggcatttctcagtggttcccagtcagactggctggtgactgagggaatgtagattctgagttaaagcctgacctggctttgtggtttgcaaagatgagaacttgcatgttcaaaaactgtctgcattcttcttcatatgcccatagaaggagattggatccactcatctccggttaaggaggctcttgaaatgctttaaagctttcacccaggcagacaaacctctgtgtgggtggatgggcgcatcctccgcctttcactcttgctcaagagaagccaagttcagtgatctctttcacagcacatacactaaaaattgctggcatccgtttaaaagctgatcagctagcgggcgatccaagcatgcattcattttctcccattaagactgcattactttagaagcaaggttcttctcttgttttgtattttaaaagacatgctaataaaaaaaatcttagtattggaatttgatcatctagcaagttcaggctgctctacaattgtcctctgtttaatatagtggtgaacacatctgttttcctagtgtatgtacaggtactgaagcatccatactatggtgagggattctatgtttagaagggaaggtaaactgggtgccataatgcatgtctagagccccagcacttggttgataaaggtagaaggatcagttgttcaaggtcattcttagctacgacagtaagtttgaggcagtcctagcctgtgtgagaccctaggtcaaataacaaaaagtgtagaaaagaaaacagttatatttgaagcctcagcatgtggaacaggctacaactatctaaaagaaagtatttgtgctagatttgaataactatgaaatttcttaaatatttaaatgcttatatcataaacgaaactacttatagatacacagagattcattgaacagaatgtacacgctgaaacaggctcagtttggtcatggagattcctacaagaacctaagactataagagagtggcagatgatggaattaacaaaggaacaaggaagtgaaagctagagctccttgtggagggggaagaagatgccacccaggaacagagaaaagccacaggatgcctatgcttgaactttcaaggagacatcattgaaagctttcttccctgggcttttgctaaggcacaggagtcaccacagataaaacgtgcaccctcttggttcatcagaaagcttatcttactcgttcagtttcctttttgttcatagttccaagttagaatgatggtaaggccttatcagagttctttaggaatcgggaaatctgcagaatagttgtgacttctgggaagggggagaccatggtgctctgctgaaggctgcctccagaagccctataacagtgcgtctccaccctcctaatgctgcggctctttattatagttccttgtgctatggtgaccccttgccataaaattattttattgctacttcataattttaatttttgctaccgttatgaattgtaatataaatatctgatatgcaggctatctgatatgtgactcctgtgaagccaaatccttcttccctgccccacctttatttttcaacaatgccagtaacttgctgaatggtccaggctagccttgaatttcagatcctcttgtctccactccctgaatgctggcattccaagtgtgtggaaccatatctgggttcagaaccctttctattccattgaaaatcatggatattgctctgtcttgcataagccttacatagagattgtatttttaaaaccctgtttccttataaatcatactatgggtttctcttttgaactccccttcttattaaataggctttctccaaagcaaaggggggaaggaatgagaacgaacatgtcggcatgtatgaactctttgagcctacctagaaagcagtgaattacataggaattaggggaaattatagacaaggaatctggtacttagataatgcttatttctacagagacaattacttaaaacaactacaatggacaataatgttcaggaagtggtccctttaaatatttcttcattaattccactgatagaaaaatgtcttctctagaaacaaagtttatttttaaacactgttcatggaattaaactatggcattgtgtacttatgtgaagttgtagaacaaccaaaacctatcaaaagtgcttgaaataagattaatgattgactgggaaagggcacataggaattttctcaagtaataaaaatatcctgtttgtttatagaggtgtagctttcaaaactgacctgagatttgtaaattatatctcaactttaaagaaacttgataaatagtcttgatgaatagtttttttctcatgttgtaccattttgcaaaatactttcaactcccttccataggtaggaaacatcctactgttgaaatgtccatgtaattacttctgagaagtatgtgtttgtgcatgtgtgcatgcctatggctatgtgtgtagaggccagagcagtgtgtcagatgtcatgttcttttactctgtagcttactgccttgggacagtctctttcagaaccagaagcttacagtgtgttgcctaggctagctagctagctagggagttcttgggaccttgttgtctcctccctaaaatggtgggcttacgtggaactgaacctgactttttacttgggtagtagagattctagcatatgtcctcatgagtgtaaagcaagcactcgtacccactgagtcatctccctagcccctactgtgatggaaactgactttttttggcttctgggtatctctacttcctgccctgctccatctaaatttactctcctagtgtgctcctgaaggggatttgagtaacacagaagtcattgattgaaagcaaccctaagtggattttttttttctatgtggctgcttctactctcaggtaggctttagatttggcaaacctttattcccttccttgtacaacagagagctaaggaacaaaaaatcaaggacattacataggacatcttccctgcgtaacaaatgtaggagatgtctgcacagggtgagtgttgaaatcactgttagattcctcagcttccaatagggcgaaaacagagaacttacttccttgagcactgaacccataaaaggctatttcttgtaaagggatcaaaattctactggaatggaaactatactcagcctttctcaaacagcactagtaaactgcttttttgctcctatctatgagccattgattggtaggatttgcttagggggcacagtaatggggcctcaagttagccacattggcggcagggagggagccctagggtttgtccttagcctagatctaggaactacagaaaaatgatgatcatttgggattgggtgggcataggaagaaggtggacatctccctttactttcttactgcgagaagaaggtgtgaacctttggcaccacctatagtctatactctattgcaaaggcacacatttccttttctgtgttcaaaaatagaagcgtcaatacaggccatcttaatttctaagcagaaggtgtgcaagctgtgcaggttctcctcttttgttctagaaatttctccatgatgagtatgtacgtgctcacacatgtggatgtatgcttatgtgcatatgtgtgcttgggtttgaatgtgatggccagaggtatcttccttcatcactttctgccttatttaatgagacagtatctcactgagcctagggttcatcagttcaaataatgaggctgatcagaaaactccaaagatccgcttgtccctgatttctcagtctgagattattaatgtgcattgccatgtttgggttttgttttacatgggtactgggtccaatacaagtcctctgtttgcatggccatcactttacctatgggagcatttcttaaactctgggatgaggtcttcatgggttctgatcaccaatgaatctatccttgggtcataaggcagtataggataactgtttagtaaatattgacgtcaccagaatggctacacaggcttggtgtggcaggacctgactaagaacaatggtaacataatcaggatttcttgttcccttttgctcctcataggagggaaccccgccctcccccactccacttttatatgagtcaattaggactcgataggctgtcatagaggatttcttttaatgatttgcctgtcgtgaatgtgttggcactgtgcttaatagggggaatcatcattctgggcttcagtgcctttgtctttatgtggaaattaaactagatgatctcagaagacagctagtgtgaatagaaggataatattttctcctctctccaggctcagtcttgagactaaagcagcagactgtagaaagaaattgtattacatagctcttagtggttatggtaccaggctttccccccaagagggctcaggtcacaaggaaacaccccttgcatccatggaagctgcaattggaagagtatcccccaggtgacgagcaatggttttattgtcaacccttccatttgctgtgtagctaatgatagacctctgtagttttcccatagactcccaggccgtggaatgacagtgatactggcatctgggggtgtggcagggcgaagatgcctttgttttcccagtaggcagctgctgatccttcacgtcaggagtgctttcctggaatctcacactagagctgcttattgggaacatgaatatttcagacatcatcagactgaatatctggagttggttcagcctccctccgctgccaggaattgtgccacagatcactcagttgtggatcctgaccttggttgtggatcccttgccctgtgattcctgggaggaaggaggttattttactggtctttattcagggcaagcataaggaccccatgctacatatcctgtgactattggtatgcagactcgcagtgaattcttccaaagatcttaatcctattaaaaccctctttaaggaataatatacatcgattgaggtagcatagaaacatgcaaatgctagttagtggaaaggatgttaaatgcagtgagctgatactgagtagtcatcatgacagccatacctagatgctattgtgcgcattcttctcctaagattttgtggccatgcaaatgtaatcaatcactactccacaaatttgtaccctgtgagttctctatcaaccgttgtaaaggtattgctctggttgtctccattctctgtcattcatcaggccctctcccctttctggaatgctctgaagatacttcccctaatcttagctactgtttctaatttcttaatggcctatcttaattttgacttacctcttctcaaatctgtcttttaccattccagatataagtgagctcaacttgatgtaacaagtctgctttgtgctaattcatttctttatcctgcattgctagccttagtctttactcacaccttatcttgatacattgtcactttctttagaaaaaaaaaaaaaacctgggacttgtcatatgtaattatgcactcctcgattctagcaaagaaccatagtgcatatacctttaacagagacaaagatcatgcttaagtatggtatgcgagatgaattaccagttcagttacatagatatggaagcaggaatttaatttggcaggagaaaatgaataagttcacataacagctaagtttcagggtagaatttgaactgggcttgagttttagttttcttttttatttgtttgaattattgaagttcttggactgtacttgttggcttggactggtgtagtatatacatataggaaacctttaaaggttctagctcttttttttttctattgttccatgtgtttttgataatgtcattcttgcttgtcctcaaagtgaccttatttttctctccaggaagccaagtaaacattcagacatctactttgctgttggtagatccatctcaaatccttcagacaacttctctttccccatttcacctgcccccagctagttggtcacgaccactccatacctcaaaactgaacatatcatgtctcttctcattactttcctggtctaggtcccacttcctcctcagttggccacagccttccagccccctaatattccagtctttcccccacattcccagagaaactcacgtgaaatctctctacccctcccaagttctcagctcagaggtcttttttttttttttaattgaaaatagattctgctcttaattgcccggttttggttatcttgcaaactcctccttcccttctatccccctccccgtcccttctttgtcttactcccccactcttcctttttgtttctgttgcttgtttgtggtactgacagttttatatagaccttgtggcaccatatttccagctacttgatctagctggatagctcaggctcacctcacaggtactgtttattttccttgctgtgtctctcctgagtgctggaattacagatgtgtatgcccctgcctggttatattcacagggcttttaaaaaaatagtggttttcataaaacaaaacacataaaattacatagtcactctggtgaagtacacatctaacaaaagcaaattttgatacagtaatctatgtgatagcttaatagattaaataaccaatgctacccagcaggtacatttcaaagtaccaatgagcacaaatgatattttgaggtacatcatctatgatatattaggaaaatattcatgatttattccatggtaagtcaccagttctactaatactggtatgctatctacattcacaaccaaagggaatgccaaatttcagttagaagttgactaaaatgaagtgtcaatttttggctgtttgtgttggatttcaggttaactccctttacttgtctgaatcataagaccacatgtcctgctttctgttttcctggtaattttagagcatcggatccctgttctgtgtgagttctactctgtaccatgtcagtaggagacctgtctaacctcatcttggacctctgttctttctatgcaggtagaggaaggatggtgggaaggtgtgctcaatgggaagactggaatgtttccttccaacttcatcaaggagctgtcaggggagtcggatgagcttggcatctcccaggatgagcagctttccaagtcaagtaaggatgcctaccattctgaacagaaagggaagagaccagtgggctctgtcatagcctccttatatactgtgcttcaatgccaaagggctatgagaaaagcttgtgggtattttcttggctcttgcaccttagcccactatgatttaataagtttgtcactgtatagatgtgacctatagctatatattctatatgtctctggataagtgagtaccagcctttagtcatggtagtactggctcatgggtggcatagattgttgtgcttccatatacttacttctagaatatcttttcccagtgagtttataattattttttaaataaatgcagtgagatgatcagtatcccccaatgtcctctgaagaacttaggaaaaaaactaacgattattggttgcaagatactgtgtacaagataaatgcatgccagtaccattgcatatatgacaagatagtccagcctcaccttgaatgaggaagtggttcccttttgtaatggtgagaacgaacttcaggtctttttttctccagggcctgaaggtttccttccagcttctctgctgccctttccagctcatggagcaaaaggtcaggaccgggaagctttgttctcccagtcactaacccaactccccatgtgggcgtctgtgtttattttgtgctgtgttgagccaaggtcatggccatgaatgttgtaggagattcagctatgtcattagtagtgtcatgctacttgctgactttctttcctgatgtgaggaagacagcccagtcttaccaaaacaattttcaaatagcttcactttccattttgaaaagtttaatttaaacagtattcttctattggcttggtatccctgtattcattcagtagtttaattggataagtgtttgatttggaagttgaagctatttccagataagtacttatgtgactctttttggtgtgtgtggggtggtagtgtctcagcagtggctttgggctgtacagctggccacaaatagaagcaactgtactagctggctgactcagtgtctgcagcaggatcccttccttccactgagaatcctctgctccaaactccattatatcctcaagtcttggatgtgaaggatcaggatggctgttcagatcgactgacgtactgaggagctcctgtcaccttctctgagctgagacaagtgcttctccaccaatgtggccagctcaatgcgtagagcagtggtagcttcttttgcccctcctcccactccacagtagaattttaactgttccagaatcttcttttatacactagaatagcatcatgcctggtaactaggtcccatattaataatactgtatctctggaacattgtgagttaaatgtttctgtctgtctgtttgtttgtttgtttgtttgtttttaaggggattatatttttggaaaagggttatcataactttattttcatggggaaatgaaatctaagttctaacagcaatagcatacataggaaggtcctcagtaaatggtagctcttattgctggtaagatagacttggaacatgaccaattagtgtttagccatttgttttctctttgctaccatggccactgaagcaccatgattatgttttaacaattactttgtaattcctttactgatgcagagagggagattggggactgcctcttgacttcctggcggttacctaatcttagctatatagtctcagaagtgaagactttcaggagaatacatgccatagttttgggaactattgaaacaaactacaccatgagatggtcttctcagtcacttggctatcctttacctacccctcacaccaactcatttattagatagacatctgtttcagaacaagaactgtccagcagtttttgtagctgtgttgagtgcagctgcccattgctgagagggcttgaggtccctggagaagtatgtttttctaacaaggatggatgcttcttataaacacaaaacagaacaaaacagtgcttgctgtagtcttcctaagtatacagttaagaaaagcagggcccaatatggccctatctgcttgcttatatttgtccattccctttgtcttctctttatttccttcttctagtcttcattaattaaatctctgttgagctcagaagtggctctgtagttactaagatcttccctggtgtcttgaagagtcagagacaaatgaagtacagatggggaccttgtcttcagtcaactcatcttgcagaaaggaggcaaaggctcaggaaacttccctaggagctgacatttgagtgggagtagggtacaaaggcagagaggccagtcccatggtaatgtgggggaatagtagtcaaaagggcttcatagaagaggagatgtggaaataatgttgttgttgctttctgaattgtcaccctgccctaacagacagaagtagcacctttcagtgttgtggtagtgttttcagtacctgtcaacacttgtgactagcttcatcataggattatcctaaaatgtatatataaccatatcacattgctacagagatcatgtatatgatgggatgcatccaagttggacctttgagtttagaatggtctgcttattctcttcagcagagaatagtgttaggactttggatatgctttacttcttttagaaaaaaaaaacttttttgttttgaagtaattaagattcataggaagttgttaaaataaacacaaactatatagggaggatccacgtgtaccttcatccacatttctccagtgattgcatctcctataattacagtaaatgcatatttgtttctgttctgcagttgaaagatactaagtatagttggtgtacaaacagcttctagctttttctctgctatgagccaaaatgtacttaatcagagtctttgtttgagcagcccacttagtactctgtaaaatttccataatgattgcttaattaatacatgactttggggctaagttaaatcctaatctttctaccatattggtaatgtttagagattatagtggtatcatataaatatccttttaagtgctaccagacattagggtgagggttttctttgtgactagagctaatatttgtaacctaattatggagagaacgttgtgtccaatgaattcctgtacatctttgattcatgcatggacacaaacactcctccctttggattaatgcattcttatttgtatactttgcaaataatacttgaagctataacatttgcatattaatagatgcctctgatagtggaagcgttggtggtgtactttaaaaagaaatattccactgactatgtgtcacatagtaggtgtttaataaattcttcatcagcccattattactccatggaggcatttttatctggaatgacagatagacattgctagaacttgatttttatgcacttttgcatatgacttttggctcatagatccttgttcagggcagtctgctctgtcacagagacttaacaatcatatgggtttgcccacagttaagtggtaccaggaactttctgcatatttaaatttgaaaacattttttccatccttggaacttgtggcaccttatatgtagttttcaaaaagatttttataagttctcagttataaatgattttcaaatatcagtaaaggaagagtataatgaacccacatggacctgtcctcggcttgaggctaatttattaacagtatggcttacacattcttaaagaaaatcctaggtattatataatttaccaataaatatttcaatatgtatcaataaaagggtttcttgaagtactattaccaaaggcacacaaaatttccttaaataattaaacctgtgctccatgtccactttcctctaataaactacatacacagtggtgagttgacatgtctaaaatttctctgaatctgtcctccttcatgggtcgtccttctgtgcaatctatctgctaaggaagcaaaatttgtttttctattagttcctcattgtctggcttttgatagtttcatcactgtgtgtcatttaaactccctttctgtaaattgttaactaaatctggggatgtgagtagattaaagtgtgtgtgtgtgtgtgtgtgtgtgtgtgtgtgtgtgtgtgcacgtgcatgctacatctttttaggtggtattagatgctccacctggaagcttataaggtctgactgtctttccttttaaacttagcttttattatcagtcagacatggcttacagattggtaccaagcaagatttttttttaaagaatgaaatgggctcccacctctcacattaataaatatacacaaaaaggtgtttaataaaatcagatgttcaaaaacagaacacagaaatgtttgcatcaacagaatagacagtcttacgattctgtgggtgagcagaaattttcctttcattcagcctgctgtcagatgacaacatgaatgctcggtgaagtgacatttcagctgtgcccttggcttatgcgttaggagaccaaaatgacatgccatctttctacacatattgtgggaccaccaccattatacaaacagatcaacttctcatgaaacatctggcgaattgcaagtctggctaacattgggtttatttttaccacaatcatagatgttgactaattaattgtctttttatatataattatacatatgttctcattgactaaataatgttttcatcacacatcatcccgaccctctaggatttatttggacttagtgatgacaaatttttatatctgactatggtcccatttcagtattgtttgcctcatatttaaaatatatatgaatcttctatttttaacatttttgatactgcttaatttcaaataaaggttgtaaaagtatagtcattacttttttaaatccttgggccagagatgtaactgagttcttttagaatgtttgctaagcatgcacaatgtcctggatttgacccccagcactcaatactttaggtatgttggcacaactctgtactctcagtgtttcagggctgcatacagaaataccagaaattcaaggccgtcctcaggcacattagatagtctaaggccagcctgagatagatgagaccctgactcaaagatagccctatcgttccaggaatatcttcaattatttctcatcatcatctcagcaagaaaaggttgtattttgtatgtaactacaattttccatttgaacttttcattttctcaatttcttctttaaaaggtttaaatgtgatgctttggtgacatgtcaagctaagacaaatataagagggcatcttagaaagtatgacaaaaacttccttgatacaacatatcacaaaagtctccattctacaatatcacaagacctccttctgtttcagttttctttttagtattcttttttaagtatttattattttttagtattcttctttagtattatttttagcggcattggttctttgtgtcctattggcagtgaagggcagtttacccaccaataaaacagtattaaacaggcaaagttagaagctaatataagtatacacttttatgtctaaatttaaaaacctgtcccttctccagtgcttgttgccttcaagaactaatatttagtggtcatagcacaatcttcaccgccagcgaggcaaacactgctcatatgcaggagctttctgattgcctctctcttgttcctcactcaagtaagtacctgggagactttgcccagccctctcccaggctatctctctgattgtcttgctgccagtgggcaggagagacttgacagacaatgcagatagcagaacaatggtctgtctcccactgggattttcagacttgcttctggggcagagcacatgaaagctttgctgttctcaggagcatccccggaatattgacttttttttcttttctatctccattttgctggaattgagaagactgatgcttgttcatttgtagagggctatactttaggagtgatggtgacattcttggagtaaaaaatacactcaaataaaaactagctgcttgctggctggacttttgacagagagtctaagaaacaggtttgcaaaattctgtagcttctctagattgctcaaatatagacagtggttattttttgagacatggtgttaccttgtatcccaagacctggaactcaatatgtagtccaagctggtttctaggtccctcctgcctcagcctcctgaacacctgaggttgcttatacataccacttgaatctgcacataagtagtgacttgaatgcctaactttttttttgtttgttgttgttctacttggctgtagcacccaagcccacaaggacagattttcagatcagggcatattaccattcctgttacacatgggaatgacaatacctcatctatttagaatgatctgatcatttataactggtgtcatgaattggaattgacaaggcctaaacagtgaccctgttgggcttccttttgtgatggtggagagtttctaaggggtaagaggaattactctttcctcattcagttatcttcgctgtttctaaacctagctcaatggtacctctccattttctaggaaaggagaagcccgactcatgtttgaatatttaactcatgatctataacagaactcatttcttttaataatacatttactaactgagattacttttcaaatcattttaccatcttgtgatattgtctgtggtgtgtgtgtatatgtgtgtgtgcgcacgtgtgtcgggaaggtgggtgggtatgtgtatacttaaattggaacaatatatgcctttatgctcttacgattcagtgatatttgggctttagctacatgttcagtcatctgtatgatattgtatcaaaactattatatttgaagctgaatgagtcctctgtcctcaatgcttaagtacagactcattattgacacagcaaaacctcaattaagatgtttcaagaacaggggtttttgttttgttttgttttgtttttaattcttggtgctaacccaaaccatcccctcatgttggtatatgtgccactattggtttcaaatctcattactaaaatagcccctggagtttgttaatttcttcttgacaaatctgtttttttcgtgttatggtgctggggtcaaacctcgggccttatgaatatttagcaagtaatctactactgagccccactccatgctcactacactttcctgaggagggttccttgccatgtttataatactggggctcgaatatcagcgtttactatgtgctactctaggaatgaatgacgcaggcagaagggccagatctgatttatgtgtaggtcacactcttcaaagagaagactgcttgctcagttgagttaatgcaatagtcctatgaattggattctttctgattaattgaggttttcctactcttaagttaaaatgtgaaatggcttccaggtttttaactgggcataccatccatgtcagtcatgtgagaaacaagcactaaagctgggtatttcttgccattgtggtgacctggggactttgggctcattctgtaatattcttaaactctacctaatggtctttaatgaattgcatggatgaagctcttgcagccaggtaggtcattgacggcaagttcagttaaagactcttcctcttccatcatttgctcccctctgtccccctctcttgtttttctctccccttctcttctctcattcactgtcaggaaagactacctttgaagggacaattctgtaccgagccgcaccgggaaagacggagggccacagacgctattacagtgagtgaccttaacagcaggaggcaatcataaagctaagatccgggcacctgtgggttttgatacagctgtgctttttcctgagctgcttgagcttatgccaagtctctgtgtgaatttctgaaccaaggacatgggcttatttgactacaataagtgtcatttccttggtgtatgctacgagagcactctcatcaccagctcctggcgctttcttgtttgctttctgcctctctcgtgcgtggcatgtgtgcatgaaccatgtatgcagagaaggaagcagtagacactgtcatggcagtgggagatggcttctggtggagacatcaacctcttctggttactgctttttccaagtgggtcatttatcatttgcgtggttcaaagaaagaagatcttggcacggaagtccatgccaggcccagtgtttcactttgcccatccagctaatcatcacacggcagacttctttggtcaggacccattgcagccttttgtttcgtaaaaagtacgctgccaagagttgaagaaacaagatgtatggattaatttcatgatggtcttacagcaattcccgctacatcaggagcactacacatgtgtgcaccaaattagaaacagtccaactgatgggtgcaaaagctagggttaatcacaccacagtgaacagccacaggactgaggcaaagtttaggaggcttcgttctgcattcatctggagggaagagcatccactgtggtgcatatacacatgtatccatgaattatatacacacatgtgataaaagaggttcagacatgagcaccacaagtttcctcaaatggtggaagtgaaggtatttttctttctattccactctgaacacatacacatagcatgtgacttagcatgcagtgtgcttcttgggctcagtggggacatctgaccttgttcacctccatgccctgccctgtccacgtgtctggaagttatgccagtgcataatgctgaaacgcttaagtcatttccaaactcttatgcatttttgcactatctcatcatggaccagtaatgtgcccttcattaaactggccccagtctccattccacttggtaagctgagctgcctgaaagtgccatctactattctgaataatgatatggggatattttattggaagatatacatgataggcacaagtagctaaaagtctacccaacacacatgaaaattaagtaaactttcttcccttctgaagagagagaactagatttttgagctattacatcaatgcaaatatttagctgtataatttacattcttaaaaatgatagaagccgggtgtggtggcgcacgcctttaatcccagcactcgggaggcagaggcaggcggatttctgagttcgaggccagcctggtctgtacagttccagcacagccagggctatacagagaaacactgtctcaaaaaaaccaaaaaaaaaaaaaaaaaaaaaaaagatagagcctggatgccagaatttctggaagaaaaaatctgccgtgtgtttccttcccaggccatgcttgtgtggctgagtgactgtgcgtctgttccctgtgtaatagattatttcttacaaggactaatacgttgttattacaatgagcctgaaggcagcaaatctctacaagtggaaacttggtgaaataaaatggcggggaagacagattatggctgtagctaatggtgaaccacagaagagcccccgacttcctctttctgaagaactaaaacagatacactctaatccatttaccctgttgccttctggtggtagaggaggtggtggtggtggtgatgggaggtgatggtggtgattggaggtggtggtggtgatgggaggtgatggtggtgatgggaggtggtggtggtgatgggaggtgatggtggtaatggtggaggtggtggtgatgggaagtggtggtgatgatgggaggtggtggtgatgggaggtggtgatgataggaggtgatggtggtgataggaggtgatggtggtgatggtggaggtggtgataatgggaggtgatggtggtaatggtagaggtggtggtgatgggaggtaggtgatgtggtttcttcctactatttctttatttcaccctcaatggttctttccaaacacgagaagaatatgcaagccatttatcacatagaatgaatccatacggcaaaataagaacatgttaaaggggaaatgacacaatatttagactccaaaattatatctccagcattagtattcccagaaacaatgagtagataaacacacgaatggatagctaatccagggggctcaccatgtttgcatactccaatccagtcctgtaccgtgcagctggccccctcattcttctgtcctgtgtttctgctcacaaatgctgagctttagttaattaaaatgtgcaccagcaaccttctccctcccccaccctgttggcttagaaatactgctctatggaaaatggcagcaacaaaggcaactattgttctatggtttgaatctgaaagttgttagcaatctataacaacctttctgtattttaccagtttgcttttaacagtttcttcccattctggcacttcctcacttaaatggcttcaacatcttatggtattgagcaattatttagtatattgttcctatggactaggtagccacaggaagctaatatacagttggccactaagaaaagaaatttggtggcattcttccaccttaaaggcattgtatgatcaggagatacagactaaattggttaaaaaaaaagctacctaccctacacatctagaaccttgaagatatagtttaatgacagaacttagtactcaaaatatcatttgaaccctgccctttagtgttataattaatgtcctgacaccaaaggaagagtatatgccctgaaattaagtagactcaaatagcgtctccattttagaaccatgagtgtgggcagagcctagggagaaagcatctggggaggtaaatgttgatgctgccttgctgataactctcttacaccttccaacacacagcagaagaggttcaagggaatgtgccatgaccccagcgtgttttctttggaaacagattccgctttgggaagatggtggtgttagaggaagaagaaagaaccctgggttgggattctggcctctgggaaggcagtattttttcccatcattaacaagcactaccatcttgctagcaaatgctgtcttaatgtcaagtttggtttaatgcttccttagaggaacatgcctgtatgcatttattccctgtgaagccatccaaagagatttaagtcgttggcagtcatgattttgtgtgatttaattgctaatctgtttaaatcacttttagctttacagttcccctttagaaaatgatactttcgttgctagtttctaattgacacaaatcagagtttagaggtacagtattggtagtgactgagtgggaaggttagatatgggcaaggaggtttggtattgcacaagtcatggggacgttttttggattgaagtaggctttggctgaagcatgtgaaatgtcacatatacaaagaaagtagagtttctgaaaagctattttgattcactgcttaaaattaaagtctggggtaggaagatcaaacaaaactcagagacagcctgagtcagcacactcaacaccccagtacagaagcccaggcacactgtgacagttggcgtctggccagctgtaaagttctttattgtggcctgtggctgatttctgagctctctccctctctttctcctcatccccactggtgacaggcttaagagaaaccacaggctccgagagtgatggaggcgactccagcagtaccaagtccgaaggtgccaacgggaccatggcaactgcagccatccagcccaagaaagttaaaggagtggggtttggagacattttcaaagacaagccaattaaactaagaccaaggtcgattgaagtggaaaatgacttcctgcccgtcgaaaaggtacacttgacttttctgtctgattttgttgcaatggggaagagccttgggcttcgacctcagatgtttctggtccatgccttcctcccccccccccccccacttaaattcccttttttgcaggagtggtctccctgctgctgatttcttaccactctcttgtgtcggtcagttttctacaactatagcaaaatatggcttgagataattaacttggtaggacaaaatggcttacctcatgacctggatagaaaagagctggggagggttggaatcctataatctcttttaaggtcagtgacctaaggatcccccaccaggtctcacatttcagaggttctacaacctcctgatggtactactctagggatcaggtctaacacctagaacttcatttatataaatctcctgtaaagaatgtttctcaggatgacttttcaaatggttcagcacttctccatctcccatccaaagaagccactcatacctggacccagctaaatatatgactctgaaatcctttagatacccccaaatctatctctaatgctttgtgtttatgtgcgttggttgtgtttatatagtggagaaaagcaattgtgtggatttttttttctaagagttaggtagagagaatttcagactgttgaaaggaagtctcctgtatgcgtgtgagcaaatgatagagacagtttgtgttctgactccctgggttgctcccatcaggaagctagctgttttcttctgcttctggttctgggctggtgagaagcagacagcatgttgctgctgagtatgcggttgctatggcaacatacccagagccatagctctgtggctactgctgacgtctactgtggtacacttctgagcatcatagccttccttaggagttgataaatactgtggaattttccaaattataataagctacactcgtgctgtgtttaagaaatgtttgttaatttgatttagtgttaagatgtttgctttgacgcttgtgccagcaggtttgggatagggcactggcaacattgctaattcacgtctatcattgtcttgtggttttcattactcaatgaggtcaaaatttaaaggttgcatcagcatctgcagctgtagaacctgcactaagtacccagcccctagcagccttccctaatgccaccaagcattggaaacagtttttgtggagtgggaacattttggacatttagtcccttagagaaaaggcacaaagaaagaaattggagcatgcttcacttaaactcttcctttgttgaagtgtccctgaacacgtttttctttttcaattattgataatgcgatgttgcctgtgatctgaaaactatgttgttagtgtctgaacttgagttttgtttcccatggccacattcagatcctgtgaagtagccacaaaaaaagtgagtagacatattgagaaggaatgatgaacggagattttttttctccattttattcaagaatttgggaaagaatataaccattgacttaatcaagggtacatgatgtgtatatgtgtgatttattattatgattaataatatttgttttagctgacagtaatatattgagttattatatcagtatcagacatgatccttgttctttctgtatgttttttgcatgtgtgtgagtgtatgtatatgtatgttcacatgtgtacacatgaagaagcctgatgtagatatcaggaatctctttttttctccactatattcattgagtcagggtttatcagtcaaactgagagcttaaagatatagaaaatcttactggccagcattctctgcagatcctagctctgcatcttgaggctggaattacagaagagtgagcgtgctcctgtaattttgactcgtgttctggcaatctgaagtccaatcctcttgcttgagtggcaaatgttgactgctgagattatttccctagcccctgtttgtttattcctgaggtgcgatctcactgtgtgacctttgaacctctgagctcaggccacttccccagctccataagtgctaagactataggtatgtgtgtcttcctaccagctactcccaagtttatgtcatagcacatttcttccaagaatggaatgcctttctatcatttccacctagagattctaattcatgttattttatccaaaccccaacaacttctcctcccacaactttctccatctcagataaaggtagtattatccctctttcccttttttttctcaagtttgtgcctgactaattgaactggaaactccctcacctctgcctaactatgtctagcatttgcctgtctgtatttcatcaccctagtagggccccttgtttcttctccctgttccactctatgtatatgaaacataaggatttgtggaaggtgtaatgtttccaaatgtattaacattgtactttggagattgcagacatcagtagagtgagggagctcggtggggcagttagagcaagtatataattgaaaatcagccaggtgtgtgcttaaatgtttctttgtgaaatgaagtagtagtgacctgaaataataactttaccagagttatgaactctgaaggtatgtgtgtcatgtatgtgggcatatgtgtgtgtgtattctgaattctgatttcttgcagagtaaaaccatgtgctagaagttcccttaacccagtgtgaagccttgggaccaaacataaacctgacagtttgtttgactggctgcaggcagcattttcaacatctgaaatgatttaacacgatctctactccctggtgttgatgcaatgggtacttgtgttgatttatggagccattgtgttgttacataatctgacttgagagctgatgagtgtgatactgttttattagtgtacaatctggttcttttcacttttgaggtggttttgtattcaatatttacgtttaaagaggaaagtttccttttcaggtggggcttgttgctttcattttgcagaagcacaaattggatcctgcatgtcaaaatttggtatgtgaattgtctcccacattgtctcccacttagggtggagcagttgatcttctgacgtggctaacttgatcatttgtatgaggaaaaaacggaatccaattatctttgataacttcaagaaccatatttataatttccattcaactttataaagtattaaggcccaattctctggattagtagataattctctctctctctctttctctctctctctatctatctatctctccctccacccctccctctctctctcccttcttccttccctccctccctctctctcttgtctatttatccctctctccctctccctccccctctctctgtatgcatgggagttatggatatggggctgtgtacacttggaggccagaagtcaacactgggtgtctctcttgatctctttacacgatatttactaccccagggcttcctcactgaatctgaagctcacttgttgatcaggttgattgtccagtaaactccatgttttgtctgtctctgcctcccagtgctggggttatagatattttctaccatatctaaattttttgtggatactagatatctgagcttagggcctcatgcttgcatggcagacattttaccaactgaaccatcccccaagcccctatccatgtatgtttaataagtaacacttaaagattacatgtcagtggaaaaagccctctaccaaccctgaaacaaagaaatagtgaaggcaggcttggtagtatgcacctttatcctggcacttgggagactgaggcagtataattgaaaagtcaaggctcacctgatgtccttagtcagttccagtcagccaaactagccagccaaacaaaagccagggcatattgttattcttgctcctcctcttaagatataagagggaccccacataatactaaaacatagatatacctgtgaataatttgtgtaatgtaccatttaactgaaatatttacagatgaaatgatgtagagaagacaagattggtgatgagttgatattttttgaacttctggccccccagcctctgcctttcaaatgctaggattacaggcttataccatctagctcatgagttgatagtaattgaaagcaagtgacacatacatgggagtttgatgtatgctccatttttgtgtatgttacaaattttatttaatagagattacaggaaagggaacttttgccaaaatgtttccattaaaattatgcttagttagaatatgttcgtagggcctggagagatggctcagcagtttagagcacttgttggtgagtcactcagatgattactctacatcaaacacttaggtaaaggaggggtgggtgtgatacaattgtcggtaagttgcagagatttgggtgaggcccaggacctcacttggtatggctttctatatagaatagtcatcgctttctgtgccaacttagtccatgtttggactctaaaggcatgactagtctcggctcctctaatcatctgggaaccagtctttttagactggttggaaaagatatctcgaagcattgtggtttgacaggttggtcatatataatgtttcttacagagaatcctgtcaggaacttttttcctatgccttcctggtttagttgatttctcttagtgacttctgacatctctttcttgaaaggattttgttattgttgttgttgttgttattttttactagtttttatttgtggcagtctctgtttttaactcctgtcaacatgaatcttatttatagaattacagtcactcgaattaatgccttttatggtatcaacattgaaacatttgcctgtggcagagaattaaaatttaaattgtatgtaaatggaaatttgcaaatcaattgtttcaatctgccaaattgtagttaagagaattttaatattttcattcatatctctgatagtctttttatccattctagtaaaaattcattaaacttcatagtagaattaaaccagataagtaacaagtgacagtcttagctgaatacagtattcatgtctgtattcccagaatactagagactgaggtgggtgaccactgcaaattcaaggccagcttggtctatataatttccagtgctatctaatgctacatagcaaaatcatatttcaaacaaacaaacaaacaacaaaagtaatagtctctattgtaaataagagatctggggccaagaagattgctcagcaggtaaaattacctgccatcaagcttagtgacccaggtttggtccccaggatccccaaggtggaaggacaaaacttactcccaccagctgtcccctgacctctatacaatgctacggcacttgtatgtatgtatatgtgtatatatatatatatatatatacatacacacacacacacacacacacacacacacacacacaaaatgttctctctttcccctctctctctcttgattaaaaattttaaaagaagaaatctccatgcttgttagttccttttctattgctgtgacaagacaccacaaccaagtcaacttacataagaaagagtttatttagggcttaaagtttagagggaaaatccttcagcatccttttggggaaggtgacagcagtcagccagacatggtgctgggtactagctgggagtttacattttgatcctcaagcaggaaacagagcaagctaactggaaatgatgtgtgtttttgaaacctcaaagcctatcccaagtgacacaactcctccaacaatgccacacctcctaatcctttctacacagttttaccaactggggaccaaggattcaaatatatgagtctataaggacttttgtcattcaaacaatcataatctccaatcctttgaagagaaataagctctggtgaggcccaggagctaatatattctttggctaataaaacacaactgggtaagatttaaaaaaaaactcatctaagacttagattattgaatattcctcagttggatggaaagatatgattatatgacatctttagagtgattgcaaactctgtggctttcaatgagcagatggtattatgatgcttactggttaagtgaaacatatgggattgttagacttcagtttatttattcccattgtatccatgtttccttgtctaggaaaaggaaaggggggttggtaaggaatgggaaacaatgttacagtttttaaaagattattattatttaagtgtgtgtgtgcctgtgtgtgcaagcaagccatgttccctgtgtgagtgcagttgcccttggaagtcagaagagcatatcagatcctctggaggtggagtgacatgtggttgtagggcacctgataaagggcataaaactctggtcctctggaagaacaatatgtgctcttaagtactgagccatctctctctcccgagggttatttttttgacaggttggatgttttctgctatttatgtatgctcgacgtgtactttgtgaaacactcagcctaatgtattttccaagaaatctttaaccgcagccagatcattaccaagagccacagtctcaggagctcttactattgtatttctacagactggagctagagcccagcgtgcagaaagccgaggcttcgatcctcagcactgtgtaaaccagctgtgttcctgcatggttagaagtcaattacctggaggtggaggctatagggtacacagttcaagatcaccctcagctacatagtgagtttaaagtcaaagtgtacacacacacacacacacacacacacacacatacgctattaaacagccaggtcagataggacaggttcaaatcctaactctgcttccttagaaggcaagttagtgactcagagctttctgttcctcatctttaaaattagaataacaagatgatttgtcacttacgggtagcacgaggattaagtaaatgtgtataatgattagaaaagtacttatcatataataatcacgtagttaaggttcttttttactagaaaggaatagttaccttttccaggaccattgcagagagagagatttcatgtagtgtataaattcatttgccatgtgtcttcttcagtcttattttaaagtagtctcactgtgtagctctggttggtttggaactcaatctgtagaccaggttagctcccagctcccagcaatctgcttttctctacttccccgtgtgctagggtgaaaaggcaaatgcctccttgcctagcttccacctcagttgttgggccagggtctcacactgaacccggagctgatcagtttggttagactggctggccaatgggttttcgggatctctctgcctgtacctccccagcaccaggattataggttcaccttgctgtgcctggttctacctgagtgctaggaattcctcttgtttgcatggcgaacactttagcaacagagccatctctccagcctgacatttttttttaaatcttgattatggaagatttgaaactccaaaaagtagactcgaattttgctatatttgtggcaactgtttgtttcatattaccaagtcttaaatgtcagccactagaatgtaaatgccataatttgggaccttgtctgcattagtcaccactctatttacaattccttgaaaaaaaattgttaaaactactatgtatcattggtcttcagtaaatgtttgttgacaagataagtgaagaccctcttttgtcttaatccagttagaactctaaagctcactgtgctcctgctgggcttgtggtgtagctgaaaattccctttccatttattcattaattgcctcaggtattcatttactgaagcatcaccaaatttcttgtacagatcatcagtggcaccctgagatttctctatgactgactgactgaatgggtgacaatccacatcaaaagcaatcagctgagtggtatatgcagatcagtggttctcaacctgtggatatcctatcccgcacatatcatatcctgtatatctgatatttatattatgattcataaacattagcaaaattatagtaatgaagtatcaatgaaaataaatttctggttggagaagctcaccacaacatggcaaattgtattgaagaatcacagcattatgaaagtggagaaacaattgacctagatgttgtagttatagattaggtatagagtggttttccttgtttgtttgcccggatgattattgattaggagtcaggtagatatgatctaggtaattggtatttaacacttcttaccaaagtcatactttggctcagtcattatttctaggtttctcatctgataccatggattgtctcaaaaccttttatttatgttttgtttgagacaggctaccatggaccctaggctcatttctaacccactatgtaggtggggatgataatgaactgttgatgctcctgtttctaccttccaacttctgggattacaggcatatacctccatgcctgggtagattgtcccttgatctgagaaacttgtatatataaaggaccatataaggcagggagaaggactagcagagttgtgtccatagttgctgtgagaatcgggcagaagggaatttcctgggatgctgaaaagtaagggagtatctaaagatattttcaaggaaaagagtgttcaaaaatgatgggaagtcacaggattgacggtatgtgtgtggatcgggagaaagcatgattacaatgaaggggcaaataggtagattgggccggagctcagggagggtcaggttgtgatggtggtaggcagctggtgcctctttccacaggagtttgccagtctgctttccctgggtgggctggcatgttggtggaggagttcagttgtgcactttagagagataactagggaggtgcctgagaatgtggactagagattgaagaggaagtagctggcagagttgccagcccagggctctgtggttgatgactaattggccaggcaccaggagcttctagtagctcctggaaaggggcagatgggcccacctcatgcacacacttgcagccaggctgccattggcacggttggcagcagaattgacagatgagccaaattttctttcaaagaaaattgttctgtgtgtttggggaaccagaaagccaagagtcagcattctattgtctttgctcatagatgaactagccatgggggtggggagcgggggataagttaggagggtattgtttaaatacatttgcatttgtgtatgcacccatataattgtgtatatgtataaataacacctatgcatttcaacaaattcatcttcccaattagtttttttttgttatcgttgttattttgaaataagttgtcatgttgcccaggttggattcagactcactatgagtccaggctagccctgaactcctataatcctcctgcctcactctccaaatgctgagactataggtgtgtggtgttgtgcacacctacctgccctaattagtatttatctatttaaatcctttgatactgggtctcatgtagcccacagtgacctatagctcactatgaagctatagatggccttgaactcctcagcttcctgtctgttttctaagtactgcaattacagacttatgccaccatgtccgccttttaatttgttgcttttctaattagtttttaaattagctcttcatgtagaataattttaggtttacagagaggtggtaaagtaataccggaatttctacataccccatgcagagctctcacaattgttagcagcttctattcatattatatctgttgcaatgtataagccaatgccactaggtggttattaattaaagccctaactttattcaggtaccctgtttttattagtagtattatttttttaattaggtattttcttcattttcatttccaatgctaccccaaaaatcctccaaccatcccactcccctctccccccactcccacttcttggccctggcattcccctgtactgaggcatataaaattttcaagaccaatgggcctctctttccactgatggccgactaggtcatcttctgatacatatgcagctagagacaggagctctggggggtactggttagttcatattgttccacctatagggttacagaccccttaaggtacccttagtttttattcattgtcccttttctttaattttagggtgtcattcaggattctgcattgtatttaatcaccctaactcctaagattcctcctgttttggtgaccttagcaattttgagttttgtagaatgttcaattggccatttgtctgaaggttttctcatgatggaggctcattcatgtgacatcagatgcggagggctcatgatatcaaagtaacttcattttcaatgttgactttggtcaccttgactgaggtgagcttggacagttttgtcccctgggaaggttccttgtcttgttttatttcattctgccttctttccattctaaactcttttggaagaagtcactctgaaaacccaatggggagttatgctgtactttactgggggaggagagtctaaagaaatgaattgaaatccctctgggcagccaggtctgttctttctcatcctaattaggttttgataaggtgatttcttatctgcattccaaatgctaattccctagcacttgcatcacatctgtcattcacacccagaagtagcccccacctttgttttaggtatgtagtatataaacagatctgtgtcatatttactcagattatacctttcttgaggactgaggcggcatctcatttaaagggttggccacagtgcaggcagttagtaagtacagactatattatttttaagttagtttaattaaaagacttaaaaattagccatggttcataactaactgcacaggacatcaaggtctaagaatacaagaaacatggcaagaaaaagatactgttgatttgtgaagtcctgaactggtaatagtagctaatatggtacttcctgtgtgccagattcttctgtaagcatttggtcttctgtacatcatttagtcgcctagacaaccaagtaggtctgtggctacggtgatgactcttttgcggttcttgaaattgaacctagaaccttgcacatgcgctgtcccattagtcccattttatagataagggaattaaggtgaacaaaatttaatttgttcaagattatatagcttgggaatgacctacttgtaacctttatatcatgttctggctccagagttttgaaccctttatcactggactctgaagtcattaaaatggtgattcatatggtttctcatttaggggggaacaagattgatgtttaaatacttcattccagactgttgggatatttctgatgacatgatgtatcccgaggggaacgtagccataaagtcagtgctatttcccctttagggtttttttttttttaaatttttgtgtagtatgactaattttatttctgtaaaagtgtttgtactttttgtaacacaccatattttatatatccccaactccccaggcatataatctgttgaaagatagttttttatttcccctctggcatttaaaacacacacacacacacacacacacacacacacacacacatacagatactacacacacaagtggtcactgggtcttgccaacaaatactctcagttagttccttgtccgtgtgtgtggtcacacctttgggcactgggaggcaacctatattacggcagggatgtaggcgagggaggaggacttctggagaagccacccaagctatgattcggccccagcttcctgaaccataaacaaatgcaagctttgttctccctattcctcatttggtcccaagtatgactcaggattaggctgggtcctcaggctccgcgcctttggctgtttgaaggaagtgggaggatttcagggtagttctgggacctttacaaactgaagagacgaagctggctgcaagatgggagaagaggtatttctttcttttttcctttagagaagaaatagagcctttaaatttttatcttatctatagcattttatagaggccttgatctgtatttacatggggtgttaaaatgatgatgtttgggctagctggaatcccacagcggagggggggtcactcttggatgtattcagaaagaacctttcccatggaagggtggttttctaaattcgaatgttctactggagctatctagcttgtttttgacgcccccccccccatcccaccccaaggctttggtccatttggccattaatttttacagatgtttccaatttctttgttccttagttttcatgtgctcatacagcagagagtaatttagatgggcagtctgcacaagcagtaactaactgttacaccatgtcacagagatgtttagcaattacagatgtttgtgcagtcaacaaatctagcttgctcttcaggttagtttaggagaaaagaacatctccccagaacaagccagctgtggagcattgcacccccgggggtggggttcacaaacatttggagtcttccttgtgaatgaagaaactgtgagtagtgcttttagagatgaagagccctgctttcttctgtagggctgagcatttatatgtgtgtactcacatagaggaagcttggattacttgcttttctaaaagttaaactaaggtggtcatgtttctctgagtcctttattatttgtcttcctaaaagcagaagtctgttattttccagacacaaaataaaattccctaaagaaaccacaggataagtaaaggcttatgattattgtgtgtcttctgtgtccctgtgtgtctcactgaaagaaaaaaaaagaaattagggaagagacgaagtctgcaaaatatgatcctttatatcttttctattggctttaacttaaattttttgaaacgttcttttaaagggaaaataatgtggcaagaatgaagctagttgtctcagcacattatttaagagtacaagagtcttttgaaagttttcgttttctttgaacagcatctgttggcttgcttaggaagactgccagatatatgagagagcttcaggtattgaggagaataaagttaatttgtagtagcttgggaggatccactagggaaagctgtctgaaattgtctggtcttctatatggaatttttctaagttcatttgttgttaattttctcagatcctaaagctaagtaatgggcttcctcttggcctcttcatatgtttatgtcattatgctttgttcttggtggttccattgccctcttcttctttcctggtccttctataccttttgacttgtaaaggaagaacccagacttagttgtttaacttagccccaggaaatggtgagagccctttaagttgtaaagtactgactgggaagactgagcaatttgcagtccattgggagcttatctggccctctggcaaggccctagagatgacaaagttagggtaacctgctgaccctaacccttctgtcttgtttttaaggagataagctacctcactgtaggagagtgctttctgagtccatctgtctatcaaaaactaaatagcactgttgcttctctcatgtcaagaattctttgtagtattgataatagttaaaaatactagctcacggttgaagtatatgaagaactagagactgttcttagtctcttattggagaaattataattaacagtttttatgtgtatttttccagatttttttttctgagcctgaatatgcatgtagggtacaatcatttgctattcttacaataacaggggtatagtacatgcttcctgtcttgaaaacttaatttttttgtttttgtttttctttgttcggtttttccaagacagggtttcactttgtagccctgcctgtcctagagttcactctgtagaccaggctggccttgcacacagagatccgactgcctctgcctccatgtgcactgacttgctgtttggaaaatttaatatgccatggctcacttttttcctgttagataactacaccgtatttttaaggtataaccattaaaaataaccatcagaagaatacaaaataccatttattgaactagacttcacttgataactgtttagattgtttttttgtttaataactttccatacccttaatattaaaaactaagtattttcttaggctctgcatgatggctcacatctgcagtcccagcactcaggaggtttaagcaggagaatttccatacatttgaatccactttgggctacatagttccaagtcagcctaagctacaagttctcatctcaaacaaacaaacaaaaatccaataatgttacacacacacacacatgcattctcctgtattctgggattatgaatttgccatgcctgactcctttttttcccccacttttttttattagctattttcttcatttacattccaaatgctatcccaaaagtcccctataccccttcccccacctcctgcttccctacccactcactcccacttcttggccctggtgttcccctgtactggggcatataaagtttgctagaccaaggggcctcttttcccaatgatggccaactaggccatcttctgctacatatgcagctagagacacgagctctgtcgggtactggttagttcatattgttgttccacctatagggttgcagacccctttagctccttgggtactttctctagctcctatattgggggccctgtgttctatcctatagatgactatgagcatccacttctatatttgccaggcactggcaaagcctcacgagagacagctatatcagggtcctttcagcaaaatcttgctggcataggcaatagtgtctgcatttggtggctgattatgggatggacccccaggtgggacagtctctggatggtccatccttttgtcttagctccaaactgtctctgcaactccttccatgcatattttattccgtattttagggaggaatgaagtatccacgcgttggtcttccttcttgattttcttgtgttttggaagttgtatcttgggtattctaggtttctgggataatacccacttatcagtgagtaccatgcttggctccttaagctgaattttgaaaggagaaatttccagttttaatgactgatctgacattaattttgttctaaaggaaaataacctgaaaatattgtttcttgactacctgtggaataaaaagttcagtttttgtaatccttcatacttagcgtaacttcttagtggaaataaccctgaaaagcttttgccaactgagtgtggtagtagacacctgtaatcccagcattgcacaggcaaaggcaggaaggatctccataaattcaaggtaagtctggtctctgtggtgagttccagaccagcctgagctacagagataaactgtgtctcaaacacagagcaaaaccaaactaaaaatcccaacgacttcagagtgttctataaagcaattgtggcattaattccgttcatggcatcaggcttccagcccactattagtctctagagtgtttacatgctgccaaactcgtcccataaaaaacaccctcccctaaactgttgggaaactccgttcggctgtctttatgaatttatttgctggattttgtgatgattctaatgctaaagtattgaggaactttcatggtgctttccacagaggaggtaccaccttccgttctcaccagccatccacatggttctgggttttccacatcctcacttgtccatactactttctgcttctgttttgattttgatggcctttatcctacaaatgtcaggtgtttaacatgtgtctgtttgccatcatgagaagaaaaggacaacactttcttttcatctaataattggagagttaaagggtcagggaaaaggtcttctgcctcgaagttatcattaaccagctgtttgcacaactgcaaaagactgcagagtgcttgaaggaagaacctgtcttccacactccctgaagaaacacaaaggtagtagtatccaagtacttggctgaattcctgcttttcatgtagtttagctccctcactttgaaggttaaaatttcttctgtattcttttgttaattctaagtgatttcctctgtggaaaaagttagctatatggttgatttttctcttgttttctattatatagaattgctcaggaataagaaacagcagtccttccttttttataaagtattggttgaattatttatatatgctgattgatgtttttcaataggatgtacagaactattggtaaatattctgtcttctttgttctttactgacactaatgattttttatagtatttattcttgaggttggtagttgcttttgatattcaacgtcatgcacttgtctggctgtcgattgaaatgatcatactttttatttaacctgatttttaaaaatattctcgactagttgtaaaataagattctgaccaactgggactcagtagatgaaatatatccaatgctataaaaaaaaagagagagagggagaaagaaagaaaacccagcattctattccactgactttagctgaattgtgttgtgttttctcacaacaaatgttttaacaaatgtaaattgcagagttcagttactcagcaacttgtcttatatttctttgtggcattgaagcccatttaattggtacaaatttttttccttagctcaggctctccatgttgaaagccagatcctcaaataaatgtgtgctccagccatgaatagcagcataagctgctattctatacttctgtacttccaataggcactccacagtcaactttaaaaaataacaattcatcaacaactcatgcaccagaatttctgtaaatggctcccttttatcaaaaaggtcatccttaaagctatttaatgaggcctatgagtctgaagtgtttcctccattaaacttctccttgcacttgtagaaacccaacagtcacagtttgggaatgtgaaggcagaaaactgaggtctgtatcgcttcaaagttgtagttctgctttgttcatgtatgaacaaaggaatgaggaacttagaggtggaaaggacgcatttactccttgtttttcttattctttcactagccaagcattttcattcaccagtgattttaatgttttgctccatttgttttggtagcatctgtttggtctgttctttttattttgccttcttagtcagggctattttcactttccaacaggaaacaacttctcttgggtgccttttctaggctatgactaaaagctgataatcaatgaagtgatgatgctaaaggtatcatggttttaggtcctagagaagttcacagatttcttctaggcacaatacttaatctctgtctagctcctgcactggaagagccagctgccccatatgcctcacatatctgattttataatgaatttattttgcttctaacctatcaacccctttacttttaagcatcattagaagcagagaaaaaagagttcaaaagaggtttttgtgacctttagtcataaattgttatgcccaagagggcaggagttgtctgggtagagatgaaaagaggttttaagaaagttgggtggctgagagaggcatctaggtcatgagtggatcactaagtttctaagtattataataaaaaatggcttcatgggctctaaagcagtgtgtaagcaaactttgaattttgtctgtcccaactctgtgaaatcttatggtagttgaccttgccatggaattgagttgatgacaaagaggccagatagattctgaggagctatgagacaggcagtaaataaaaacttgggattttttttttcaaagatttcttgagatttatatattttattttatgtctgtgagtattttacctgcatgtgtatatgcatcatatttgtgcctgttacctatagatggcatcagatgccctggaactggagttctggatggctgtgagccacacatatgtgctggaaactgaacctgggtccaacataagaggagcaagtgctcttaactactgagccatctctccagccccaatgaaaactagcttcaaccaaatactaggtatcaagagttatggacaaaacttagtcattacagcaaagagagttggctaagcaatgtctatgaggaaattagacttcccagagcttgatactggtccctgattccactaatggcagaaaaagaaaccctgtaattcgaaccatggtgatcaggctagtggtgagggttaataaactcactttgttgtgctatggggataaggatgtagaaagttcgctgaaaatccctgtaaaattgggattaatctcatctgccagaatcatactaaatataatagaataacccagaagtgatgaatctattgttcattcaaaaagtatcattcctggtcattgtcctcttttgtcaccgttttccatgaatctgtattgtgtttgccctgtgaggagcctatagcacgtctttgtgaaaggcacaaagaggaattgctgctctgggagcacacaagcaaacattgaagcaagcattctccattgtgacagaaaaggacagggaatcagtgaagaagagaaaacacatcaatggacatattttactagatacattgtcttgtcttttgatcctttaaaaatgttccttaaaaagtaacagaacccaacatgttggtccatgcttgtgatcccagtagcagacctcacggtcatcctctaccacatagctagtttaaggccaacctgggctacatgagaccccatctccaaaggaaaaaacatagtgatgcatatttttaattctagtactcatgaagcagaggcaggtagatctctgaatttgagggcatcccaatctacagtgagttccatgctagctgactacacaatgagagtctgtctaaaaattaaaataaaaaccaaatttaaaagtagcatagccagctgagaaaagcacgtgtgtaaaattagtgatttcatgttttcttcattcatgtgttgtgtggtttggtgtttttgtatatgttatagataaagaagggagagagggggaaacattttagcacaggagaattaaaacttgcaaaacgagtggtaaaacatttaccatttgctcatatggtaaggatctaatttgcttaaaactcaggcttcttagcatttacagctttaagagatctgtcttctccctcctcatatttgctgttaaattgatgttaaatggatgaaatgatgaatgaatgtgaaaaacagtcaaacatggatcatattaaacttctgttctataagaccagaaacaacaaaagaaacatctttattaaagtgcatttacggggctcggaagatggctcagtgcgtaagctcacttattgtggagttcaaattcctagtacccacataaaacccgtgcatggctgcacatgtctgtaattccagcctcagagggagaagataggctgaccctgggacctagctgcacagccagtctagccaaaacagcaagcttcagggacagtgaaagaccttgccattgcatacactagcaagattttgctgaaaggacccagatagagctgtctcttgtaagactatgccagggcctagcaaacacataagtggatgctcacagtcagctattggatagatcacagggcccccaatggaggagctagagaaagtacccaaggagctaaagagatctgcaaccctataggtggaacaacattatgaactaaccagtaccccggagctcttgactctagctgcatatgtatcaaaagatggcctagtcggccatcattggaaagagaggcccattggtcttgcaagctttatatgccccagtacaggggaacgccagggccaaaaagtgggagtgggtgggtaggggagtggggggcagggtatgggggacttttgggatagcattggaaatgtaaatgaggaaaatacctaataaaaatatttaaaaaaaaacaatagccaggtggggcaacacaagcctttctttactcccagttctatggaggtaaaggcagaggcaggcagatctctgatttcaaggccagcctggtttacagagtgagttcgaggctagccagaactacacagagaaatcctgtctcaaaacaaacaaacaaaaatgtagagagaactaaaggaatactctcacctcctcctctggcctctggtttcacatgtatgtaatgtatgtatatatacatatgctatataactatatacctaaaatatttttaaaagtaacatgcaatatatatgtaaaatgtgtatttattagagtctggagaggtggctgagttgatggagaacttgccacaagagtatgaggacttcaccatgcttgtttggggggtggggggtttagcttggtggtatgatccaacagtcctagcattcactgtaccactgggcaagtggagacaggatatctgaagcttactagtaagctagtattgcctattctacatactccaggtttagggagagaccccaccttaaaaaaaaaaactaaataattgggttggagagatgactcagcagttaagagcactgactgttcttctgaaggtcctgagttcaaactccaacaaccacatggtggctcaggcgccctcttctggtgtgtctgaagatagctacagtgtacttacatataataataaataaatctttgggccagagtgagcagggcccgagcaagcggggtggggcagagcgagtagggcaggagtaagcagaggtcttgagttcaattcccagcaaccacatgatgactcacaaccatctgtacagctacagtacactcatatatatatatataataaatcttaaaaaaaaaacctaaatgattaaaggtagagagccctagaagatatatgacatcaacctctggttgccacatatacttgcatatatgtgtacatgttcccaaatacagtcattcaaacacacacagtcataagcatacatacattgcatgtgcatgtgtgcacacactttttaagaagaaaaaaaatgtatctattcaaactgttttcacctctaggtagaatcctattttagtgtaaatcagtcttgtttttttttaaagcacaagatcatgttaattaattggaaatgtttccttttttgtttgtttgtttgtttgtttgtttgtttttgagacagggtttctctatgtagccctggctgtcctggaactcactttgtagaccaggctggcctcgaactcagaaatccgcctgcctctgcctccccagtgctgggattaaaggcgtgcgccaccaccacccggcttggaaatgtttcttaaagaaatgaaaatgtctatgaaatctatgtaatgtaaaaattaggatattcctcaataaatagccacttctaattttttgaatgatttatttttatttcatgtgcatctatgttttgcctgcatttgtgtctatgtgaagtgactggatcttctgaaactggagttacaggcagttataagctgccgtgtgggtactggggattgaacccaggtcctctggaagaacaaccactgctcttaacttctgagccatcccttcagcccacaatagctacttctaacagtagtaggtaatcctgtatttaatcatatttgtcatcacttggagccatatttctttaaagaccagaaataatctgtaagagttgtcttttttagaaagattaaaattttatttttatttcatgtgtattaatgttttgcattattaatgtttaatgatgtcttaatgcatattaatatatgtgtgcctggtggcagtggaggtcagagtggggctctagaacccctggaagaggagttacaaattattaagcgctactatgtgggtgctgggaatcgaacccaggatgtctggaagtgttcgtaaccactgagccatccctgtaagcatggtctttgattatacacagagtccttttctgaaatacatataaggaattcgtgactttatttagatgaataagaaacccattcttggcatcgaaaacgtgttaaaatgtcccaatatttggaacaacattaattagaaatgagtctacattatgcacttagttactaaagataggagtcagtgaagaactgtaagtgaaggatatgacaaatgcccgagtgttttctatatgggtggcgccttgcaatttaccatcatgattcattttccatctgacgctctcagcatgcttactaatggcttggaaggaaagtgaaacacagatgaaagcttcacgggactactaggtaggaggagttggaaatcaaatcagaccttcaagagagacatcagtaatgtggggagggagattgtaatttttagccattttaacgcatgcttttgtacctctcaaaacgtcatttttctgattataaaatgatttttgaaatactagaaaataaggaaacaaaaagcactgataattttacttccccagggcatctactgttaactgtttttaaatattagctttcagttgtttggtcatactttttttaaaagactttttatttattttatgtgtgagtacattgttgctgtcttcagacatgacatcagatcccattacagatggttgtgagccactatgtggttgttgggaattgaactcagggcctctggaagagcagtcagtgctcttaactgctgagccatctctccaacccttggtcatacatttttaactggttgagatcatatcagacacaattgtctccacacacaagaatatttttttaaaattttatttatttgtttagcaatctataaaatttcacacatcactacaaccttctagaaatgtccctttaactgctggggagcccaattggtttccttcttgtggtggaactgggtgttgaacttttgtggttcaactggggcttgaacccgagatgagcccaggaccttacacacactaagcaggggctgtaccagcaagccctaccctcaccccccaagctcctgtttgaaaactttaaaaaaattccactcatagctcggcagtggtggtatacacctttaatcccagcacttgggagggatgcaaagacagatggatctctgtgggtttgaggccagcttggtctacagagaaagttccaggacagcctgggctacatagagaaaccctgtctcaaaaaaacgaaaagaaagaaagaaagaaagaaagaaagaaagaaagaaagaaagaaagaaagaaagaaagaaaagaaagaacatttatttattttattttgtattcacacgttcatgttctttctttctttccctcccctattgtgtgttagagagagtgggggtatgcttggcatagcatgtgtgtggagatcagaagacaacttgaaggagtatgttctctccttctagcatgtaaaactcatgtggtcaggtttggtcacactggccttcaaggttctgttttaaggctgtagatccatcaatgttatattgacattttctacattacaagtcaggataaaatgcttccttgacaacaatcagggcctggtgagttacacagtagtctgcattgcttaaaagctttgttgagtttctgatatcctgcatacgatctggaaagtgttccagcactttctagctgatgccctctctgtctctctctgtctcatgtgtgtgtatatgtgtgcgtgcatttgcgcgtgtgtgcgcatgtgtttatacacatgcatgtgtgcacatgtagatgacttgctggagtcagtcctctccttccactatatgtgtcttggaggtggaactcagtcatcagtcatcaggaatggcagcagacagctttaccactgagctatctcaccagcctcctcgataatcttgaaagaagcctttcagtgtggcttttggcgtgaggcatggccaatccaggtagaggattatgaattcaagggtttgtgttaagtatctgctagtagtttccaagtggctttaaaaatctgtacgatgtgagtgtgtggtctcatttggcccgttaccttgggaggagtatctgtttggtccagtaatttagaatttcctcatccattacagaatgggtgccaaactttgaaaaagatcgcttgggatagttttctatggtggtgtgtttgctcctgagtaccaaaactctcaataaaaggctttctgttctcagacaacaggccgttttccccagacacacgccttgttgttttcccatcatcaacagtagataacagtttggatgcagccagaagcagctggcatggacacacacttggagggtcctctgggatgttgttctgagcactcactggaggggccacctttattgacaggaattgtctgtgggttgtgggctttgacccacctcagttcctctctcctgtactaatctcccagcagcagctctgtaccaatagatactacttttaatcccttcccagcatccagatttatccgtgtcctctaggcttgtctttgctctgtggctgtcttctaaaagctgttttctaacccccaagcaaaggaacgggtggctagcctactatgagaaaaaactgtctaatagagcactctttcaaagttgaattcacataaaggtattctgatgattggtttttccatttttcatgtgtgtgtgtctatatgtataaacatatttgtatgaacgtatttgtgcacatgtgtgaacatgcatgtagaagcccgaggctgctgttgggaatcatcttctattgatctttaatttcttcattgaggcagtgtctctcaaacaaactacctcaccaatatggttagtcttactaggaggcttgctctggggaccactatctgccccttctgagactagtactgccagctttccaggcatttaatgtgggtttctgggatcagaacttaagtctttgaacttgtgtggcaagctgtttagctcttgagcagtctgtatggccagactgagtttttaattcagcaaaatctaaccataagcacgttacacacctgtcattgtatccttctagaaaaatccataacatttttatcattggcttcgttttaaaagaggaaactggcacatggagaagtgaagtaatttgcccaagatcacatagccagtgaagttgcttttagagaccatttctcctcagtataaaacttaccactagatgccaaaagaaaggattggtttatttgtttcattattatgtccctaacaccactttatgactattttctgatggatggtaaatggctgtttgacaaaggtattaattatattaagcttatctaatgcctggggcacttggaaggatttagggttgcccagggcagccctcccccatcatgtcatcatcctagttaatgaaacaaacagaaagaagtagtcagaaagccaaggttgtgaacaatgagagctcctcaggcatgggagggcacttctgtctttgccacctaagacattttcctgggaaggcacaaaatatgggtttgatttgccccgttgttgaatatgtcctgttcacttatgactagaatgcccagattttaagttaagtcgacctctctttacagaaccttcatttttcttgactatttattttgatgtttcttctatttttatttgtatttaattatgtgtataggcattttgccttcttgtatgtatatgcaccaatgtgtgcctggcacctacagagaccagaagatattggatcctctgaaactggaattacagatgttttaagccaccttgtaggtgctgggaatccaacctgggtcctttggaagagcagccactattgctctttactgctgaaccatatctccagtaccttgttatttttaatgacttactttactgtgtttaagtgtgtgtgtgtgtgtgtgtgtgtgtgtgtgtgtgcgcagcacatgcatgtaactactggtacctgtgaggcattagatacccttggggctatacttattgggagttaccagatatcagttctgggaatcaaactcaggtcctcttacaagagcagtgtacacttttagttgatgagccttctctacacccccagtgtttcttttaactctgtgtagctctagctagccccaagcttaccatcctcctccatcaacctcccaaatgttagaattgcagacatgtttccaacatgccccactgggatttctattcttgagatatattgaagtcaccttcctaagtatgctactatgtacacagaagacatgtccgttgtgtacatccccaccaggaaactcccattttcaatccatatatgacctaaattcatttttcatagtacaaagcaatatctaaaaataataccagaaaggcttttaaaatattttgtgtgtctacatgattgtgcatgggtgtcttgagaccaggggtctagttcctgtgttgtttcttaggattgatgttcaccttgctttcgaggcagcatttcagagggatgtggagcttactgattaaacaagactggctggccagtgagcccctggttttctgcctccccagtactgggattacaagtgtgcacaaccccaccaggctttctctgtgagctctgagggtcgacctcagggtctcctgcttacacaacaagcactttagggattgcgctacgtcctcagtcctcaaacaagtctacatgtatcccctctgcccttctgtaagttaggggagcccatatgatttttaaaacgtgcattattctttagcactagtgtagctagtgatgtaagtaacgaatgaatcttacagcattaaggccagcactactttaatattagccagatttgaagaagggcttcatggaatcagtaaattatcttttatagagctatttcacctaagactgaggcagatatagataacatagataagaagatagcttggattgtgctttaatgttaggcttggactcctagctccacagaataaatagaattagacaatgtagtcatcctttgatatttaggtgggattgtttataggaattgccccctaatggaaaaaaatctatgatgttcatctcatatataaaatataaatagttgttatactgcattgtttagcaactgatgacaagaagaaggtctgatgatttaacacagaggcagtacctttcccaagtatgttaactctgaagcatttgtatctatggatgtagactccacagacacagcagagtttcccctccctccctccctccctccctccctccctccctccctccctccctcctctatcccccgttttctagttttttatgactggcttaattcacctagtataataaccaccagaatcattcatgttatggtagcagaattgcctttttaaggctcaatagtgctctactccatactctaggctctttttctttttcttttccttttttttctttttctttttctttttcaagattgtggttctacttgaaaacaatgcagcaaatcatggctctaagtgtgatttgtttttggactgaggctgcttcattttccttctgtgctctgaagaacagaaagctttctggaaatacattctgggaaaaaaattttggagtcaaacttgattaaacaatttactttaaatttgtcagatgaaaacgatggtgttcttctatctgtcaagagcttctcatgtgtctatatggtttttttaatgtcttagttttcaaatgggagattgactggtgttttcacaagaagtgaaacgctcagagctattacagacctattattttgccactaagtcttggcactagcagcagagcacagaaaaatacaacttctctgaccctttccatcaggtccccgaaccctgggtctcatctctctgaccaactcctctgagtgggaacttaactgttgtcgttttgcatatggttggcactccagatatgcatacacatagactcaagaccatcacaacatcggaaatgtttcggccatagttgtaccagtttgcagtcactgtttttgtgcctgtagctgctgtgagctgtagccaggcaagcatggtttcagggctttaagcagaggacagtgttgcttcgccaccgtctctttactttagccttttgtttcttcatcatttttcatcgttcttaacaccccaaattggattatcacacctctctttacttttcctagtgaccagatgtcttaagaataagccacacactactataacagtggctctaacttacctagctggcttgtgggcctaaagctactctctctccttcttagtgtgtgtgcttccgcccacatcacattgtgaacatctgctcatgactcaagtgagtctcctgcctcagtcttttgagtatacccactacacccaacccctgcatccagttttgccttatttccttgctttttattcaactaaaacaccctttctactacattcttaggccacctcccactctttctgaatttagcacaagcctcactgctgccatctttgaggcttatttcctcatgtagattggctaacaactattttcccctctatctgtacatgcctttattgtaccatctatctctttgcactatgtgatgtgtatctaatgaaccggaccctactgctaatctcaaacttattgatgatctaggactctgatttctgattttttcatgtttgtatatgtaatagccagaatagaattcactaccaaggcaagtgttctctttagtgttctaaaagaaaactgattaaaacgtggctttgccctcaagtatgctttacatagaaaaatatcatgagtaagtatgggattcatgcctatagaagatgttggttaaagctgatacattacctgctgggctttattggaatcttacatgtaaggtgtactcaattatactagggaaggaggtgccatccccaggttggtgagagggatagcctggactatgctttgattatataaagaaacacataaagtagagtggattcttgtgtgtgaattaatttagctgcttcctgggaacattgtggtttggtccgtgtttgatgttaaagtatgacaaaccagacatatttgttacatctaccataccattctttctctcccttacctatccaatctcttcctaaaatctctaaatgatgtaaaatgaaggcattgttaatcataaaagagagggaaccattctgggataatgagaaggagtgtttataatttttcttttatctgttataacagcaaaaatagtctcccaaagtctaatgacaggttgtattttgtaaaagtgccatggcaatggacattcactttgacttgctcatattctttgaataagatgattctttaacaagctggcattcagggtcctctcctgggaacagtgtgggtaaaatacaaacagtattttcatgtattgttagatatttggagagccaatgcctatgattttaatattctctgaattatatgctgcatctcattgagcactgaaggctgggtagaagcctcagctaactgcaagtgttatttggatttcacaaagagacagtcatcacccttcctcttcctgttgtatcgctcttttacattttaaaggcatagttttagaggtgttcaataaacagacaaatgagccacatcacatcctggcaggaaatagagtcagtgattaaataacagagcctggctcaaattctttatacaagcaacactctcattctctctctctctctctctctctctctctctctctctctctctctctcacacacacacacacacacacacacacacacacacacattcatatatacatgtatatgtacttatacatatatagacacaagtattccatacacacacacacacacacacacacacatatgtacatatgtaatagaatgatagatagtaaagcctttttatggacagattaaaagaggaaatgctggaagccctgatggaagacccccaagttcagttaagagatcatgctgtatttagagaaagtttgctattagtcttgagaggtagaagatatgaactgttaggaggtatagcatggcgtaaaaattagaagtgaatctccatatttcttcttcgtggatctctatgagcagtaataaaatagcaatacttgttctgattgcttttatgcgggtacgttaagaggtgtaaagggtgtttgaaaattgtcttatgatagatcaatggatctttgtctgaaaaataattgatataatccctgagcaagttgcaggatctagatccgagtcaaagaggaaggaagggatatgcactccaaactctattgttggattcactgggaggtataatgacaattgccattgaaggccagtttcaagtcatgatcctaggacacagagaagatagggaggaaaacttaggaaaaggatggtgttcacccagtagttctgtagactactcattcttgtggtgtcttgctggctgtcaaaagaagttctatgcttggagaagactgaacacactgagagaaacttaaggataaagtttaatgataactataggacttaaaacagtcctatattcagtggtttccacatttagcaaggtagggattaggtgttttggtggttagttggtaagtagtgcattgtaggagaacacacttctgaaaattatttcaggatgaaatatgtgtgtattgtgcgtgtgcatatgtgtgtgcaagtacagacatttgtgtgtgcattaaaagaaatgtgatggagcctaggaaaacattgattgatcaatgtcagcagagtgctgttaccattgaccaagctgtggagtactgatgtatgtatgacaatgactaaaacagtggggttcttggaaggagaggagtcctctgatttgtcaagaaggacattccctgtctttgtacttgacatgattggttgcatatgctagggttactgaggactgcatggtatccctagcaccctgctttccccagcaaccacgtactaacctcagattttgtggaataagaaaataatgaacatctaggtcctaccaaatgtgttaaagttagcaagcgcttggaaagcagctgtgcttcagacaaggctttaactgtgctcagtcaaagagcttcagcagaatttggattctcaaattgcaagacaactcaggcaaatgaaaatcatctgaatatctcttaagtcaacttcataatcagaaaaaagagagaattatctttgaacttttactttatttatttatttatttatttatttatttatttatttttctgccttttggagacagggttttgctatgcttccaaagctggccttgaattcaacaatcctcttgcctcagctttcccatatgctgggatttacaggcatgtgccatcatgaccagaagattattcttaaccttttgtgtttcttatagtcaactttaaaaatagaggcttcagagaatgctccccgaaatgttgtaattgacataccaacacaagaggtatgtcaaagggaaacctgaccctggcctagaactacaaatgttcttgttcactgtactggaccatgccttttatttgtaaaactccaagttgtgttttactgaggcatatcttttgttcttgtcatacagttgaagtgaggtccaccaaatgcaggcagattgacagttaaacacgtaactgagaagccttccagtgggagcccacaaggcactccattgtaaagacagctctttgtactcattcttttctggctctgatatgctcatctcctacccctccctactgaaagccaagaagactttccataatgccatcagttataggtgttcatgaaaggattgtgtgaaaagaaagaggagagttttggtggaaaacaaaaagtgaaaagctgcagatacagttacatgtagatatggtgctgtgctgcccctccatccctgtgccctgtactttgtatctctccacatcctagagatgagtaggataaagataaccatagtaccctcttgggtatccctcagtacactactgtggaaaaccagccccaaaacgttgttgtttcagtgcccgacagcttgctgccttttgctctgttttcttgcttcatattgaataggccctaatgaatccataatggacaggaagagaaagaatactgtcagatgctagtattgtataaagaacatcatgtaagaactatctttgatcttgggttttacccatgtatttggctttgtgtgaggtgcatgagtaatggctatgtagtttctcagaccatcatatacttctagaagagttgccagaaagtctgacctatggacagggaggcctgccaactgctcagattcagggagccgccacccctgccccagtcatcctgactgcctttggattgcaagagagttgtatgtctctggaaaggggacttttagaggtggaatttaagtattgtcctgcaattagagacttcttacactcaggggattttgcatctgaattattacagcagaggaacgattttataccaattacttgagcagcatgctgtgttcatattccacggtcacaaagagaaacagatacattaatcatttgcaaactggatttccctggactcaaaccagtctttatcttggcatgtaaaagggaaaaagttacttgctctactaattgaaatcatatggtacttatctgttctgatgctgtcttgctgggtctgatggagtgaggaatacatccataggaaactcctataaacaagatccctcccccagtttgccttgtgatcttggcaagaatttgagaaagatggattaatatcatcattcaaaggaagcgattttctgatagcttttagaaattaggttttgtttttaaaattacatacatatatatatacatgtgtatatgtaaaatatatataggtgctttgtttgcatggatgtaaaccatggtcacacaatgcccttaggggccagcagagtgcaccatattccccagaactgcagttacagatagttgtgaactgctcagagggtgctgggactagaatctgtgttcccttcaagggtagtatgtgctcttaagcacagaaccatctcttcattcctggttttgtttttttaacatatttattatttttatttatgcatatattatatgcctatatgaatttttatgtacaatatttgtacagataccctcagagtccagagggtattgggccccctggaactgaagttacaggtagttgtgagccacctgatataggtgctaagaactaaacctggctcttctgtgagagcagtttgatgatcttaattactaacccatctctttagcccctaaattagattttaaatggagtttgggatgtagataagacagacaaaaagtgataccagtgtggtaactactgagtcttaggcatatccaaagcaataggctatttgtggcatattcagctctgggtttctcattatgcatattcactgctgttcctagtagtggcttctgggtcagggcagaagcacataaggtcaacatgggtgcttgtgctgagaaatgttgggagaaggtagagagtagaagttgagggtttgttccttctgaagtcactcagtgagacgaggctgctagctgacctctcaggaactgtcctgtgccatgtcagcccagcccccaagtgcctcactgccgcttagcctggacaaaacatctttcttactatactcacaagggggagaagttgccattctgtggaagaggcctcaagaggagggcccgagtcctctggcacagccaaggataagcctaccctttgatgttttccaggtacagcagtaggtgtgtgtgagagtccctgtttatttgtatgtgtgtatgtgtgcctgttttgtagctgagcttcagttatatatgacatagatacatatgtgtagtctaaatagcagcacgacgttcttaaatcagtgaggaaagagaaagtggcgagcatgttgtggagagggagagaaaggagaggggaggaagcagtaaaaatgttttatgctgtatcttggtatgcaaacaggcactgagtttttaatccaataagggcatttaattctccctaatagaattcctgctccatcaaggtcaatggttcttaaactggagcatgtatcagactcctatggaggtgtgttttctcagagactgctcggcaccatccccagggtttctgattgggaaagtctggggcagggcctgggaatgtacccggctgacaagttttctggcattgccagttacttaactagccagtgtcacttctagcaaatggagacgtatcactgtgcaccctgtctttggcatccctatgggatcagactaggttgagaggaaccttctagacttttgatcctggctcgcaaagatgaaggatttgaagttcaccattctccagaagagaagcataatatggactttatcatgatccatattgctgggacccatggaagccagtgcactggatttttctgaaacaatgaagagaaaaaaaaatcagagtgaacattaggtttgataactttggacattctggcaaatcaggacatcaggcacgagggcagcactttctgtgcctaccaacgtagaaatcataaggatgtaagctctgctagactctctccaggagaaggcatttcaggtttaaaagcccaagccatttatttcctatctgcttttggtgggttatttgtttgttcatttgttcgttctaggagtgtgagcaaagctaggctggttttgtttgcttcttcctagttgtggtaatgggaggagatctttatcccaaccttccctgccttccctgccttccctgccttccctgccttcccagcccaaggagaggcaaggagactggcagatgtgcttccagccctgtggcaggggtggttgattgatggttccagaacttccgggttccctcctcacctttcactatgatccccagactgtttcttcataaaatgtgaccttctagcagaagaacatcaactttttccccatctttcttaacactttcatagaaccataaaatagtattcagctgagtacttagtggtggaaggtggcatattatttggggttttctggttttttttcccccaaatacagagagccttgtggcactaaataaaattgtcaccatgtaaaatggaaaggctttctgtcacaaacgtttttaaaaattcaggaaggtctgaagatttggtttatcttttcctctttctgtaatttatgcatatttaatgctagtttcaatgtttgcaacatgaagaaccttttcaaataaaaataaatggcagttgagtttcgtttgaagaaaaataccaaccatggcagtttttaaatgacacagcttattactcttcctatgttcagtggacatagaatagtttgtttttcccagtgacttcattgttgggatgttagttgacctggctatttggtagtgacaactgtttctctcttatcagtggatacttttcattggacattaatcatgtttaatgattatgggaacactgccatgtgggaacactggcagaaagaagagtgggaacagccctcagctcagaactgttgggtttgttcatgtgtctgatttgggctctggactgctgggtagcctgtggtttcaggaacatcttcaggcagagacagtattcagtttttcctgtggatgactcataaataataagagagttcactacaaatgaaagagaagggaagtcagagcaaacacaaagggtgtgtgtgtgtgtgtgtgtgtgtgtgtgtgtgtgtatgtttgtgtgcaagcacgcatgtgtgcacatgtgtgtgcgtgtgtacatatgttttaataaaacaaatcattgcgcatagcatctgaggtatggacccttttaggccttggaggactaaccaactggtaagaatagagatgaaaaccctccttactttagttttaggagatagctgggttctttcaaaaaagtactagactatgttgctcatattccacaaagtaagtgaaatctctaatgataagaaagaattaatataaggcccagatgggtctggacagtctagcttctgcttgactgtccacctccctctttgcccacctttttccaccagctcttgtccctatgataacccccttcatttctgtccacatatttccattcttcccctatggagttattctggagtgtctccaatgggccagacactgggcctccataaatgtgatcaacttgtcataaaataaaggaaactggacctttttgtctgttaaaaataatagcagacctgtaaaacgtatcaagagaaaaagagaaatagaaggtaccaagagccttctctattattttacctctctcttacccattttacccccgtgttggtcactgtcggggaagacctattattatgtggcagcctatccgcagaacagcctcgactaatggctgtggtttttggagccacatctggggattttctcattgtgaatttgattttgtccctttgattaatgaagtgaatcgtcctgatgtgtcaatcgccttattctctccgcagacaattgggaagaagttacctccagctacatcaactccagacccatcgaagacggagatggacagcaggacaaagagtgagtttccttaattaccctaaatccttatatacctctgaaagcgtttgctattaaagcgtctctattaaaaagcacacaaacgtgtgtccttagatcttccatgagtagactggcagcacaagacagaatcggaatttttccgtgtttttcgtatgggtttgattctttcctgccatgtgcattgtgccaacatgcaaagctagagtttgtccatattggcacaggctaggtgacctcaggccccaggagtgctagctaaagcacatcagggattcctgcatcttccaggaacagtcactaaactaacattacttttgtttcacttatgttggactcctcaagacatctttttttaaagaaaattatttctaattatgtgtgtgtgtgtgtgtgtatgtttttatggagatatatgcatgtgaattcaggtgcctgcagagatcagaggctttggagtcctggtaactggagtactagtcatgtatgagccatctgatgagggtatgttgggatctgaactccagtcctctgcaagagcagtgcacactcttaaccactgagctatctctccagcctgacatctttgctcaaatacctcagaatctttctagagcaactttcagacctatagaatacctttctatagatatttcaggcagcagactaggtgagtagatgggaaaagattagtttcattttagaacagtgtgatccaatagaaaaatcacatgaaccagtatatgattgaaaattttctggagaccacattaaaaaatggaagctcattttaatgtatttaagtcaatatatgtacataaaaccttttatatatgtaatctctgtaaaattattaaaaagatgctgtactttttctcagtgtgatgtcctcacagtgtcatatgtggtttgcatgttttatgaatctcagtttagagtagcagccacatttcctagtgctcaggagtcacatgtgcctattggtgaccacgctggacagtgtattttaagagtaatgctgaagcccttgacagaaaaccatagctctcagagatagtctctgctgagacaaatatgagtgatcaagggctgggaacatgcatttaggttgatctgcatgacatgttccaatagagaaacagttacatgaacttttttatagccacaaaacaaaagaaactcataaaccaaggcttttacacaatacttcagtgggagcaacaggttatgggcaactccgaaaaatctctgctataggttttagatgttctctgatgacattcttagcttttggtttggcaaatcctagtgatctactcagtatactttttaaaggcttttcctgatacagaggtgggtggtaaatagttattaagagaaatgaagatagatccagataattttgactctcaaagatttgtaccattctatctcttcagtcaaaatttgaaagtctgtaggccttgttgagccttcaagatacatgtggcattcttcctgggaactttctggggcctaagatgagctccttgggctaagtgatgtgccccattgcagatactcagcgacctcaagcatgtggtagaatcctgcccctagtgtatgccttgttcagtcctgtaaatgtcaatgaaccacatctgtgtgcctggctctcccacaacattatggtggtggaactgattacttgcaaagaagggattttatagtgactggagagagtattttgtcttagagtcctaggagggccagatgttattcgttactgacatggccacagacagatagctttaatttctctgacctttactcccactatctgctttgtgtacgcagtcagaatgttgccctagacaaagaaaatcccttagttgcctcccagtatcttcttcctctcattcagtcttgaaacctttaggactcagttggaaggtttttctactcccaaatattgagcaccctaatgggagagacaaaaggaagaggtaggtgaacagttctatgagaaaatgggatagtgctgggaattaatattaatgtgcctgttggtgggcatcaggtcagcaaggtcttgagagatttgttgtttactattgggcattttccatggatttagggacaagaactttgacagttgaattttactgtatacgttttccctttggctttccttgtcaaaagtaaattttagagtaattgctctcctacgattgccatttagtggaacgctaagccattgtaattcctccaacctttgggccagttccctgtttctggatcctgatgccacatccgtgtttaggtaatgacccagagtttatcatccaggcagcctacttgcttcttccttctgacctaaaatagaaacctatggcaaaggatgcccggcagtacagaggagagctgtttcttcctgccagctgtctcttcagcacactaagccacaggcccacatcaggattcagagttatgatgactcaaaaatactcatgcgagttggtattttttgagtgatccagatttatttaagcagggaacattctccccaccccacccccaaacaaaaggctctcatgatgctgagattcatcagcaactcaggctggggaacagattgccatcattttcataacaagaggaaaactatctaaatattcataacaaagtgcctcgaggtgccttcagcctatcacatctggtatctccctttttcttattacagttggtacagatttgttgtctctgtaggttagaaaaatcaccccaaagacaggcctctttggcatccttctgaactattcaatattatagatgcagaagactgtagatcagtggttcttatgctgtgggtcataacctctttggggtcaaatgaccctttcatgggggtcacatatcagatatcctgtatatcagatatttacaatgtgattcacaacagtagtaaaattagagttaagtagcaaagaaaataattttatggttgggggtcactacaacatgaggaactgtatgaaagggtcacagcacaacattaggaaggttgagaagcactgctctagatgaacaagtaggtttggaaaatctggataaagtatgattggaggtgcaagtgggctgtttcccatgttacacctcattcacttagtgactggacatttgcaccacctctgagaccattgacttgcctcttgggaattattgtctatagtagtgacatgtggtgcttcattggtaccattagattgttgatccctctaggtttaagacagacactgcatttgattttcccatcatgcagcctagaacagtgccggagactcactggatatacagtgagtggaggttgagcaagtggagacttttaaaggacttctgacattgtggggttttgttgttgttgttgttattgttcacttcttctactcaaatctcacccatactgtacctgacacatcccatatgaagcacatctcctctttatccactgatgtttttttgtctaccagagccctcatgttcaatcccccccaaagtcccctctctccctaggaagcacctttcaccaccccccaatacatctgttcactggattcagagggagggccttcctatgatgggtcccagctacctaggtggttgaaaattgacctttcaactccagtcctcttagagaagaaaggcttcctgttttcctgatgactggcctttctcccaaagtctccaagcttttcatctgagcagacaaagctgccgatgagagaacagtgctccagcctctattctgagctagaacagaaaggctttgcttctcaggttttcattttattcttttgaaacaatgcttctttttcaaacaggaaagtgaaagggtgttctaattaatgcttgggacataattgaaaagacaagttcccagcagcgtctaagatcaaaggcaattgaacagtcagcttcttcggaagggaagctgttgggttggaattgacaaatatggtaatgtacgctccatgtctgaactcagtctgaatgtagattgaatgtacttacacgtgggccagatcattctctatcccggggactgtcctgtgtatatcacagagtatttagcagcatccctgccctctgttcaatagaagccaatagaacctgttcctctcctgttgtggcaatcaaaactgtctcaaagtattgctaatgttccttagaaagcctaacttgttctgtattttgttactctagtagaataccacaggcagtttataggtggtatgtatttgcctcatggttccgggggctaggcaattaaaggaaacatgcctggtgagggatgttgagttgttttataacatggaccaaagagaataagagtttggagatgtacaccagtgggtaaagtacttatctactatgctcaagacactggattcctttgtcagcagtgcatacaactggcatgatggcacatgtctttgtaattacagcactctagaagtacaggcagaacgagcagaagttcaaggtctcccttggctatatatgagtttgaggccaatccaggatatatgagatgctatcttaaaacaggcctggcaagaggccttattgggtaagaatgtgtgctttgtaagtataggtgcctgagtttaaatctccagaacctgtatttaaagtcaggtatggttgcccattccagtaaacccagtgttgatgaacaaagataggagggtcctgggagtttaatagttcagatagttctccagccagccagcctacccaaaatagtgatcttatgattcatttagggaccctattccaacaaggcaaagagtaatagaagacaatatccaacctcctagcctagtctctgtttgcatgtccatgagcatacatacatatatatacacattcatatatacacaacacacacaaattcacataaaggagagagattgaacttataatctctagcccttttataaccatagttaatccatttctgagagtgaaaccctcattacttaaaacccttcaaaagaagcaccatctcccaacactcttgcattagtaattaagttcacaaatgcatggcctttagaggacatatttacacagcagagccccagttttgaactactagtgtgtttgtatagtaagttctgttagggcattattacaactaccctcctccttgatgcacaattgacacttactgactttatagaaaacctaatatatatttggcccctcctgatacctctgggtgctcaaaatatgatccagatctggaagccttgtccaaatatagcatgcagtacagcgtgccccagtaccactactgcactggtcccatcttcccagtccctgctattaccagactaatacagcacaacactagacagtgattctcacagtgtgttttcagggctagtagcagcaaaaaaaatgcagcctggaaacattgtccaaaatgcagatctgctgggcctgccccacgtcagacaatgagggtgaggtcagtgatctgtttcttcaagccccaggtctgaggccttgcctactcaagtatgaggacctcagactgagaccaggatgtcttaagcttccctggtaatggaattagcagagttcttatttagtagatagaattctcatcctaccaagacttgaaggcccagataccaggaaaggaatctaaagagttgtaggagcagatgtcccacacagctgtgaccatgggcaatggctgtgacccccacccccatcctgcccctctggtcagttccctagagcattgtggcaaattcattgccattttacctccaaaggacagggttctatgtctctgacaatagaggtgattaccccatttctgacattctgatgctttgagctgactgtggctctcatcccttccctgctgtcacattgtcaagaactagatttaggcattcttcatttctgccaccggattataagatgcctgacagccagatactagtcttacttaccttagtctgttgtccatagagcatgatagagtaccacccctgcacgtagtcccagagtatttaaatctctgagaatgaaaaagttttagtgttcatagggcaaggaaatctgttcttggctgacctatacccgtatgttatttatttctcttacttagggtgataaatcatccatttgctgtggaattttaatgattgagcataataacataagaccctaatagtgggtggtacatactacgatatggcatgtgaagcgtatttctttgaaaatttaaataattctgttctcaggagctctgcttaaaactacaaactagtagtgtcttagatactacttatccattgaggggcagaattatgatgttagggaaagtctgcatcactgatggtactgtgtgtgtgtgtgtgtgtgtgtgtgtgtgtgtgtgtgtgtgtgtgtgttcatgcacatgggtgaaaatgtgcttgcttatgtgtgtgcgtgttcatgtagcagtcagaggacaatactgagtgtctctcctagtcatcccaccctgcgttttgagacagagtctcactgaccctaaagcttaccatttcaactagactggatggacagagagtccctatgatccacccgtcctcactactactcctactgctccttagcactgggtttccaggcaggcgcatgagactttgctcagattttatgtaagtgttggttatctgactcgggtcctcacgcttacacagcaggactttttcccatcgagcatccccttagcctgtgatactcttccttttataatgtctccagggaaaatgaaactccaggtttaggcatgacctggccctttgcaccgctgccaaaaagctctggagagctttctttctaccagagtctgggtacatgggctcatactctttacaggttgaaaatgagctcagaacaccttcaaagggtgaaagagaacccagtgagagttctggatttaaagttatttcctcatgtgtatgtgttcagattgctaacatatttattttgtttgttctgtttttatttatttatttttaagcagaaggattttgggttatttgtttgttttaaggtgtttttttctttaatccattataaaactagatggagggagtcatggaatataagcatgtgagttcagttcctttaattgtttttaataacttgtaaatatttcatgtctagagactaaaataatgtcttaggagggggaggatgactcatacttgatgttctttgtgattcttacttgagcaagtttcttaaaaaatgtgaaagctggccacatgtggtagcgcacatctgcaagcccagcacttcagaggctgttaggagactcaccacgaggttcaagatcaacttggactatacagtaaatgtgaagcttgcttaggttctatgagatcctctctcaaaaagcaaagaaggctagcatggtggttcactgggcaaaggtgcttgctgcctagcctgaagccataaggcctatccctgggatcacagggtagggggagaaaccaactcttaccactggtgctctgatcgtcacctgtgctcagtacacattcgtgcatgctcacacacacacatacacgcacacatgcacacacactttcttgcacacatacacataaatgtatgaatggatgatagataaatgcaattatgtttaaaaagtaaaaggcttaaagctggtaatgaaggcggcatagggaacttttgatctaggagtaatgtggagagagtctgtgaaccttcctgtgttgtatctaccttctctactctttgaaatgtgtttgtatggtttgttttggaaaaaaaaatttgtttctggaaagaaaaagtctttgcttcttatcagattatttaaagcatgtaagacaaaaagctctcagaaggtaggaatctagacttaggttagctaattcattgacatattttagtcattcaaggaaaaagtaacaacaaaatcattttaattactatacaaattgtgcctttctttctgcttttgtgtagacccattcctacttgatttcagactatctacattgatcaaattaacgagttgatgggaaacacctgcttgcaaaaattcatttcagccctttcttctttatctgtttgctacgcatttaaaacttagggtcttttcatgaccacaaggaatttagagttatccttttcttttaaaacatactaaatgccccttcttttggaacatttttctgcatgcacacgatcttgccattctgtgaaacaggggagcagcaccccactatcaagtgatgtgtatgtttgtcttgtccttttgacattcttctccccttccctttatctaaccattagactgtcagttccatggaaggacaggaagttcttcttgtggtcttagttgtatattataggctcaggctccagaactagttggcagcatcttatgcatggtagttggtcagaaaatatttgaagtagggaacagcatgcagtaggagtactatcacacttttggagttaatagtgattttgcatatgtatttatttttgagcgagtatcttaaagctactgaaatgcaaaccaatacgtttttattttatgacactgctcaatggctaaaatgctgcataagtaagggtaactttaaaagaaatacatcataattaagtatgagtctactggctgccatatttgctgagaagtggttgtgattggagtgttgaaatgtcattgctggaaagaacataagtctaacctattatggtactgtgtgatcttagaacattagtgatatgcttttcagatcctaagtaggagctggaacaactctgttctctaattagaagagcattgttttgagttatttaaactttaagatttggaatacacttaaatgtgcttaagatgttctgctgaagatagctaaactaacgtctcatctccttggttggtttctgattttacacctgatggcgttatattcatctgaagctacaatgtcatgtagcttgatgtcatctcaggtcaagcagtccacaaaaatccagctggaactgagcccagttccaagtgtcctgactcctgactcagaatcttctactactttctgtcgcttgagggtgccactacttcttaggcatcactaagtgatcatcaggaaatatgcaagaactctatgccagttctgggaatgcacataggcagccaagaagaaactgccacactgggtattgcttgagcatatatatgacctcaaagctctcccacagtgacacattttctcctataaggccacacctactccaacaaggccacacccaatagtgacactccctagggaccaagcatttcaacacataattcgatggggaccaaagctattcaaactaccacagtcctattctttttttctcccaacttctcccagatattccccatctccctgcccagcccatccaacttcatgtcctttctctctttaaaatcaaaacgaaaaattattgagtctgttttgcattggtcaactattcctggacatgtgacttgtcctggaatgtggttgatatacacaatgttatatcattgaagaaaactgatttttcctttgccagtggggatcacttgcaaattgctttcttggttagtggtgggaccccatgtctactttccccctctcagtgctgggacactgtctgtcttgaacgtgtgcatgttctgtacttgctgccacagtctctgtgagttcatatgtgcataggtcctgttgtgtttgtcagacatatttacttagagtcatccactacctctgtctcttacaatcttcctacctcctcttcttcatagagccctgagtcttgagaggaggcatttgataaaacatctcatttaagactgaatgctcccaagtctcttgctctctatacattgtctagttgtgggtctctgtgttaataaccatatgctgcaagaaaaggctacttgaatgaaggttgaatgagacattgatccatggatgtacctgtatgtcattaggagtcattttagaacaatagtatttgggcttcccctagtgccagagacctatctagtctcatgttcttgactactttagtagtgtcatatgggttccatctgatggaatgggtcttaaatccaatgattaattactcccataacattttctctacaatcccatcagtatatcttacagtaagtctctgttattaggtcaaaggttttatagcaggacaatagtgatgatgatatttctccactggaagaatacaaagtaccttccagcagcatgaactctagtcagtaagggtcaaagttctagttctgcaccagttcaataaaataagtaagcgttgtcctcatcagtaggaccgtccctttaggttggggaaagcaaccagtggccttcgcaggatcctatggtatttggaggggcacatggcagggaccttttggccaatgactcaacaagatgtaattcattactgacacttaaagtttaacttggtggcatgagatgtctggatggggcattgtctcctccattatattgaaacttaaatgtcttccatatatgtatataatttaggaagcttctacagttctaggtttccatgtagtcttaaaaaaaaaagattggtcccagtagtagagtcttcaactagcatacccttggctctgtgttctatctatagccctgcaaagaaaacaaaatgatcaaaggcaggcaactctttgccttatatctctaggcaacaaaatctagcagtgccatctctaacatttccttttatacatttcattgactagaagattatgtcttgcctctaagggagtaagatagcattatttgtctatagccatgacatattgaatatgcttcatctcagaagctaagcagggttggtcctcatgagtacctggatggattactttcctggacaaaacaaacctgagcaaatgagggttctgtcaagtaggacctgacgggctgggaatggctgccaggaagttaatccatagtgctcgatcgcattctattaacctttgcaccaaaagacagaaaaacatggcgcgttctttctttgatggtcaagagtaactgatagtcttttaaaaaaatgtctatgatttccatagagttgggattttgcaggacagttcttcaataatattgtatgttcatgtttgaagttttgaggttgggaagtcatatttcagtagcacagtcaattggaaaattggtgaagaattgtccttatcccatttagagatgcttaacttttccccttccattacaacatctaactaattcgggcttgggaaagttttgctatttctaattaaagagagatggataaactatacttggaacaatttaattgacacttaggcatagagtggtaggttaggatctagatgcaggaaggagcctaagtcttaggaaatatttgagaatattcaaagagaaccgtgagacttttggactctgatggagaatatagtaatgtctgctctagaagatactaatttccttgagttttctgtctaccttctgtcttgagtcatgaaaacttactttgcccagtcttcatttcccaaatccattacaaagtgtttcactggcttcttacctgatgctttttgatagagctaatttaaaatccgtaatatctactcagtaatacttaaattgattttgaatggccaaagtactttttctctcttcagtgaggattcttgcttataaacaaccccatcaatgaacaggtgtgtttgcacagagaccatgaaatgtatatgaataggttcacccatcccacacggatatgcataaagtcattttggcaattttcatggaccctgaacagttctgagctaggtcgtttgcacatcctgtatgactgactgtgtagcttggtattcttatgggactcccaacagtggtagtgtgtgtggggggggggtgagggatgtctctgactcagtttgcctggattgaggccctttacctcctactgggtagcctcattcacctttgatgagggtaagtgcctagtcttattgtattttgttatgccatgtttggtgatatacctgggaagcctgttcttttatttgaaaatctgggggagaggggaggtggggaagggactggaaggaatggagaaaagtataatagaaaaaaatgttttggtagtatttgttggctacctgtggttgacatttttatatacaaatacatgggtatttacctcttaatacatggtgtaaaaggtaattcctcattgttttatttgctgggttggctttatagcagatctaaaggccccctttctgattttgtaatacttgcaacaaagcaatgagaaaaaaaaatcagatagttcacatttcctttctcaagataaagaaaaatcttttgcctttctaactgagaaaagcaaataatcccaaggcatgcatggtattctattattcctgagggtaaaatgcagagataaatatgcatgaggccaccataagtgctcttaagtccctttcggagggacttaacattctgttgagcatacctttttcttgaggttaatgtggcagggagtaccttcaactgggtcagctcattagatgaaacaaacaccttaaaggttgtattttctgctcttcttacagccaaggattactgcaaagtaatatttccatatgaggcacagaatgatgatgaattgacaatcaaggaaggagatatagtgactctcatcaataaggtaaacaaagatttttctcccaccttctaaattgtcaagtgctttggagtgtgtatatgctataagctttcattttagccattttcttttgctttgaaaaagagtcttgttataacaagctggttttaaatttatcatccttttgctttagcctcccaagtgcaaagatcacagacatggctatcatgcctggattgttttagacctttaacactcagttttatggtcttgaacttgtgggaaaattttgcatctttctttttattcaggtgcagtcctggcaaataaacctacttgagaatctaatagatctctgtgtacctcacgaagggccagctacatgaccctgaagaagagtctgtcctgaaaggaatgacccagaaggcagcttacttaagtgtgggttctgccttcgccagtggtcagactgaatggcctgtatcatcagggactcaaggaggggctcttaaaaggctggtcatgtctcacaagcagcaaacccttaaagaatgtttgctattccgatcaaagacagacagagtgcctgggagaattttgcttgtcttgtttggagtataaaggttggatgattttattatcatttcagccagattcttgtaaaaacccagagagcggtaaaatctgtgagaagcaaagcagtttgctaaggtcttgaccacacactgtgtttcctttcatgcagtgctactcaccacactggaagctaaaagtcatattagtcaagtggttcttagaacaaacagtgctttgctctgaagtacagggattttatgatggttgagtacaataagaagccaggcagtcttcaagatgtagaaagtagctttgttttgttttttgtttttttgtttttgaatccaggtaagtagctggaaacatattagttattctctacacaccagaatgacttagagattgccacagtcacctgggctctaatgggatggggaagcattgtcagtctaaaggatgcgtgatgcagggggctgggaagggaacagaaaattggaatcaggaaaggccctgtggctgttaggaagaggggtggggactgctgttgtgtcgcctgttgctacccctagatgctcatgaaagaagcgctccagagttccagctatttagaagcttttaaactgtctagtgattattgttttttctgtcgttgttttgcttgtttgtttgtttgtattttagggaggacattgaccctctcatggacaatgtagtctgtatgtcgtatgcagaacaacactacagctaggcaaacacctttgtggaataatacattatcccccctctaagaactcatctatctttttaacctgtgagctagcctctccctgacttagttcagtgtacgtctgtgggtgctgaatgtggcaggaggaaagagaggaggaggggagcagtgttctccttgctcctctctgcaagaggcagttcctggttcttgccacccccactcccccaaggaggcggctctcttctacatagtacatttcctatttttaatcagtcctgtaaccaaacaaatgggataagcaagtttttaactgggtgtgaagcatcatgcaaatactttaataattagcactgataattggttttagtcatgcagggaaaggaatagagcactttctttccccttacactgacagagaatcagggatttaaggaactgccattctttgcagtagggaatggactcactgtctatatttctgtcttgattttagagggaggagaagactcttaatagaaagcccagtgtgttcataacatttatgatggtttgggaaaagggaacaccaccttggtttctcttttacctgaagatagcgattttcactttaagactctagcctccaggcctcaccactggcgtacattctgtcctgagtgggttcagcctctgattcagtctcataaaaggaatctgattcgggcaagggagagcttggtctgaatagaaaccgctaacagcctcagtcttttagtaggtaaccatgaacaggtgactatgtcctcggagggctgcacccgtttctctggtttcaaaggttaatgcacttggaagtggtttgttaatacaatgtgatgcttgctgccggatcctcttttacacatttgtactccaggctctcttctgactcgacttcctgagtatgcaagtgagcccaggcttgctttattgccctgataaacagcctgagcttcctcctcagctcctgagaaatgcccggagacagtaaagaatagagggatgctttctccagctccatcacccatccttagcatcccagcactttctttttgacactgcataacagggcttcatttgtgacctctggaccaaccaaagtcttcagtggttttctctcttttatgataaaatccagtctggggacatgacacttcttccctcagacattaggctttggcacattaacttttggtaccatttgttcctatcttactcttgtgtcctcatgcgactgaccgggcatgtccattcctgtagagatagtctctgactacctacttaattgttttctctttctttagtgtgtgtttggacatgcttatgcttgtgtgttgtcttcttgatagctaatatcagaggcagtcttaactcaccctaatgaagtacattatgagcttgctgattagccaagatcatttgtgtttgatcatcttgtttgtattattattttatataatcttctgagaaaacaggcctcttactgtcctctcctgaaactgatgttatttttgttataaaatttatgccaatcttgacctcgaaaagtgcatggtaagatattaagtcatataggcttctagctcagagaaaccaaggtttgactccccgcatcacaggttctgattatggctcattgggcatgagacttgacctctctgagccctagtttcctctgctattaagcaagggccttaaagctgacgtcacaggcctagtgtgactattcatcaagacactgggcatgaggcctgtctcacaggagtgaatctgcctatgggaaccataatcttagctattgccaacttccagtctggcgtttccttctcaaacttcagcaaaaggaactgtgggctctgggtttgttgttaaggatgaatgctgtgacattaagtaggtaaaggtggttttaaaactccacctgcaatagttaaggattcacagtgaggaggtttcagcaagaatttagaaagaaaatacaccacaattttttttttgtctgctgaaagtgggaaaaaaatgaattccgtgcctgtaaaaatgctgctgacattatagagaaattcttacctctttttttaagttgatgagtcacccagaaattcatttcgatgattataagctatcataaaatgaataggttcatcacaactggctaaatatgcattttaatgtgcctatttattgtatctgtgagttgaggtcaaagatctgaagtgttactctcgacatctcagttccgtttgctatttaagtctccactgtccccacacacagcggatgttccctttgtcagccaaggtgatttcctctgccctgctttctgagccatggcaagagtcacagagcaagcaccggcctccttttcagctctagattgtcatttgcatggctttctagaaaaggaatcagacacctttagtggatttctgggagccctctgtggttcctgaaataaagtgcaaagacctgaactatttgtgtgcccctggatactaggatgagatgtggacctgggttagcttttagtttatttagaaagaaggcttgtggatttgggaacattcctacttgtgcagaacacacctgtgtttagtttttttttttttctattcccttaaaaatagctcctgcgtctgtggttctgccgcctccatcccactttctgattgatgttcagaatatgttcaggaagggttagagcctctgggtgtggtttctggttttctttttcttttccctttttaaaacttctgtctgtctgtctgtctgtctctgtctctctctgtatctctctgtctgtctctgtttctctgtctctgtctctctctgtctctgtccctccctccctctctccagggtctctctgtataacagtcctggctatcctgggacgtactatgaagaccaggctggcttccaactctcagagatcagcctgcctctgcctcctgagtgccagaattaaaggcctgtgtcaccacctactggcttccttttttaaatttagagtggcacttgtggcaccagctagccttaaactcactatgctgctgagcctgcttttgaattcctgattccttcccgcttctgttgctagagtgctgggtttacaggcatgtcccacaccagcctgccctgggttttagaaagcaaatttatggctccatagcaaaagtagctgctattggagcatgtgctttctgtgacaagcacccactgaggatagaggaaacgctactggaacaatgactatgttctcaatacctctgcccctccctgaatttagaaggaagtttttcctatgaacccctttgaaagcaatgctcataaaacaacttgcatggatagcctgttccccatccatgcacacttcaatgttagaaatctatttgaaaacgtcaaaattggcatttaggaattcagtgctattgaccaaagtggtggggatgacaggaaggggatagagatagatggtgtgaaatatcactgatgttcatagaagaaaaccagaatataccctaaagatgaagggagacccatggaggtagttgctggcactgctaactgcagaagtatacaatacttccttggatcataaggattttcttctgatgctcagtggcagcaattttaatgtacttattttacttaatttaaccaatttaattaatttataccctatcttcttccctttacaactctcattcatcaattcatttactgaaagacatttgtgatgtgccagaagttatactaggtgatagggttacaaaggtgaacacacgttccaaacttggaggtttgcttttttcctagttccaaatatttggagctcagcatactgtgaagttggagtcagaattaaatgctaacccaccaagcttctttcattgctactttaatgtgtcttcatgcctcccttctttctcatgcaaatgtttgcttgaacatttaatactctctagatgtgcctgcggggccacagcctctcagtgcaggattctgggcagccattagcaaaagttcagacccctcagccctattcttttctcctcaggggtctatccaaagctcagcatcttgcctcatcctcacagcaggcacgggaatcacataggatgatgagtgtcctttccaggtcacagaagaacaaagactcaaagcgtagaaatggttctttcaaaaacctccccagcaagttaccagaagaactgggacaggcatgtcttctgactccctgtcaaatgatcttgggatatggggatcagatggggtggtaactctggacggagtttatttcctgtgggttgtcagatgtttgtagtcggtgcagctcagccagtcctagggataactataatccactcactgagaagcaaccagtgttgcttgatagccagagctagcatctggagtttcctttttaattaatggtattattattactaatcagaacagcaatattaccacgatattgccatgtttctgacatactagaatctatcactctccagctagccagtcaaaaagaaaggatgagccattcagggctaatgtcaattatttagaagatatttgtattcattctttgagactttaatacatgttttgatcatatttactccaacaacccttccataattcacctccctcccatttgtgtcatgttctaaaatccctcaatgctaattttgtactatctaaatcttctcggatatatggacgtttaccagagaggcaaagcaagagctacacttgagaaaactgtctctccctcttctagttgctgacaattgctagtagtcccacagcttggggaagggcgggaggaattttgcacgaaactcctctttgctgcgatttggtctggtttgggctctcacaggttttgtacacactatttctgctgctgtgggttcatgtgcacagccgatatgctgtgtccaaaggatactgtttccttacagccacccatcacctcactatcttgcactctttccatctcctcttccacaaagatctctaagccttgggaagggggctgtgggatgcactttcccttatgatggagagaatatcttctgtagtgtatggatgtggcacctgtcaataataaataaatatggcctgtggtttagtcaggaaataggagatgggacatccaggaggcagaaaggattctgggatagtgcagggcatggggaaattcacccaagaagaagtgatgggatggacacatggtacctgtgggtaaccagtcacatggtagaattagagtaaatgggttatattaagttatgatctgttcagagaagagcctagctatgtggccaagagatttgtaaatatattttgagtctgagttttatttctgggagcctggggctggaagtaggaaccacgtcaaacttctacacctatggataaataattccaaaggccttaaaaaaaagacatatggaaacctattactgtagaagcttcaacacacatacacattactatagaatcttctaaaacacacagatagaaagatatacagaaagagagacagagagagagagagaaccagagacacacacagagagaattgagtgtaacaatgcccctgccccagaggatagcaaatcaaacatccagtgctagttatgagatattatttttttaagacagggtctcatgtagcctaggctcacatcaaactcattatgtaggcaaggttgaccttgatactccttttacctcccaaatgctggggttataagcatgtaacattaggtttgcttcacatggcactggggatgaaaccaaggcccttgtgaatgttaggccagcactctaccaactgtaccacacccacactccctaatgtcaattctttctgtgtgtcaagcaactctccatttgctgtcttctgctttcttcccatatagagtgtatttcggtggcattcttttattctaggtctgggggttttagctctctgtttgctgttactatgacaataaagactctgggcttgatctttctgagtccttcaatgatgacatgctctaatgttttaatgcctaatgcctagtttccccttcctccatcccttttcattagcccattaattaactgaaatgtctatctacagggaagatgttttcacccccctccccgccttgcttcctacgagaagtaaggttgctttgacagatgtaagtagtcccgggaatctgagaaaagatctttagtttggtataaaaagccactcaactaaatagattgctggccttgaccctttctctcagaattgccgaggcttttagcagagctaaaatgctaggattaaaagagggtccatgggtgcagagtaaattagcaggtgccaccctgaagaagaggacgtgctggcagcaccattagaagggcatgatttatgagtgaatgaggaagttaggtgcaggtctgcaatcgtctgcatttgcacacatttgaaaagcgtcagtgttcagcaaatgatttgtttataccatagaatatttttcctaacatatgacccatcttgttagactgtgtatgcccttatctgagatgtaagtcacaatgtatatatccctcaagcattaaaaacccaaaggaacgtcgcttgttgctatctctctgcctcttaaaagtgcctagggtactgggatggagaagaggaccatgattctctagatgtagttcatggaaactcttctgcactgtgcttgtgtagacgccctttcagacagaattttaaatgagatgaaaaggtaaggcatggagggggagatacttcttttgatttacttatagcgaaaaaacccatgccaccgcaaattagggtggctcctaatatagtccctttctttttatagtggctaaatgaatttatggattacacaaattcccaggttcgtgtgccttcgctacttcgctatatgaaactgtctaaaaagacctctaattatttgttcaatctgattgccatactccaacgtgctaatcttaaattgctataacatcatgaaacacctctgctgtctatttctgttttaaattttatttctctatgtgtgcgttcaagcacatgcacccatggagggcagaaaggatgttagaacttctggagtgcaagtcaccgttacttgtggtctgcctgggttggtcctggaaactgaactctagtcccctgtgagagtgagaactgctcttgaatactgtgccatctgtctaggccaagctataattattctcatcactttcttaattttcaaaattgcatttattaaaataaacaaataaattacatttgcttattattggtctatgggaggcatgagtctgcctcagtgtgagtgtggtggtcagaggacaatttgcgggagtcatttctttccttctaccctgtgggtcccaggaatccaactcaagtcatcaagcttgggggcaagttctttcatccactgggcccacggaggcattttgttgcccttatccctgccatgttctcctagatgaatacaaccttggataagctgcttgtctctccttgcctcggtttctccatctgtaaatcatgggcaataataataacccctacctcctggtgttacaaagagaaaatgaattaaactgaggagtgctgtggtttgaatatatccctccaagttcctgcattcaaaacttaatttccagtgcaataattgagagaagggacttaaaagaaatgattagggtatgagggccctgcttcaggcttatgttaatgcaattattgtggaaatggattcattattgccccagtagattcctgataaaaggatgagtccaggccccccccctttctcttgcctatccttttttgcctttccatcttctaccctaggataacagtgcaagatgcaagcccttcagtctttggtgtcccatcttgcctgtaagaactaaatctgttctttgtcattgatccagtgtcagacattatattatatcagtacaaaacagactaacataataggcaaagcacttagaaagcctggccaatagtaactgctatataaccgtttgcagctattatttcctgatgataaattgctaaatgtaatgctgcatcagtgtattttgaaggcatttaagctatgctgctaatttagtctccccacgggagtatgagcaaatgtttgctattccttgtcatccctggatattaccattctttttgttctctgctaatatcttttaacctctgctaatttggcactctaaaaattatcactgagcttgaaatccttatgcatcattttccaattgatttttagaaaatactctatgtgcatgccattaacttgtcattttttcatattacaaatattttttcttagtttatgactcatggagatatttaagtaagaagtcattaaaataaataccttttacactcacaatttcctcattttatacttaacggtatagtgaagtaaaatttatcatttttaaggtgagttttacttaagacttttatgtttggagccctaggtggagagagtatctggcgattaaatgtattccctttctgctttcctcagggctttcaaggttctatttaaagcttctacccttttggtatttctgatattggcatttagagagcccctgggattcttcatggattcttacaaggattctcctgtcctagacgagggcttggcaaacttctgtaaaaggccagaaagcaagtatttttagactttgtgggccatgcagtctcttcagcaactgctactctgacactctagaggaaaagcagccgtagaggtaaatgagtctgtttggttgagttccaataacactttatggacattgaaatttggatatcatgtaattttcacattccttgaaaatgtattcttcttttaaaagaaaaacacatttaaaaatgtaaaaactgttcttagctcttcttagcttttggcccgtcggctgtaatttgctgacctctgaaagagtatctggaagtagacccatgaaaatccaacagattaattttcagcagaaatgcaaagatacttttaagagtttaaatcttggtctagaaaggtggctcagtggataaaggcacttgcctctaagcctaacagcttgagtctcatcccggggacccatatggtggaagcagagaaccagctcttgaagttgtcctctgacttccacatctgtgtagtggcatgctgtgtacactcacgcacacacatacacacatgctgcacactttttaaattttaaatattttcaaaaaatagtgttggcatgagtaaaacatgaactttaatctaaactcaacatgctatgcaaactttcattcaaaatagatgataaatctacacgtgaaatgcaaaacatagttattcatgaacgtgtaggagagttgttaggccgtctacacgtacaaaaacaatgttaaattggatgtcagcaaaagtgaaatttttgcttcttccaagacattgttaagtgaattattggtgggtctggtttgactacatgggcgtcagagtcacagtgttctagtctctggccaactgcatacgttctaaggccttggttttatcccgagtgttcctgaaattcctttgtagtataaagtcatgaatctcttacattgcccgttactgtacccgttgccctttctccctcatggtgagtggcagatgttgtcacaatcttctggataaagggagacccagcagagagctggagtttagcctaagatctataattttcacccaccgcactggctaaatcatctaagtatagataaaaaggctgtgcacagtattttaggccaccaaataagctttccaagtggggaagaaaaaaaaatcttcctaaaagagatgcagcttgatcccagtggagaatgctaacagaaggcaggaatttcctactggctcccacagctgtccaggtggttctgacctccagggtgagctatttatcccatcccttccctggcttttcctgctcaatgagtataaacacccctttccaatctaccattctcttttcatgtcctcaagatgatggagcagctaagaaaatctgtcaaaacgtaaggaaaggtgctgtgggaaaggcactgtctttatcaatgtggcaaaatgattttctgtcacgtccgccatccttttaatggaagaaagatgtgcttttgagtgcagaggccatgcatttctctaactataaatgagaatgaaagctcagcaccaggatgcgcgtccttgagaggtaaactgcacttaggtgtgtgttgtagaggaagcacagatgccattggaagtcgctttggagattgaccgtgcggcagtcatctccgtgtaagctaccaagcaaagagaaaatgaagaatgtctgtgaaaacttactgttatgtaaattcaaatagtggcttttgtttaaaggagcacaaagaaatgtgaaagtgcccctaactgattttttttttaattttattttgtgaatggcttactcacatgctctcatgcagtttatattgctttccctgcttaaaaaagtcagattacaaagacatgggaaagacgctgtcatatcagatcctttccatgtgagctctggctttcaaagcaacctcatggagagagaaagtattttatggttattcagaaaaaaaggctaaagcataaatatattttgagaagacttaagattatatgttcctcagatgaagttaatataatatatattatttattcattgtcatgtctcaaagaagcctgggacaagtgtccctctgtacctgtagcactttccagcacttctcatcctacccataccctcaatgtttccagcccaggggctggacctcacttaacccaagcttctgatttttttataacaccatcattttgactatatgctctcttggctcctggttcccctcttgtccctctcccttctcttcctctctcactctcaccactctgtctcctcttgtggcccggttcagtctgctggccatgttcagtctggacccttccagatgtctctgaatgttttctccctcatatatacaataaacccttctcctcaactatacccaggaatggccatgtccccattttcattccgttatgttccagctatagagccaagccctgacaaccccaggaggtgcccagtaagagcactgagcctggagctgggccaacaggacagcctctgttagatggctggtctctgaagaggctccaggaagaagcaccttttgaaagagagggaaggtagctgttatcacagaggcccttaggccttctgcctttgataatcttctatttaaatccttaggccttcttcattctgctctgtgactctttatgtatgtgggagctctggtctctctatggcagtggttttcaacctgtgtgtcatgacccctttggaaagcagatgagccttcacaggcatcacctaaaatgatcggaaaagacaaatatttacatcacaattcataacagtagcaaaattagagtcaggaagtagcaatgaaaataattttatgctggggggggggggtcaccacaaatgagtattaaagggtctctgcattaggaaggctgagaaccactgttctatggggactgagacttaggttgggcttcttgtcttcatatcttggggcccttagactaaaggttaagttctgtagcgtttcctaagccatgtgctgtgaacaggctgtgagagggtaaggaaatgatcacctaggcctgccaaggtccattcaaaggtgagtgcaacttcccttcctccagccccagatgatggcttccatcagcctttggcctctaacaacactatgttacacatacagtatcattttctatgtgtgcatccccagaaaagggttgggtggtacatttattttcctctattaagatgtttaacagaggctctgcttttatcttagagagtatttcaccttctttgttagaaaatagaagaggaaatactgtgatagaaccctcccttgcaatagctcagattaggaaagctaaagcttagagctctcttatgcctcaaatgcagttaattcactccaattaaagaaccaatcctttaaaaagaatatagcttctggttgtatcaacaccagagtgaagggtattaaataaacctactcccttgctgtagagaacccagaaatttatcaaaatacatagagcagctgtttagagccattgaacagtatataatgcaaggacatgatcttggagcgaagggggcattggattgacttttttcctggggtgttttataaagtatagcatggggcagaacccaaacaaggaacagcagtctcatgggacagagagaacagaaaatgtaatgcaagctgtggaaaaggctcaaatctgctcaacgcagcactgtagaaaagtgaggcataaaaagaattctagaagtttatggatcttggatctaggctctctttggatcttatcccaatattatattaggccacaccacagctagactccattagactttggagaaagcaagaacttggaggactatgagctgcacaggcatcccagagctcaccagtgatcagagacatcacagttctggtcatgcatggtagaaaaaggagagatgctgaacatctctagcatttaggtgagaacctaggaaattcaggcataggaataaagctatcctgggcctaatctaccaaatcctcaaaccaagcttggactggccaggctgatcactacgcaactgacccttcatcatcaaactcaatactctttctagggagataacaaaagccaggctcttttgaaacctgttatcataaataagccaccaggtaaagaagcagctttggtactggtaaagcgacagaaaagtagaccaatggaatagaattgaaaacccagagatgaacccacacacctatggtcacttgatctttgacaagggagctaaaaccatccagtggaaaaaagacagcattttcaacaaatggtgctggcacaactggcggttatcatgtagaagactgcgaattgatccattactatctccttgtactaaggtcaaatctaagtggattaaggaactccacataaaactagagacactgaaacttatagaggagaaagtagggaaaagcctcgaagatatgggtacaggggaaaaattcctgaatagaacagcaatggcttgtgctgtaagatcgagaatcgataagtgggacctcataaagttgcaaagcttctgcaaggcaaaagacaccgtcaataagacaaaaagaccaccaacagattgggaaaggatctttacctatcctaaatcagataggggactaatatccaatatatataaagaactcaagaaggtggactccagaaaatcaaataaccccattaaaaaatggggctcagagatgaacaaagaattctcacctgaggaataccgaatggcagagaagcacctgaaaaaaaatgttcaacatccttaatcatcagggaaatgcaaatcaaaacaaccctgagattccacctcacaccagtcagaatggctaagatcaaaaattcagctgacagcagatgctggcgaggatgtagagaaagaggaacactcttccattgttggtgggattgcaagcttgtacaaccactctggaaatcagtctggcggttcctcagaaaattggacatagtactaccagaggatcccacaatacctctcctggtcatatatccagaagatgttccaaccggtaagaaggacacatgctccactatgttcatggcagccttatttataatagccagaagctggaaagaacccagatgcccctcaacagaggaatggatacagaaaatgtggtacatttacacaatggagtactactcagctattaaaaagaatgaatttatgaaattcctagccaaatggatggacctggagggcatcatcctgagtgaggtcacacattcacaaaggaactcatgcaatatgtactcactgataagtggatattaacccagaaacttaggatacccaagatataagatacaatttgctaaacgcatgaatctcaagaacgaagaccaaagtgtggacactttcctccttcttagatttgggaacaaaacacccatggaaggagttacagagacaaagtttggagctgagatgaaaggatggaccatatagaaactgccatatccggggatccatcccataatcagcttccaaacactgacaccattgcatacactagcaagattttgctgaaaggaccctgatatagctgtctcttgcgaggctatgccggggcctagcaaacacagaagtggatgatcacagtcagctattggatgggtcacacggcccccaatggaggagctagagaaagtatccaaggagctaaagggatctgcaaccctataggtgcaacaacattatgaactaaccagtacccccagagctcttgtctttagctgcgtatgtatcaaaagatggcctagtcggccatcactggaaagagaggcccattggacttgcaaactttatatgccccagtacaggggaacaccagggccaaaaagtgggagtgggtgggtgggggagcgtgtggggggcttttgggataacattggaaatgtaaatgaaataaatacccaataaaaaaaaagaaaaaaaaacagcagcagctttggctgggatagctgttacagcatttctaagtgcagttttcagacaccagcacctgcaaaggttcatcctgactttatttgctattcatttggttatagaatatgttgaaggaaaaaaattagtcattagtatagaaaagtatataaatcattgcctaaaaaggccaggagcttttaggagtagatgggcttcctagaaccacagaagaacgaatggcttctttaacctagtgcgtgttgccatttgaatagggcattttcctgagtggatttgtgtccttttcctgagtagggctgttttcttgtgtctctgggtcctcctccccacttacctctggactgcaagcgtttcttccaacatggagccagcaggtagtcctctttcctccttgctatctcatgaaccctgctgtggatgtgcctactttagtagctggcttctggggtcaggtgattctgagcaacagtctctgccatacagcataattgcatctcttggggaggagttaacagacagagttagcagagcaggttggttgctcctgggcttcagcttccacggagtgtatgtgcagccctcttccaagctccatgcagaagacactcattagtaaatcttccacaacaattcttttttgtgagtgaaccgagagtgtgaggctctcctcgggcactctgaggctcacttgacagccttgctgaaactggtcaacactcggtttcccctcaaatcattactcagtcacccgagatgctcacaaaagtctccatgctggataatttctagaaagttggtgctagggagtcagccgaccgctaggcaggcttgattatagtaggtctcttttcttacctttgcatttgggggattgacatatgattttctaagctgtatatttccctttgaactcaaacaagacctttataatctccgagaaaatgtgatcatatctttcaagggtgatttttaagttttttctgtaactacagatactttaaaattaagtaaacatcagtaagcctaaatatataggtaaagcttaccttagggaactatcctgtttctatttaacttgatcccacttccattgtcagaaaatggaagtgtacacgtgttcagggtgactggtgactggttactcattcctgaagaaaactgatgaccctgttctcagcgggcattgttgctcttcatctaggagcaggccgtgtgacatttccagcacaggcatattaattggtgttgtcattgtgcaggtgttatctaggcaaccatattgttgaaattttatgggtacaactttccttgttatatcaaatatatactatcaaacaacaggcacccatgtcctcttacaatattcctgatcacttttatgcagtgttccctcaacctaggtgtatagggattctattgcgcatataccagtaggctgtgtgtgtgtgtgtgtgcatgtatgtacatatatgtatacagtaataataatttcaaaaaagaggtcataagtttgagagggagctggagcataagaggagatggagagagaggggttgaaacggtataaatacagtacttcttgtacaaatgtctcaaaaaattaatgacttacatttttaacaaaatgacagttgagaggtatagaaaaaaacattttaaagaaagtttaggccatccacctgtttatccatttagccagagcagaaacccatagcaaaaaccctattgggtttttggtggatgtagtgtgaagatgggtcatttctttaaaaaaaaaaagaaagaaagaaaagaaaagaaagaaagaaagaaggaaagaaggaaagagagaaagaaaaagtttacccattttgagaactcaacgtatgtccacaaaatagcagcagccaagcaatctgggaaactctttaaagtcctagatctcaaacttgccccagaattttaaaatatgaattgacattttttaaaaaaatccccaaacaagaaagccacttctctacttacctttggaattccccgggagctttttataaagcagagatttttttttttttttttgcattctcctattccaagttatgatgtaattgatgtggggtttggcctaggccttgggcacttaaataattttagtgtgcagccagatttgagagccagctgtctgataagatccctttgcactttaaacaaaggcgctcaagatgagatcatagtatattcttttaatcagattacaagccaggctgcaaatttgtcttttttcaacattcaaagagactaactagcccaaggtaaatatatcaagtctcgtttctacttcctgctcagatggacctcactatggcaacaggttgtctctgatgctctccgctggtccctggcacaatagctatgtggagcactaaagtgcttcatccaggttccctggggctgtgctggcatcgctgaacagactgaggcatgatattaaagtctgggtatagcctcctccttcagacacaccctagggccttggcttgcatccctttgtcccccttccaagaatgagctcttgccagggtctagaagtagttcgtcctgggaagaagggagtatgagtggtgtatcagtgctcagaaagggtgtgagtggcagggcttcacaaggtaataaatagcatggggggtttaattaagacatgtccttgtgctgggatcgcagctcaggtggtagagcatttacctaattgttcacaaagctgtggattcaatccccagtttcatgtatagcaggtggtgtagtgcaaacctgtaatcctaccacttggaagtttgaagctgaaggatcaagaggtcgtcctcagctacatactaagtttgcagctaacctggaccatgtctcaaggagtgttatggccgctttatccctagctatttagtccagcctatacaatcgcagtaatgattacaacaaccattggtgcactggactttacaaagatcttatgtaacaagaaatagatctagagagctctgattgtaccacatagcttatttactctcttcttctctcttgttccatttaaaacacccaaggaagagctggagagagaaggggaaggggaaagcgatagaatcctattttaattcaaaattttaaaaacatatcagacaaaatagggcatggcaagtttgtgtgctagcatgtcttccttatttgtgttatgcagctaacccaaagcatagcactaggctgtaagaattcccaagactcagtcctgtggttcttataagagaagtcagcatttgcatttcatgaagaagaataccctattctagtggatagataatctgcctagctatgagaaatagacaaaccatttttgacattttgttgagggcttgatcatggaagagggagcattctttgtcagaaatagaatatcctttcattctcttcctaacgcttcagttctccctgccacttctttgatgccaggagagcttattactgaacatcatttttccaggagctttcatctctccggtgggaccaaccttttgacatggtgacatggcattgtcacatacaaatacatggactgcgttcctagctatactgggatgcacaggtgggccccacttgatagtggccgtgctttatttccatccgcttcatccacaggcctgtgctgccctttctcctccttagacactgaaaatctgctagagtgactggcatcttggtctatgcctgttttcatgattagtagtgccttgggtttggaaagaaattacagtattttggtcacattgtctctttgttcagtggtcagctactgcctggattcctaacttcactaggttcctgctttgaggacataatcactttcaccctgaagatgttctggacttttaagttgttgactacccatttctctattctgtccctgtcactactaggaatcacattgacactgctctcagatgactgctgtagattctggtctgtgcactcagctccagttcttggatgttcactgctgtgatcagctccctgctctcgtgtttctgtgtcttcacactcagtgatccagccattaaccttctcatggcctcactgctcactgcccccacccccacccccaccccaaggcttcccagcttcctgcttatttttaaatctagccaaacctccaggacagtgtctcctcgatgtttgggttcactgtgtctgcttctcctttgaggctcccaagctggagagtcccatgataactagacgattttctcttactccccaatgactctcctatcttgtacattttaggtcctcaaataaatagaattctctgctgttttatacttctggaagtgcagtcctcatatgaataattctctcttcatcactgccatcaaattcctagttcttttatctgctatatggcaaaggacttatttttacttgtcactttgccatcagtttccccccaccttcccgccccagatccttataagttagcttcattgctacaggaacatgttttggttgtctgtaaatcgctaacccactctgcatatccgaccctgtgcctggtgtgtgctctgtagtagcctccttccttggctctccttcatccccagccaccctggcaggttttttttttttgtgtctctgctgatctcatccatggaccttgtgtttttttcttatactcatcagaacaatagacacattgtgtctgtcctttgcaccctctggctcttgctttatattacatgataattatatgctagcattttcctttaggagcagagtttagataacccactgaagccactgaacccattacttctggaagacatgataaacatgtctttgttatgcactggtttcccccacgtagagatgtttgaggtctcaagtgatgctggataggctcttgcgtattacatttttttttcctcacacaggaaataaaatgattgttggggcactgtttgattgaagctgaagtgaaaaaatggtttcataccatttaggaactttaaaagaaatgtagcactaatcaatatttgcatgtctttgatggatatgactcagtatcagatgagccaaaatgaaagacaaggaaagcccttatgtaagcaaaccctcctcacatgcaaagatgtgagatgacttgaaaagctgataatgaatcctggttttgtgtttgttttttcataccagagcatatggttaagaactattacccaaataccactttgggatactgcatgtctgttttccacatgcatctctaggctctgggagtaggtatcatgagactgcatgtttaaagtttagtacctacagaattttaatgtgcttttgcacttaatagatacttgttggagtatggtgaagtgcgaattaacacagaaccaagtgttagggaaaagaagatagttatcatatttgcctgcctaaagatttaatttctaaggattgattcatgataaagacattccacccccttgcctactttgtaaagttttctggtatcactgataacatttataacgtcctcagaagccatcaggccatgctaccacattctcttctttggggattgatgctagattgtttaaagggtgacataacaagggacagaaccaaactatttacctgaacttatttaattttccagaaagatcagcactctctcttgttggaagtgttttgaacccttgttttgctctgggtaaatctgaacttggtgcttcttgtatatgtgttctctggtgttggtcaggtcaagatgatctccaaaatctgcattgtctttcaaagggagacttcttccttgagaccaatatcacaagggaggggaagatgatgatggctccttgcagtggggttagtccaaactgtctgcataatccaaacatcagactgcaagagattacagatctgagttagagccttcatcaaagtgcatattcatcatgggagaccattgtgcaacgggctaaggagcataaaggtgaaaaatacgatgtgtagcccatcttgttggaacatccactctagcaaaacgcatatgaaccacaaatccatgcctgtagttctcaggccctcctgtccttgtctctgtccttgttttagaagatgatggagtaactccacagcccctgagcaggattccatctctttcttgatcatcatcttactttgagtataacttttaaaggtctgtgttgccagcactttctgaaaaatgttcactgacttttggttcacctagacatttgcagttttattttaattcaatggtagtatacttatttgacagtggtatgtatgttgtacatgcactggaaagcaatgggggggggctttgctgtaggctgagtcttggtttagattacaaaatggatattccactcaaaggatctagaggagtttacttccaatgatttgcaaagaagaaaaactggggggggggggtctgtggcctgaggttgcatgcctagggttttcagggtagaagcctgaaaaaggtgaagtcttacaagtcttgctcagtgccctctacacagccactggtacagtgtacagcacaaatagctattgaagaagcatttaatgggtggatggaatagaagatatccagagatctaagtgaatgagtaggtaggttatggtgaatagattatatagacacatctgtgccctgttgatatcaaaagaaggtgaaggagacctgtatgctaatgaacttgagtaaaatgtaacatttttcttcttatttttggtggctgtcacaaagccctttttaagtttgacaagcattgtggcagtctatcaatggggatgtttgtgcatgtggtgttttctaagccacctttgcaattagtgaaatgctgttgtttcagtaaaattgaaatgaaaaaaaatgcagtctctcatctttaagggaataaaaaaggcaactttaagctggacatggtggcttacacacacctgagatcctggcactcataaggtagggtcaagaggatcaataattcaagacttgtctggattacatgagatccagtctccaaaaacaaacatataaaatgaagttaaaaacaaacaaaaggaggattaggatcagggcatctgaaatgccagctgagctttgaatcctggtgggtagcatgtattatccctcctgactttgaattccgtgctaaattagtaaattgtcgcaatgatagcaccctgaaggaatgggttccttgggataggcatgtacctgaaaggtacaacatttgcctagtacatataggtccctaggttccatccctagtaccacaaagcaaagaaagaaaaacagagcttctacttttccataacaggataccatacctttctgccgcccatgtcttactttctattgtgctctttctaggactgcatcgacgtaggctggtgggaaggagaactcaatggcagacgaggcgtgtttcctgacaacttcgtgaagttacttccatcggactttgacaaggaagggaatgtaagtctccctggctttgatctcagtgtctccctttctgtcagaattgtggcttccatgatgagacttgggaggtagagatcttttggtataaaataaaagagcagtgacatttaaatgtttaatgggcttgggttctgagcccctggctgccataggacaaactcatcataccagctggtgaatgttcctcacagtttaatgtatacggagtactttaagcagtacctggcacgttgaaattctcaggaaagctgccagaaccctgaatgtcctacatagtaagaaaatacctcctgttttatatagcatagtcctttggggtgctgaagtagccaatatttaaagttgctgaaaattatattttgagactgagaatggagagcacagcttgttaattttatattatatttgcatatgtgtatacatatacttaaatgcatatttatatgtctcaccaaggttgtctctttctttgtgggaactggtttgatgatggatactgttgagatgacccattctgtttgccttactctttgtgtattgtctctcggctaatgatttaaccaaaaaaagaaaaaaaaaggtgagaactagaagttctttacagtatgaggggacagctatttgatctcatctacctaccctcttccttacctctcagcctctcactgacacttttgcctgatttctgatctggagtctcttcagatccagggagggtgctgttcctggaccaggctaaacctgactgtattattcagttttctagttgctgtaacaaagtatttgacaggtacaacttatgaaagaaatggcatattttgactcacagttggatattacagtccatcagagcaacaactggtcatagggcatgtcaagaactaaagggaaacttcctaatagacatgcttagaggtttgtctcctaagtggttgtagatcttgtcaaattgacaatattaaccatcacatcaactttgatacatcaccattcctgagatgatatatggtaaggatagctacagtgctagtagttagttgcaccaccacttaatggtgtctatgctgtttagatgaatggatgtatttatttaaaaacgtagcattgttctagcatctctaacaaactccaaggtaatgttgaaactgctggtcctttgatcacactttgagcatcagggttccaaaaaagcctgaagaagtaggatttagactctcctgagctttggttcaaataccaagagggactgataggtatatagactacaacatatttttcacgttaaacagtccaagaaacaaagctattaaaatgtattaacaagcatggccttggattttaaactcatttggtgatctaagggcataatcttgggagatgcctcaaactgtatccagtagtgggtaaattttcctgtacatattaaccattctagtagttataattactatctgtaagggtagggggaagctagccacaactatgatataatgctaaaatagtaactctggttctttttgcttcagctgaccaaatcaactcggtatcttgattttcttggttaatttccctgggaatctaaatgaggctaagaattttgatgagtagccattaaaaagatacccagtaacatgtaaaatgtacttatagagataaccaagcaaagaatgacacactcttcatgctgtttctcatatgtttcctggatctgttgcctcatgattgtgtttgagttttcagtcattccttcagtatttttggaaacttttccctgggctggcctgggttggccttcatggtagataaatagagatgaagcatacggttcctggccttgttgactcagagttgggcagcagggctggcctgcaaggctttctgaaggattctccctgtggctgggcctcagtgagtggagcacgggtccatccacatggcgtgtggtacccttctttgcccatctttgaatctagaaaatcctttgttgtgagtccccctcctttggccactctgctaggttttattatctaattagttcagactgaggcagtagcatttacgttttttaaaggaaagctgcaagatcaaattgcaggtattgaccatgtaaaatgatgttttgaagtatccacaggccccccccccatatccatagttgaaccagccatagactggaaaggttttaaaaatttgtctgtgctgaacatacacaaacttaaagaattattccctaacaatgccctgtagcagccacttataagtaatctaaatgtgattttacagtaaatagggactaggttatgtataagcagtataccattagataaagggccatagtaccagtggatctttatgtccataagagatcatgtaatcactcaaacacagatgccaaaaggttattatatatttacatcatggaatgactaactatagctaagcaacatatgccttccttcatataatttgtcatttttagggtgacaggagcatgtttctgaagactaaggtaaacactagaccatttttttctgacaaatgaggaaaacccacagttggctctcttgtggtgctctgcctttaaattcttggtcttattttgttgggaccatgaattcactcatacgagagagactctatgtatagtgtactgttctagaagctctttgttacataagatattaagggaagtaactgccacaggagagtaaagttgtttgtgctgagagggcatggcatggcctccttgttgaggtgtgcatattttgtagagccccatgggcatctctgcaaccccagataagcagccatcatctcttttttaaacttcatcctcacaaagcagaaaactcagttttagggatacaatagtcatacctgtcagataactgaaaagtaattttcagatagctgaaaaggtattgtctaatgtgacatttgggttttttgaaatttcaaagtagaaaatccctttttcatccctgctggcttacaaaaccaatgggatagctgtgcacccgttgctatgccagccttttttttttttgctacacctagaatactggtgagttgatgacaatatggtctggccaggagatgccactttctgaattgacagtataaagatgattagaattattaagatgaagatgctgcatgggttatggtgtctgaaacattctgccaccaatttcagcagatgtcatcttgtctcaccagtgactagggttacagtcatccaccccagtctgcaatgatcccgatagacagaagcaagtcttccgcagcaggcttcttgactcagcaggtatcatcagggcatgcttttgagtctggcatcttgtctgccaggatgtagactccagagagtcactatcaggccctttgcaattcctggtggactttcttcctgagaacagagtctctctccagcatggcaagcattctgtggcttttcctcaaggcattccaggagaggatgtccattgatctcgtggtgcatattttaaagcagttatgtaagctatttaggagagaacctagatgcaatcactgtttattttgagccttgactgtacaattgagcatcaggatggaaagatgaaatattctgagagctctaatgaagcaaggtgcatgcgctgtcattgtgagtgaagtgtaacaaggagctaggactgatttttagaatagcagggacagcatcctgacaccattagaaagagacaaaggttaggttcaatctttggaaagactgtcctttgaagggtagtgtttcaggaatatctcaggctgtgtaccttctaagagaagaaggcagattaccagacactgcaggcccattctagagcatgttccctgaagaggctctttggagttggtgccatgtcgcaaatggacacctctaaggctcccccaagggtttccccagtgaatataccacagtgaaccatttgcttctcagccacagggacttagaaacctgccatgaagatgtctgcctctgccactgtgactcagcctcactttgcctgctcccaggcttatacaggcagcagcaggctgacagcttacagcgactgagaagtgcaaggcagtcttgaagacatgggtctgcctgccctgggcatttgcccccaccactgtgggtctaatttcttaggatccaggtttcacaacaacaacaacaacaactccagctttctcttggaaggctctccatgtgagaggaatgaacgtttcttggaaaaagccaggcaggtatggcttgaggccctcttcacacatggaaggagaaggtttgccaagggagccatgtgctgagttcggctaaacccagttgttacaagatcactgttctgttggctttgacagcagtgtttttttttccatattaaccactaaccagggtctgggattgcagttcaattggcatagtgcttgtccagaatgcagagtcctaaatttgatccccaacactacatagtctaggtaaggtgttgcacatctataatcccagcgctcaggagatagaggcaagaggataagaagttcatctgtggctatatattgagtttgaactcagcttaggatatatgaagccatgtctcaacaaaaacagacaaagttaagccaagcatctttcatatgcctgtaactccaattctgagagggacagagacaagaggatctccagaggttgctggctttccaacctatccaaggaaacatgagactccatctcaaagggaataggtggagagtgatgtcagcaggcacccaatgatcttttctgacctccatgtgactgcacaggtgtgtacacgtgtgtgagaagctggcagggagaaacatacacacaaagagacaggcaggcaggcagagaatgagtgaacgaacgaacaaacgaataagtgaatgaatagatcttttataataaccactgaccagatccttcctattcataccaacctctaggcactctgatatgatcctgtgatttcccacattctcagttatagttctgtgcctatacatcctcataaatttgttctagatcaagcaactttgcagatttcaaacttttataaaaaaggagtttccatgatgcttaatccaccacagatgagttttatagcattatttctggctacttttctctttgccaagttcttaggagctcccatataatgacaacccagtttgtaaatttgttcttagccaatatttttctcatccctaggcatgtccattagccctcagagatctcctgtaatttttctacattctaaatgtggccaataaaaaattaaatatatgcccccccatataaccagttttaggaaaataatccccttacagcatatctgtctcatgtatttagtttctctgagtggtctcatacacaggaattgaatttgtcaagctgtttttttttatttaaacaatttttattagatattttcttgatttacaattcaaatgctatcctgcaagtcccctataccatcccctaccctgctttccaacccacccactcctgcttcctgaccctggcattcccctgtactgaggtatataatcttcacaagaccaagggcctctcctcccattgatagcctactaggccatcttctgctacatatgcagctagagacacgagttctgggggtactggttagttcatattgttgttccacctatagggttgcagaccttttcagctccttgggtactttctctagctcctcttttgggagccctgtgttgcatccaatagataagtggatattagcccagaaacttagaatacccaagatacaatttgcaaaacacatgaaactcaagaagaaggaagaccaaagtgtggatactttgtccctccttagaatggggaacaaaatacccatgtaaggagttacaaagacaaagtttgtagctgagactgaaggaaggaccatgcagagactgccccaccccgggatccatcccataatcagccaccaaatgcagacactattgcatatgccagcaagattttgctgacatgatatagctgtctcttgtgaggctatgctagtgcctggcaaatacagaagtcaagctgtttttatgtcacctatttgataaagcctcagtggttttccccagatggtatcacctcttccttccccagcagtatttacagttctcccagttgaacatctcatttgtcatattcttgtctatagggcttatatttcattttccagttggaacttctttgagctggtgtaccccaagcttctccttcatcataactatagtgtatatggtataaaattggcagataataggatctctttgtgttttggtattgtgtcaaatatgcctactttttcttatgcgctttctttcctgtccattgttcccttttgtactagtataaaagaaaaggaagaaggaagagggaattcataaagcttgctcctgtcacattccactatctagacaaagggatgcccaggtccttccactagacataggatctggatatataattaagttcttacttgcagggtgggctgaatggaataaaggggtgtgctgagataacctattaggaagaagctctattacagagcctagatgaccctaataggccatgcatgagattgacccaaccataagagagactacagatgcatacaatgtggctagagactgagataggaaaccagcaagagattctcctgagaggaggttatatgatggttcccaggcatctcctgtgcagatgacagtgcagctagttgtttgaactctagaaggtacagaggagcagttatagacattaatgtcactcagattgttgtcctagctccatgctttcaaagtgtagtgggtcctccagatacattggcacagtaatagcaggacagagcctcccatctttctctacaattgtgatgggtgccctggtctggaaaaacccatttgtagcctttccagtctcacatcttagcatgatacatgaagatgttttctaaggtccaaagttgctaaagatctgagctacactttgtttacctcttcccctaaccaagctctgattctgtattaggatttaaataggcttgagctctgttcaaatttgtgttggagcttggtagcattatatcctgaccatagtttttcctctctctactcctcccagtaccactggttagtatattattgaagacacctgactaattttttcttttcttttcttccctttcttttcttccctttcctttcctttcctttccttttctttcctttcctttccgttccttttcctttcccttttttttttttttggatttgtgagacagggtttctctgtatagccctggctgtcctggaactcactttgcagaccaggctggcctcaaactcagaaatttgcctgcctctgcctcccaagtgctgggattaaaggtgtgcgccaccacgctcggtgttaattttcttgagactgaattagttttcatgaaaataggttgcaatcctgcaccacacttcgggttttcttgtatgtgggctgtttctacctgtactttctgcccctcccactttctggcaggagtcgaagttgtagaaaacccttattataagccaatcagaagctaacactgcatttttggactttcagaatgaagaacccaaataaacttcgtttcttcataaattactcagatttaggtgttctacagcaacatcaaactggctaagccatctccttctatctaacgaaccatcaggacctgtcctcagactatttttagcaaagcatatctcagtggtttggaggggaggagctataaactagttcatagtgcaaagccacagatgacagttcctgccaggagaaagcagttgagccagatgacgagctccttgggttggaacaggcaagtcttgtcaaacaaggggcagagtcagttttgaaatccttcagcaggaagcagtttgccttcctgttatccatactctggaaccttcagatatgtttccttcctggtactgtaatggtaataatcaaatatagctggtttgtcctttgaaggatggcaggttatttccgtttgaagcatatgcagtcagaggtgagcatacacatacttagatctatgtgccctaaatacatgaggtcacagaaggctttagactccacaacaaatcaggaaatgttgcctctctgggttttattgttactggtattttcttgttggttttttaaaaaaattaattctctatgcctagacagtgagtgataaggtttttagactcccttggctaccagctgattgttgcagtccccctgagcatcatcaccatggcgggggcggggggtggttcctcctatactcatggccccacatccactgctctgttttcagctcttacctagaagtcaagcagcctaaagccacccaagtttggaactggggttttggtctttcaccagggagagagggatgagagaataaatggaatgattgattctaaaaatgcagaactttaaatgctcgcctgagttgaaggagctagtttgtatgtagctgttaaactccacagaggatccctagacctactgctgaacctcatgccattgccttcttccagccacagttgaacattttgaagaaaagcaactctggggtctgttcatctctgtttcttcgagaatcagcaactgctgtgtttctttattattgccacatttttgctggtgatttgctgctctgctttttctgtcctcgtcacccagtttggcatattaaaatacaaaagtaggcccatgtgcagtacttccaagttttgaggagttagtctagagccatatgggtcttgaaagtgcaaggagggggatgtgggagggtttggagggggaaagggaagagtgaaatgatgtaattataatcagttgaacttactgaaaccagagaaagtggactcagtccaaaagcaggatggggtgggggtggggagaataaactccctctgctagctggtacctatccagtactgacagctcatggcttgcaaactagccctttcttttcaatcctatccgcctctgcagtggtcatgacactcctcataaatgcagaccccgccccctcctgttgccacgctcacaggcatactttttgggaccacttttcacactgtctgttattacaaaattttccatcctctctctcaccctcctttgtcgtctcttctttttcttccacccaattccttccatgacacatttcatgtatcggctgcagtccaaaccttacacatcaagaggttttggttttggcttggttttgtttttacatggcccagtaatcacagaaagtgtgatagtttgaaattgtcattaccttttttattttttctttccccacgtattttgaggcaaggtctctggggtaacagcttctactacagaggcttctgtgagattgtttatagattattttaaactagggccagagagatagctcagccaggaaaagtgcttgagtttgatccctaggatccacagagtggaaggagagagagagagagagagagagagagagagagagagagagagagagacagactactctccagaagctgtcctctgatctctgcacacgttgtggcatacgtgtgcaagctcacacacgttaccatgtgcacaaaaataaggaaaagaactttttttttaaaaaaatgaagagtatttcaaaccagcaaggatggagaaagacatccagaaataggcattgttgggacttggcaaggaagaattaggccatagggtgttgtcagtttcatgactaagcagtacctctgatcctggggtcaaggaagattaaatggcaaggtctcagcaataacttcattaggtaaaacatatatccattcccaaactagtttataccaagacagaggaggacgcaggacagcgttaatagggaactggaaaaagctgacaaagggaatagagtactgagagagcctgagtcacaaacacacccactcagtacagggcctgtattcaagggcaagaggccccgagagcagcttgctttttcctaataaagatcattgtctgcttatgcatacagcacagggaaatatcaaggaggaaacatacccaagtgctagtcagaaaccaccactttaaagagacttcttttccactcgttctaccttttttttgcatgttagagcataggtgagctcatcctgtagctgccatttgataactatttcctccttgcaatctgaccatcgtactgttgcctgtgctttgatgaattccgtgtgtatgctattatgcctgcctcatggctgttctccagcactgggccttcatagtggttagcagtgtgctatgggtcaaacagccctgggctttacttccagttccctctaccctatttaataggttgcttcatttaatagattggtgaccttgggaaatgactttctctcaattatttcaacagcaacatgggcatattaataccagttcctcatagagttgctacatgagttacccaagtcagagattactaactcttcttgcaaaactatcgtctctcaagttgaaagataatattaatggccatttattggtgagaaaggagtgctaggtgagattgcttgtcatcatctaataacagagatttgtactgatcttcagctgtcagaaccctttgtctttcttaccatgctatagtctttactcagagtaatttgctggagtcagtaactaatgaagaatcaggctgaaaatgtattgaatccagagcgtgaatgctatgatggcccctcctcagataaaaacacataaacagataaagacaagaacacatgttcttgtgggtcttgtatactctggattttattggaaacatgttctttctgcaatctagtactgtgtcagagaaaggtgagccagagtaggggctaggtgtctgccttttgtggtccctgtggtaatgtcacactacaacgtttttcaaaaccagaagatactctttgtaggtttcttagaaccacaaatatatggtgcctgagagagtaaggagtgtcaatggtgatgtgaagcatcctccctcatcctcttagttccccgaatccttccttagtggtatcacactggatggctctcccccttgcccttatagcatcacagtacaagatggtacctggctatgatttctgatcactgaaatgtttagccagttcatttttgtccatctccctcctatagtcaatcttggatgacaaagaaaagcccacaaactctgaaaccagttcagggatgaatactattgattgcattgctacttccatcacctatggaggagcaatgtgtgataaaaaaaaaatagtgatccacttaaaaaaaaacccacatccattccaatttagcacatgtagtaaggtataaccactgtatgagagatctcacaaatgaccttccttcctcggcataaaaagaggcaaaaccgggggggggggcgtgctggggggggggaacacttgccaggctgcagtagaatcttggtctgcatttagttgaagggtccatacaccccatcagatttaattttgagtcttcatggtcactcttgttgaaccaaaaaaacaattgttattcaactcattagattttttttattggatattttctttatttacatttcaaatgttatcccctttcccggtaccccccccaagccccctatcccatccccctccccctgcttctatgagtgtgtccctccacccacccaccctctcccccctccccaccctccagccgattaaatcttaattgcaaatgggcttcagcttaggggcaccattgtgcttgctggtttcaggccatttttgctgaactgagcttttctacaaggctgttgtaaatttaggaagagggaagctgtgtttcatttgttggtccgagttttgttttgctgattgaatttgcttcagtgtttatttagaggtgccaaaagaaagctggtgtctctagagagagaattgctcttttttttttggagaggccccttaaattgtccacgctgtacatagaaaacaatgtctgtggtctgtctgtgatactacagcttgccaacagtttcatgtgtaattttgattgatttttttttttcagagacccaagaaaccgccacctccatcagctcctgtcgtcaaacaaggggcaggtaatgtacctttcaggtccagcaaacaaaatgttcgtctttctttttgcacaaattcaaattttctttgttaaaattcaagatttttggatccacagactactggttttggggttgttgtgatttggtctcagcaggcaggttttaaatgagctgctgtctttcctagacacaaataaatgaaagaactcatatcactaaaacgtgtctctgctacagtgcagaaattggggttctcacagagattggccaggaagtactagaaaatgaactgggtctttttttgtttgtttgtttgttttgcaaacaatctgcttttgaggagcaaagactcagttattgtccttactgaggtcggtttcccatgggatggcgtcattgtatatgaacagagagttgctggggtttcgctgtctttcctatgtggttagccaaaatttgcacttacttcacttccaacaacaagatggtttttctagccatagatactttccctcttgattattttctagtcttgaaaacaaaatctagtccactcattctgtgtagtttagatattaggtatgaaaagtataggaagaagtgatgtccctgcatggtggattctcatacagaaagatgatggatggtgcttcccaatggaacactgttttaggatagtcacacttaattgtggagagaaattccttttgtgaatgactatttaagtggtttgttaacaaagtgaggagggaaagggacaagagaggatctaaagacaatcaaaccacatgccatacatgtatcaaagtgttacaatgacttctaactaagaagtgattgttttaaaaaaaatcaaagttttttaagggactacaaagaagtgatgtccctgcatggtggattctcatacagaaagatgatggatggtgcttcccaatggaacactgttttaggatagtcacacttaattgtggagagaaattccttttgtgaatgactatttaagtggtttgttaacaaagtgaggagggaaagggacaagagaggatctaaagacaatcaaaccacatgccatacatgtatcaaagtgttacaatgacttctaactaagaagtgattgttttaaaaaaaatcaaagttttttaagggactacaaatttagaggaaaaatctatttaagattacatttctttcttacttattgggtactaattaagaactacagagattaacattgggtattaattctacctcctgttctacctcaattcccactaacattgaacagtttcattttgccacctagtggctctggctatataaatattttattgtgctaagattaaaatagactagtcgtgtgttttttctctgaagacccttttctctagaggccttagtaataagtcagagcccaaggcatccaactgagcagtttaagaattgggtagcctagaataaagtaagaccaggttcttagagatagtagaattgtctttagaaatgagactttatggtaggtggtagacaaattcttttgaaataattttatcgtatttgcaatgaatctctcctgggtaatgcataacagcattttgtcttcttgctcttttatcttgaagtatcttgagaattgctttgtaatgaggaaatacatagatattcatattcctattgtgataggatatattaccaatgtccttttaccaaaagaacccaggcatgtaaatgatataaatcagaaacagtgtttaatgtatagtgtcgttaaaggttgtgtcatatgaagtatgtgttcaatgaaattttaattttttttaatctcttggggcctcataatactgatttcaatgcctaacacccactcatggggccagtcaggtggccagtcaggtactcattcaagtctatcagagagtactttggactgttttgtgctgtagctagttcccagtgctcttgtatgcctgaggccaatagcaaagatgaggccctcaggtgagggagcagtggcaggccataagagcaaaggagaaatttaaagtggtgtatggggaaataggtaatacttaaagaatgcaggcacagagaaaggatttagggaaaaccactgcaacaaatctgcatattcatcaaaattatattctagatatttctggtgtatgggaagctactccaaattttgtggtataaaataacgatctttagagagccatagattctgtgggctaagaatgtgagtagcgcatgaccagaatggttagtttctattccatcaggcctggggcagtggtttggaaagctgaactagctgatgctggtgtatccacctaagagatggctgcctcattcgcgtgttttgctacctatgttaggagtgactgggagactgggcttagctggggctgaaggccagagtatgtttgcatggcttctctgaggtagttgacctcttatatggatgtccaatattccagcaaataaagtgtaagctaaatggcctcataatgtaaccttggaaatagggtggaattatttcaactactggtccaaacatttgcaaggctggccccattccagccaagggaatatacacaatgcaaggtctatccaacaattcctggctatatacttagtttataacaagagagagtctagatccttatgaaacctgttgttatttataagatataataagcttgttatgattccttatttatatgttttgatgagtaaattatttctatacattctgcatgcctacttcatcatagtctttgacttttaatgtccaggcaaagagtgtttaaatatttaaaaagagttatggtgttttattaattaaatatttataggcatgcaaattcttcttaaagacacagtttctctctatatacatatatctatgtctatatctgtctatatattccctatttggcctagaacttgtagtgatcctgccttgtcctcccaagtgccaaatatataggcacgtaccatggcacctgcctatgcaagccaatttcatgacatagactagaaatgagttctgctatgtttctgaacaattaagaactgcataacaccagcaaccctctcatgggggaaaaaatctattgcctttgctatacttgataaatatttaaatgcggatgtgtcaactaaataaattcagaaaacattttctgattgcaattagcttttacctcctaggtaccacagagagaaaacatgaaattaaaaaaatacctcctgaaagaccagaaacccttccaaacagaacagaagagaaaggtatgagatcagttcttcactggcacctcttgagcagcaagctgtgaagccgtcatggcgctaatcccgattacccacacagtttgccttttctttggaatatggtgactacgggtttgttttgattgcttccaaacatctcactttgaaagaaatgtgatcggttgtgtggcactttcacagggacagagtttttcatcaaatcaaaaccaaccagcccagtcattgaacatattagggcttttccatgatgtgtctactattgccatcttgcctgtaccccaaagttggtggtttgtaagttcatcaagggtcctgcacatatctgatgctttctatctaatccctccacttttctcagtatcttgtggggaggggttcgtgtaccattgataggtggtcttgacttgctgaaattaccattcagacaaatgaaagccctcatctttggtcactgctgggcccttgactctggctaatagcattacagatacatattcctggccaggaatattgaaggggtggaggtgggggggggggatggtcatactgggaaaagcaactcagtctcctagtcgtcagacagagtttaggaattccattggcagagcggtctcttcaaacctcatgcagtcaggttaacagatgcgcttgattcccatcactctgggtgtctttcccaaagaaatctgcatgccgtggaagggttccttttactaggtggccaagttttgactgatcacacatttttatgggaaagtgctatgttattatgaacaggaagccaagcaaattccattttaaaaaagcagttattttgaagtcacaagagaaatgctgaattaatgaatataattatctggaggtgctccttggtggcctcgtgaaattttattgcggaatttaatatttcacatcagcctactgaaagttttgccaacattgcaagctgttaaagatcaatgcctctttctttcttggtgagcaggtaaaatttgagtcattagaacctcattgtgaaggccaagcctgttttagagattagtgggaaaaattgctattcagtgcgtgccccatcaacagctctttgctaaaagcatgtgctgtgaaataactaaacacctaccctctgtcctcatggaggactctaatatctgtaccctagctaggctcatgatgaagatacttcattccttgtcccatactgacttccttacagatgtgtgtatgaacggccattctccttggctgaccaagttgccacaaagccctaagtcttcctcttagtctttgtcctatgccacagtgaatcggggaggcagaatccctagtcagaagcaatagacccttcagggaaccagtgtctgagtcgtagcatccctgtgatgtcaccagaatccatatcatgccatagtgcaagttactgtccctgtagcacagccaggaagttagctctccttaacattttagcttagcccctccttttctggccctagtgtgctagaaactgagtttatataattcctggtttgggtttgtgttcctttagaaatacaggaagacaagcccagtgataccttcatagtaccctaggaggcaccgaaagttgttgccacttggtctcatgcctgtgcttgccaatgaaaagtattctgaagacaaatacaggaattttacctgtgcttcaatcacacacacacacacacacacacacacacacacacacacacagaagttcagtctttattaataagaatgtgggttaatgttttttctaccaaggcaaggctagtttgagaatgggaaaattaaaactgccattgaacatcacccaatttaactaccatatctagattcaagctcttccaaatagctccttgactctagaaactgaccccacaatctgagaagtcccactctgtctttcaagttcaaaatctgtgtagagatccctgaacaagctatttcctgagcagtgtcctctcttcctggctgatgagcttctcagaagtttatctgagaagtttaagggcaactctttccctatacccagtagaagatcatgtaggccatatagtaaaacttatcaactatctatggaatatcagttgtatgccagcactgcatgggatcttaaggagatgttttatccaggctttaaaggttaagtaggagcttgcttagaggtcagtggcagaaggaccagcactagcaaaatcacaggaagaagagttctgactccttctaagttggctataaataagtagtgagtggtgctctcaaaaatggcatcaatgtgtgtgtgtgtgtgtgtgtgtgtgtgtgtgtgtgtgtgtgtgtgtgttaaagcagggaataagcaaggtattatctaaattttgtcactgacatgaggtctgtctgttttcttcatgcttgcttcctcaaaaaatgaactaaagaaagaccagagagagagccaaaactggatttacagaagccttcagttcctgccatcccaccaaaaaagcctcggccacctaagaccaattctctgaacagacctggtgcattgcccccaagaagacctgagcgaccagtgggcccactgacacacaccaggtactgccatgttctcaccaaggcgggtgggcatgggatgatcatgaaaattggcgaagggatgagaaccaagctttgtctaaagattccagccacttttttttccagtgagaaagtggttgcaaggtgttggggagcaacatggtgcaggttgtaggatcaatagatgagaactgggcacatgtcatgtagaccctgctcaaagccagggcattttcctgggatttgtcagaacaaggccagctgccttacagactggagatgcaggtggtatactctccttcatctcctagatggctttgcgcatctttgcatacctcgcttatagctgtgtcttctaactctagctattctgtggtcccttgagctatgccctaggctctgtctactcttcatagcttggtgtggagtacaagagctgcataccagattttcctggggcatgtgtctctgaactctaagaccctcaaagacatgcctggcaacatggtaatttcttcattgtcaagttctttactggctgtctaatacatgtattggtattctaaaatcagagttggtattgtgcattatagaattgtacagacaagaaactattgaaatatctctactagtttttacctagaactttctactattgaatacctgcataatatatgttggtgtgctacatcagagaaagtcagtaagtagccttgagatcttcacctgtgtctgtcaacatgctgaagtctattcttataagctgtttgcatggtaagcgttgtgtgcagcttctgaggtcctgtgttgaaagcaggcaatcctttaggcttgaatcttagtccacttctttgcaaattgttctttctaacttacctttcaccatctgtaaactgagagagacactgaaattcatctagatataatattccaatctgtaacacgtgcttataaagtaataatattttccttgctaactattaaactgtgtaaactgcagtaagacaatagtgtttacttaaatttttaaaaatgtggtggaactcacataacatacaatttatcatcttaaccattttaaattcatggtttgaattatgtatactcacatcattgtacagtcatttccagaggtttccccctctggtataagtgcacctctatacccattaaacagtgtctcaccattgctgccttcctgtagtcctagaattgattattctacttcctgtctctatgatttcaacgcttaattagttgatataagtagaatcaaagtgcatggctgtttttactttgcaccgtgcacttcctcagtgttcatctgtgttgtcacacggcccatttacttacaataagaagagcaacaagcgccctcccaatactgaccaaatagagacacttcatggcttagatggctgagagttacagaaaacatgtctgtctgtgggaggtagtctgcccagctgagcacagagctatggacatctctagagcaagtgaattagcattctgtagctattgtaccaaggttcaattgaaccacagcctctgtgaaatggcccttgtgagaatgaattggattatgacctccaatgttctggtcaggtccctatgtgtcataccctcttctaatggatgataaagagctctttgagtgtgataaggccacctgaaagtcccagtaacttgagcaacagccacatcagtgctgtgctcatcccagaagctaatacaccagaagggaaaggttatgcaaacagagagaggctatagagaatatgagctatccaaacagagagaagatatagagcaagaaagatcacccatcacgttgtagcttgcaaaaggacagccaaggacacacactgccaaatcctgttggtcttcagggactacacacatctcaatatagtcaataccatgttctaacatactcctgctgctttttataatgacctaatcaaacaagaagtggtattctcactacatccttgtctttgaaagttaccctcaacactgtggttatgggataggtgaagctttgcaagctagaggcagcttgtcatcctcactgtgctagcaggcccaagaggtcacatttacctcctgcctctgcctagttcttcttagcctccagttctccaatctactttgtgaggtaggaaggtggctaccaaggagggtgtacaagggctttctttctctgtctctgtctctgtctttgtctctgtctctgtctctgtctctgtctctctctgtctctctgtctctgtctctgtctctctctctctctctctctctatatatatatatatatatattactataatatgtatatattaggaaacaaattcttaacattgtcctgccacctgagtaagctataaaaagatagagatactttaacccctactcacgctgtgactgccaacccccccaaggcactagtctgaaaagaaaagggtgtggtgatgggggaaaggccccatgtttttgcttaacccattgaaaggagggcattgccttccttgactctgtggttctcaaacttgggcagactcgagaatcgcataaacaaaacagattgtaggactccatcctggggttctgactcagtagacctgaaatagacttggaaatttacattttgatttctttgttgttgctgttttggtttggtttggttttggtcttggtttttggttttgaggcaaggcctcgtgtagatcatgctgtccttaaagatgctgtgagtgcaaggatgactttgaacgtctgatcctcctgcctccgcattcctagtgctgggatgataagcatgtggcaccatacctggcttatggtgtgaactgaaccaagggtttgtgtatactagggcaagtacactaccaagtaaatggtttccccagtactggaacttgcatttctaaatagtttccaggtactgctgctgctgatgatggtgaagtctacaccctcaaaaccactgttttaggttttcccaagttgtgttgttgctcgcccatcctcctctgaccacctctaatgcacctgctggtacagcctgatgtctgtgccatgtcctcctctggaagtattctcttatctttcactattgctctcttcttgaaatgtctgacacctcatgtttagtgtggcactggggctgatactatgccacttgggatgtacccacccacagactcctttactggatttaaagcagatcaagagtgtgtttcatcattgccacatgccttacagtgtcgagcatatggtagcggctcgtttaacaaacacttgttgaatatcatagttctttaagtgagggtgccagtgcttatattttgttccatttgcctcttctgtgttccttctcaggctctatacaagctctttatcatgtgttccttatattcagagtagcctagtattccatggattttaagaagcaaaataataataatagtaataataagaaagaaagaaaatctcactgcaccttagtacttaatgcatgttatactttttgctaagtagttacattagaaaaagtgtggcatatatcagtttgtaaagttgttttatactgtcaaattgtttgtggtagaagtatgccaactgtagtcaagcagttctgggccagtgtccctctacagaaagggcagtgtgctgcatgaaacaaatcttcaccaagatttacctgacaagcaggctaacagcagatgattaagcgaaaggacacacagtccttgttggcaggtcttactggacaaggaagcactgtggtgtcagctgctgggtccagtctagggctcttcagcagccagcaagctgctgccatgtggtacttccagaagaggtttctgtctttcaagaggagtaagtctttccgaggggagggatctccacgaaagagaagcacatcaagggcccactgtatgctgggcactgttagggatcttcgggagaggagggctccagtgctcctgttcagttctcaagaattctattcagggacactagcagggcactgtcaaagaagtttgtgtctagtctgaagaaattgaagcccgttgtgaggatgtgacagtgactgccatcttcctcgggtctttacatcccttagcactggtaagaatggccttctcatttctaaacagcgagtagttaattttaggatgaagaactgcttcaaagatcattcccagggttaactttaaaatggtgagccccaagtccagtggtggctcacatgtcatcatcctgacacttgggaaacggaggtgagaatatcacaagtttcaggccagttgggattctgtagtgagactctaaattaaggtgggggaggggaggaatgccaaagatacaaaaaaaaaagttcaatgataataagaaaatttccctaggctaaaagtgttgcctcagttctcctctggacctccgggattcttcagtttttctttcatggtattttaagctggctttgcccaccttatgcaacctaacatgtaacaaaggtgcttgtgatccaataaacattctgtctaccctgtcgtgaaacttcatatagatctcagttaatttcctctatctgcatcatgtgagtgggtgtgtctgtgtgtgtgtgtgtgtgtgtgcttatacacgcagttatgtggggttataggtttaatagtttctattaccaacttaataacaataaaaacagattcagaaacctctgcttgaggagagcctcagactctgcaaaaggggcccccaaaggaaaaacaaaacaacaacgaaaagaatctaaggacttgatgaaaagaaccaggttgacatctgctctagaaactgactttagtagacggcagaaaaccagaaaccggaggagcgggcgtttgcctccaaggaagggaaatagaagcaagcaggctagaggctagacaaaaacaggtttgtcagtcttccgctgccctaagacctaatcagttttctttttcctctaaagaatgaggaagctctgagttgagaggggaagactgagttgcctgctgcctgctgcaagctcatgggcactgagcggaggaaacaggtagtaccctgaagcatgagggataggcatggggttgcagaagccagggaggggaagcacagacacaaggtgttaggggcaaggcagaagtggggtaaggtgagagctgaaaagggagaacaggagtctgtggccagaggagagactaatgctgtctgtcttagagatgagactgctatggagaggaatctgtccacaggccatggtagtggatggctaaaggtgaatgaatgaagcttgtaagcattagagggaccagaggaagaaaaatcacccaggtggccatcacagagaggggattaagaagatgacaagagaagaggaagaaagctgggcttctttaaggtggtatcctcccaggtggatctcactgtgttgggggtgggtaggttgtcgatgacagaccgagatgcagatttagcagtttgttagcagatactgtggactccagggaatgatgggacgtttgaaagacagtggtaggtatgatcctgatgtttcagtgataggactgcttgacataaccttcagggtttatctggtgtctggaagcgctaaggtaacaacagtctttactctggcttctgactgagagtgtgaggtcaatgcagacctttcagttagttggtggtgaatgtagggaagttgtttattaaggctcagatctctcagaggatgctgtccattgtcttgggatgtaaagagaagtgatcctagaagctggccatggggttgtgagcaagaagttgggtagcctcccaagccagtgctacttcctctgttgctgtggccaaatacctgaccaaaacagagtaagacaggaggaacttatttgggctcatggtttgacagggctattccatgatcatttagcacttagtgcttaggcagaacatcttgtcaacaggagtattgggtcagaaagctattcagttctggcgcccagaaagcagaaagactgggatgggggcgagaatataaaataacctgcaaagcactccttcagtgactcatttcctccaggtagactccatctttccccattaccataggctgcccaaaagagcaatatcttgtgggaactaagtgttcaacacatgagcctgtggggcacatgtcatactcaaaccctaacactatgcagtctccctgtggagaactagaggctctggtgagaggatcatagaacaggataggacaattcagtggcattgcatttttcccacttgtagtgatttcaggagccctggatcttagaggaacatgggcaatgagtgattgaaggactttgggacactttaggttgagacaaagattaagtaagcatttatgtaccaaatgtaaactaagcgcttagagaagggtggttatgtctcttgagaccaacttagcagcatagaagttaatatttttgtcagattgactaatgcatcatgattgcttatgcacctggactacgacttaacaggaaagaaggctctggatcctggttggcatgaggtgtgtgtctctttgtataccaaaggaaagcatcaccctattgctgtagaaggaagcaaaaagctagtgaaagagtacaaggggatactctgtgtgttggcctgtaagagatgtgccaggttgcttaggtcattgcatttggattactgaagtgctttctttcgaaactctgtaatgatgccttaagtaagccttttaatgctttccttcttttctgcaaattggaatgaaggcatgacgtttaaaatattattttgcaattatttttaattacgttaagaatgtgtgtttgggtcagggtatgctggctagttttatgtcaatgtgacacaactagagtcattttagagtagggaacctaagttgagaaaaatgttcccacctgaaaacctgtgatgcattttattgtttgatgattgaggtgggaggacacagcttaccgtatgctgtgctaaccctggacagttagtccagagtggtataagaaaggtggatgaacaagccacggggagcaaactgctaaatagcactcttatgacctctgctttcgtacttgctgccagtttcctcttccaatttccctgaatgatggactaaaagctgtaagatgaaacaaactctttccaaatttctaaggtgggatatagaaaagttttctgttttttgatttgaattttatgcgtatgggtgttttggctgcatgtttgtttgtatactatgaccatgcagtgcctgcaagaagccagaagagggggccttggatcctctgggaatgaagttacagaaggttgccatttgccatttgggtgctgggactagagcacaggtcctctagtgctcttagtttctgagtcatctctctggagttttgtgtggagagtttaagcacaccactgtatgccagaccctaattcctggcatagaaactttatagatatcaccaaatctgttcgaattctcccctgtcctttgaatgaattcactgtatgagtttttctgtttttttggcttttttttaatatgatagaaagcaggtcatgttctggatcccctgaggatccctcagacagtaggccagaagaccaccagggactataaacatatagttactccctacagtgacagagtcaggaggaggagtctgggaatggagggatggcagtgaatgtatgatgcagagaaataccggcaggttcaaggagagcctcttgtactgtaggtatgcttacattggtacaggctggatgtcattggtacatgttcgttctctctctctctctctctctctctctctctctctctctctctctctctttctctctctctctctctctctccctccctccctccctccctccctccttccctccttccttccctccctccctccctctatttctctttctctttccatataacagtgaaatgtatttgctgtagcaaaacctagcagtagtgacagggctttgccccgactgagtcacactgattttcctgccactgggtggtcagaagaaggcagtgagacactaggaagcatcatcacctcacagtgccatttgctctccagcctgcttatccaacagctattttcttcctaatgcatttcctctaagtggcaccctacaaactgttctcacagttgcacaacgatgagttctctctccctctgacaatgacaaggatctgggctcggcttctttccggcctgttgcttgcctttgaaacactaggatggggttttatacatgaagcctgccattttgcccttctggggtcactgggcttgttatgccctctctgggatctggagagaggttgcctacttccaggcgtctgatctctgctatacagagcctgcacaaagaattgagattaggagagagaatgcatgagaaatgccctatcaccttccgacatgccttcaccttctataaatagcagagcttgtttgtgctcatctgggtgaagacatgcattgcaaggagagagctgctagggaaatcgctctggggtttggtgtccctggcattaattgggaattcccatacttcactgggattactttttcaaccccaaagtctgtggtacctaggatatgttttgtctataaggtgggtatgtggaaactcttaagatctcagcagggcatttggatgaaagtttctgggaatggacaagaagctgttcctttgacgaacaaaataagcctgttttgtcccttctttatggaatggcccatctccagggcttgctatattgtggggcagagtgctactggaggatgcgctccacatttgctgtcttcatacatgtaagtcaccttttagttgctaatctgagagaaagaaaactcccctgaggaataaaagagacaactgtggcggctcctttgtattattgccatctcatgcatgataggaaaagacagagctagacaccaggaatctcccatctgcttcctgctctgctatcactcagcttcttggccttggacacattccttctaccctgtgatcacaggaacaagcaagcctgtaacaaagtgggaaattgagctgggtgttccctgcccggttcacagtcaaagctgaggtctgagatatgaagcagggagcaaggagaggaggggaaatgagttcacttgctgtcctagtttgctttctgttgctatgatataacactgaacaaggtcaacttgaggaggaacgagtttatttggcttaaaggtccatcatgaagggaagcccaggcaggaaccgggaggcaggaattatagcagagatcaagagaatgctgcttactggcttgcctcccagtgctcactcaccttcctttcttacagtatccaggaccacctgcccataagtggtcctgactatagtgagccgccccctctcccatcaatcgttaactaaggaaatgcctccacagatttgcctgcaggccaatctgatgaagacagttccacagttgagatcccctcttcctaggtatgtctaggtttgtgtcaagttgagataaactaaccagcttttagatcttaggggcatcactggaccgagatgttgtcgggatgagtgaggagtatgtacaggttttacactagaaagggataatggataagatttcctggttggaagaaagaaaaaagagagggtaactcaagcagtttctctgtgatctcacatttgatgggtgtagccatctgtatgaagtaccagctcccaggtggaatgagaggtagtgacaattagaagactcatcctgtgtgccttagtagttgcctgcacttgggaaacagggcttttaaagatactctattccttctcaactctccccactacctcataatatttttaggtatctaaagctgaaagatgtgtatcatggtagcatatcgttttgaggattgggggctgctaatgcagtcaccatacaaacttagaatcttggtctgtgggaactgctctttcttgcttcatccccacatagctctagaggattggtgtctgcttggtagctttctgtcatgctgctggtaatgctgtcatagatttgttagtgtactccctttggctttctttgcacttcagcgctgtttccatcccacatgccttggcttaactgtcccagcttgggctaaattaggccacgccactggctgagttcatgttctcaagggttgcacactgttgtgcatcttccacatcttcctctatacacgagccctatgttatgtcctagatccaaaggggatgagtgggtcacactgagtacattttttattattggtccttcttaacttgggaaacaataactatctacccagctaggagtgaactagggtgacacagatggcctgatgtgagtgatgacctgctgtccacagaccagattctctgctaggaagacaagaggatgaataatcaaacagccttagtggctccaccaggctcagaatttcaaggttattcttgtatagaaagttctaagccaacctgggctacatgagatcctatgtcaaaaataagtgagtgaataaataagtcatctcaaagaagtgctcttggtctctgcaattagacttagcggatccaaatctagatcctgtcactttagtactttggtgactttaaattggcaagcgacttagcctcacttagcctcacttccttttgccatataatgaaaagcaagctatcataaggacagttcctcaggaatcagaccgttcctgcagaatgtgaagatgtgttgtagggctccatgatcgtagaagcaggactgggaagagggaaagttaagttgtgattctggttcagcaagtatctgtgagatccacgaggagttctgtagctagaatagcccagttgagttgtcccatgttggctagtgaggctctgtagccaaggctatctctagaaggactgaaagctggaaactgcccatgacagcactcttagtagtaggggtgaccactctaccactgcaagggaccctcaaggcatagtgaatggcttcctgacaggtagtgggggtggaatgcttcatgcatgaaggattctgcctcagtatatagtaggtaattgtcattgcacaagcagtagctgctgctgttattttcatgggatcttaggacctattttctccctgctcagacccctgtctgttggaaagcaaggggacctatgtgatatctagttaactgtcaagcaagggtcaaactaaaacttccaagaaaaatatatgagaatagaatcattttgatttcaaatttaaatttctttttaactccatattttcttttcatttttattagtcctttgggaatgttgtacagtgtgttttgattatatttattcacttccctccttaactcttctcagatccatctcccttctctattccattttgtgccccatggtttttagcccattaagtccaatttgtgctgctcatatactcttggatgagtgacctctcactggagtgtggtcaacctaccaggggccacactcttaaagaaagctgacacatcctctcctagaatctatcaagtgccagcaactgctcagctaggggtggggcttcatgtccaactaaccctccttgctaggatttggtttggcttgactctcacacatattatcacaacagctgtgagttcatatatgtgcctgccctgctatgccaggaaaacactgttcccttgtagtcatccaccacctctggatcttacaacctttctgtaccctcttccacaagggacccttagaaggaagaagcgtgagcctggcagccttgttctttgggtgctatggatagccaaccttctcctgggttctccttttatttaattgttgtaggaatagaaacttaacagaagaaaaaaactctgacaggagccagtaaatgatgaaagggtaagctctttttctctttttctttagagttcagtaataccctttctgaaaaaaataatggtatccttgtattgaacagactgtgtcagaatggagaccatagagctgcatactcattgggtgtcagccactatagacatgtgcttcagtaaatttcagaaattcttctatttttcagaactgaaattcattagcattgttgtaaagaagctataaatatagtgaaaggcatttacaaatagacattgtaaaatgcttacacacccacagtctgagcactgtcaaaacaccagctgcagcttccctacttggaaggatcagaactttttttaaactacacctactgtgttttcaaaataggcttgcttctggccctagatagaagagcatttcaactaaagcctgtgtctagctcttggcatgagggatcagaaagctcaattggaaggaagagccagtatccctgcctccttatacaagtgcggtctgtattctagaatctggggaagagtcacttgggaatggttagtttctatttctttggggtggttcctcatgcttcagccgatagagcctgcagatgaatctcagaaacataatactatctgtccccttaggcagaagtcctacctggcaagagttcactacatatcataccaagtgccatttgaaaagaagccaccctgaccactagaacataatatctttttttctttttatcaaaccatcagaatggaggtcctaaaactggggatagagcctctagtcgctatatgaaaattgcaaaggaatttttcatttgtgatttactctatatttctagtggttatgaaccccaaataacctttacagcaaaagttccccattgctgacctctgtggtagattgtgttctgttctttaggcttcatgttatattacttttctcaggttactgtaacaaaatactataggctgactagtataaacaataagacatttatcttattatagttgtagaaggcactaggtactaggaggaagacatgataggattttcttctatatggcctagagaactggcgtagtagtttaaaaccactgacttttcctccaaaggacccaagttcaaatcccagtgttcatgtcagacagctcagaactacctgtcactccagccctacaggatcttacaccatcttctgacctctatgggaatacacacatatccagtatctactcccacaattatacacatatacacatataaatataaataaacatttaaaattctcttttgaataataagtaaggatctctaggtttatacattatcaaatattgtgatgggcgcagaaatagagatgtggcctgcaagaaccaagagaaaacaaaagatgggtctctgaatgagtcacttttattccagtggagtaggaaaggacatcattccaaaccttgagacatggagatttgaaggcaaaggagagaataaaagtctgagagtttgaggacaactcataggaccatcttccccgtgactcctgttgtaatttcgaacatttctaatgtttaaattagggaccaagagggggacatggaaggagttagagaaagtagaagagggaagggggaatgatgtccgtgcaatatgcacatatgggcttcttaataaaaaataaaacaacaaaatcaactccacaatgtaaagagattcaactgcctgttgcttaataattagccttacaccctgttttaataattataatgaaaataggaaaagtaaaagaactcttgatggtcccttggggggatggtaatcctgcccaaactagctctgcagtcatgcacaacgtttaggagagattaagtaacctggccgagatcatacaggcaattagaagtgagttcagatgtagtactcctggcttgggcctgtaagtataggattcataattttacacaacttgactgatttccagaagagatggctacatttggctacctgtgttcaagcaacttattagagtttgttgggcaaaaaccatgctgtacctccatttactatgacagtactgttggctgtattgtgtatgtctttaatcactattggcaaaggaaacttcacttttaaatttatttattttattttacttatgtgcatgttttgcccacgtgtatggatatgctctgagtgcatgtggatgtcagaagaggtaagattggatcccctaaaattggagttatggatggtttgagccaatgtgtgggtcctgggaaccaaatccaggtcctttacaacagcagtaagtcctcttaaatgctaagccatctctccagccctataataaatgcaaaatgtaaataaaagaaaaagggactagagagatggctcagcacttaggtgtacctgctattctttcagagggcctgagttcagttcccagcacccatgttatgtggctcacaattgcctaaatctctagcaccaggcaatccgatggtatccttgggttcctacacatacataacataaactcacacagacaaacacacatgtgaataaaaagtaaaataaatcttaatcattggaagggaaaaatccccaataagctttttctgaagataaataaaattcacatttttttaaaaaaatccttgtccatattttttctttgtatgattcagcttgtttttgtcaatcttacccaggtgccatcctatagaatatcataaatctttatgactcggggaaaatgcatctattgtacagatgtataagacattcccagccaggcgtggtggcgcacgcctttaatcccagcactcgggaggcagatacaggcagatttctgagttcgaggccagcctggtctacaaagtgagttccaggacagccagggctatacagagaggccctgtctcaaaaaaccaaaaaaaaaaaaaaaaaaaaaaaaaagaaagacattcccatttcagaaaatttggccactgctcctggattccatgggtatttttttggtactgcactaggtgatgaaaatcactcatcagacttcccaggaataactaccataaatattcctccaatcttaagaaaagaattcctcttcccaccacctaagggaggcgtgtgggtgtatgcatattgctgtgtgtgtcactgctctctgcctttgctctctccattgtaatataagcatttgttctggtcagactaaacctgtttgtaagtgccatttaaatgcctcataaaagcccattaaatgtcacagtctattcaaatgtttcctaggtctaaaatatcccattggtgggattttttttcagtttttcttcattgtaaacaatacaacaatacatggaacccatttattgcagactgtttctgtgactcagagctggctttcatgcacatgaagacttaaaatctatacctttaatcttaaaacttaattttaattttatcttaaaacaattttatcctgtgctattcctcagaggatctgagtatttttcaaaatttcatggtatggcaggtgaactatctaagttgggaacacaaagaaaaaaccctgtacaatctcacttccatgtggagtttgaaagtgtcacattcttaggagtagaaaaggattaccagcaactggtggagtgctggatgggcagaggagacaaaagggacatttagttagataagaggaataagacttggtgatttgccacacaatatggtaatgacaacaataatgtgttatatatttcaaaacaactaaaagaaaggatggctaggtgtttttaccacaaagagataataaatatttgaggtgatagatatgctaactgacctgatttgatcagcctgtgtggatacaggtattaaaacatcacattgcaccttttaaatataaacaattactgtttgcctgtataaagtgttgatttcattttatttagtttttcttcatatattttgatcatatgttctacctctccaacttaaaaataaagtttttttttttaaagtaagtttattgggtagggaaagaaaggatgggaggaattggggaagaggaaggaacttgacaaaatatgttatatggcacattaaaaaaataaatcataagggaatatacctacaatcatatttcaattgttgctgggtttgagtggtaataatgtgataataaatgttatacctgtctgtaaaaaaatcattttaaaaatttaaatcactacagtgatttattgctcattcagtaaagtgcctgtgtacaagcaagaggacctgagctcagaccccccaggactcatgtaaaacctgagcagtggtatgtgtatctttaattccagtgccaaggaaacaaactggtaaatccctggaactcattggctaatcagtttagctgacttgatgagctccaggttcagtgggaggtgttgggtgtggtggtacatgtctttaatcctagcattcaggaggcagagccaagcatatgtctgtgagctacaggtcattcggggctacatagtgagaccccatctccaaataaaaacatgaatgaataaatgggcaaataaataaatctgacgtgatctaggaagatacccaatatcatcaacctccatgggtacatatccacacatgcatgcataacacacatatacacccacacatatgcatacatgcatgcttcccacaaatatgtaaaataaactaaaaggctgaaagctatatccaaaagaaaaacaaatgtatataaaagaataaaatggtcaaggcttctaataacagggaagtaagatatcctgagcacattatgggcaatagagtcatctttagtcccttaagatgggctctcatttgatgaacttctggtgttcactcaaaagaagtacacagcagctccaagattgacactaatcaggatacatcatgaaaccacctgttctgaagcagccacgttttgaggtccctgcgattaatgaagaagcaaacatcatcaacagctccaccccccacccccactccccactccccccaccccccactcatgtacctctcacctacccataagaatggcaaaccatcctgcctcttggctttcagaagcctcccttccaggataccaaaagccaagtgtgttcagtttctttaaatacactgacataatgttaatataacttactccatgcccccctgaactttgaattgcctttgttagttacttataataatgcttcagtgtaaacaacttgctatggtgttatattgtattcttttttaattattttatttatttatttacattctatccattgctccctcctctcctgctcctcctcccacagttcctcatcccattctccctccccctttgcctctgagagggtgctcccccctccctccctccccaggcattccccttccctggggcctcaaatgtctccagaactaggcatattttcttccactgaggccagataaggcagtcctttgctacatatgtgccaggggcctcggaccagcccatgtatgctgcctggttggtggctcagtctctgggagctcccagaagtccaggttagttgagactgctggtcttcctgtggggttgtcctcctcctcagtttcttccagcttttccctaattcaagcacaaaggtccccgacttcagcacagtggttgggtgtaagtatctgcatctgtctcagtcagctgctggtagggcctctcagagggtagccatgctaggcttctgtctgtaagcacaccatagcatcagtaatagtgtctcaggccttggcaccccccctgcccccacccccccgcccgcaatatgagatgaatcccaagttgggctggtcactggacatcccttccttcagtctctgctccattttttcccccgcatttcttttagacaggatcaattctgggtcagagatatgactgtgggatgacaaccccatccctcacttgatcccgtcttcctgctggaggtaggctctataagttccctctccctactgttgggcatttcatttaagatccttccctttgagtcctgagagtctctcacctcccagatctctggtgcactttggagggtccccccaacctagaatttcctgaggttgccagtttccattctttctgctagccctcagggcttcagtccttttccctcacccaataccagatcaggttcccctctcacccccactctcctccccgcatccactttccctcccaggtccctccctcccttcccacttgtgattgctttcttctttctcccaagtgggactgaggcatcctcacttgggcatttcagcttgttgagctttttgagttctgtggactgtatcttgggtattctgtatgattttttgtggctaatatccacttattagtgagtacatagcatgcatgtcattttgggtctgagagttatctcactgaggacaatatttttcagttccatcgacttgcctgtaaatctcaggatgtcctcattcttaatagctgagtagtattccattctgtcgtaggacatctaagttttttccagcttctgactatcacaaataaggccgctatgaacatagtggaacacggggcccctgtggcatagtggggcgtctattgggtatattcccaagagtggtatagctgggtcttcaggtagatctatttccaattttctgaggaacctccagattgatttccagagtggttataccagtttgcaatcccaccagcaatggagaagtgttcctctttctccacatcctctccaacatgtgatgtcacctgaggttttgatcttagccattctgattggtgtaaggtggaacctcagtgtctttttgacttgaatttctctgatcactaaggactttgaacatttctttaggtgtttctcagccattcgagattcttcagttgtgaattctctgtttaagttctataccccattttttgactgggttatttggttttttggatgttagcttcgtgtgttgtttatatattttggacattagccctctgtcagatgtagtgttagtgaagatcttttcccaatcagtaggttgccgatttttcctattgactatgtcctttgccttacagaagctttctagtttcatgagatcctacttatcaattgttgatcttagagaatgagccaccggagttctgtttaggaaatttccccctgtgccaatgagttggctctttccaactttctcttctattagattgagtgtatctggttttatgttgagttccttgatccacttggacttgagctttgtacaaggtgacaaatatgggtctattttcattcttctacatacagacagcaagttagaccagcaccatttattgaagatgcattcttttttcaattgtatatttttggcatctttgtcaaagatcaagtgatcataagtatgttgttttatttctgggtcttcaattctattccattgatcaacgtgtctgtctctgtaccaatactcttcaagttccctctcctaactgttggacattttggctaagttcacccgcattgaatcctgggaatctcttaacaacccaagtctctgggtctttctagagggttccacacctcccaccctcagcaactgcatatttccactcactctcctggccctctgaacttctgtccctcccctgttctccattttcccctctctctcccctctcccacccagatccctccttctgcctctcatgattattttgttcccccttctaagtggagaagcatcctcacttgggcctctgtcctgttaaacttcttatattgtattctttaaggaatgctgataagaaaaatctaggttcaacaagtaacagtcccctaagtattttcatttctttttattttaaatatatattttatctgtgtgcccgcacacaaatatgcctgtgcacatacatatgagtgtagatgctgacggtgactagaagagggtgtcagatttcctggtgtttgcatttcatgtcattacaagccacccagcatgggtgctgggaactgaattcaggtcctctgcaaagaacaatacaatcccataattatctttctaggctccttgtttctttttaaaaatacaactctatttcctacaatattatccattgaactcaggacttcccatgtgttaggcaagaatttagcttgcctagtattcagctctatagccccagcacaaatttttttattgaaaaatagttgtatgtatttttgagtataatgtgacatttcagtacatatatctagtgcgtgttgatcctatcaggataattgacatatctgccacctcagatgtgtattatttgtttatgttggagatattcaaaaccctattagctgctttgaaacattcaattagttgctgtcaaccaccaattattttctagtcatactacgaagcatcagaagtcctatgtccatctgtggcttttgatttaccatcttcttagttctcttttctctgtactctcctcaggctttgctgatcactattcaatttgctttccttcattttccttccttccttccttttccttcctttcctttcctttcctttcctttcctttcctttcctttcctttcctttcctttcctttcctttcccttcctttcccttcttcccttcccttcccttcccttcccttcccttcccttcccttcccttcccttcccttcctttctttctttctttctttctttctttctctttttgagatcagcattaatttttgttctttaaaaaatattcatgtgtgggtgtatggagctcaaagaacaaatttatggagctagtctttctttctacctttatgtggtatcacagtattgaactcagattgaactcagataactaggatatcattacaagtgtcttttacccatctttccagcccccgttttttcttgaggcaggggtctctctctgttgtagcctaggttgtactaaatttttaaatttttattttattattgtacttattcactttacatcctgctcactgccccctcccagtcaccctcttataataaaatgttttaattcccctagtaatcctcctgcctccaccttcaaggtaatacaattatagttatgtagtaccattgccagttagttgttttctttttggttctagcaattctaactagtgtaaggtgacacattattgcacttgtgggcattatcctgattataagtgacattgaacagttttctatgtacctactggccatgtgtatatccttttgagaaatgcctaactaatcattgggattttattgttgtgctgtaaagttcacagttagttgaatctgtgtgtgcagaactcgtggaaagttgactatactttcaagaatggatgctgaggtcctggtaatcataagttttgaaaataaatcccctccatgtccccacaccaaatggcttggtatctgcctgaggccttgaggaccctgagttttggttgtcagagcatatagaaagggagtctgagatgaaccctggtttggggaaggcaaagccttaggatgttgggcgagtaaataaaggtccacttatttgtgaatatatttccccttctgagctctccagtagatcatgttcttcctggtcttctggtctaacctagctctcaatgttccagcaagtcccctaatgtacattctagagcaggctttatgacatttggcatttatgacacattacccttagtaaaggcacagcagaagaggaaacctgataccagtagttctcagctgtctaccctctagtgaggagtatgtgaaagttggatctaaaaaacaaaaagaaaggaagaaacaaaggaagaaacaaagaaagaaagttggatccaatgtttcccttcagaaagggagctagacctccatccatgaatctgtttcggcagacctgctggtatgtcaatgtgttggagggtgggtgaggggtttctcacagggttccactcttagaataagagctactggcaattgagggttgctgggggaaggtaaatctgtcttctccagggatgagccccctgataagttagccaatcccaagagtgtagccctgaacatatgtaagcaaagctaaattagcacagcagcttgtaattataaagttacacacatgcatgctcaagacccaactatagtgttccatggctgtgtaccctgtagaatcccctggcctactctggactgtaacatgtagttatcatgccttatggacctgcagtggtctgtatgtctatcccatccatactgcgagcctttccagagtagttccttcccactttagctctccccatactcttagcagactaggcaccagacaaatgtttgggagaataaatttgttcctagtaaagtttgagttcgggccatggtgactttcaaaagctgtgagatggactatttctattgatttgataggaacaactgttcagctctctcatgtcatggtgaggatcagcccttgaataaccttatttaggactcatctccctaacaggaccaaagcactgccttttgggggaaatatggaggaatcttaggctggtatacaaagaaaccttctttccttagcttggaaacttattcccatcccgtatgtgggcttcttccagcccatatctgagagtcactcatgtcataatgggcatagtgttggggcggggcatgaccacccagaagctatctaattttatagacatgtgccccagtgccagcctttgggctgccagatttcaacttgacaccttgtgcctgtcaacagcctggctgatgcctcagccccaaggccagagaacctttttctcaaggttaaaagtagctgacctttgacaagaagcattggctaaattctgtgttccttaaaagggaagcagccagtttgccagtgcttatttggccatggggcaggaacaggcctgtgttgcatcctgtggagacagcaggagggtttgtggctagaagtatactggcaaagggtcattattaaaatagccatcttagaaaatatgtacagaacagagggacatccagtttgctggccagtttataccacagctcctgtggctggacagctcattgggtctcactgcctccttttggctccctgcacaggtaccaatgccattctcccctccttaatgtgtgagcagcaagcaagtggacagaatgagaaggacacacactgattattaaatgtctggacttgtgtttttaatataggggtgacagtccaaagattgacttggcaggcagcgcactctctggcatcctggataaggacctctcagaccgcagcaatgatattggtgagtgaagacttaacttgttctgcttctctttgcattgttaggaaagaacttcagggcctggcttgcctcttcaagcaatgtgatgggctctattgtggccactgaaacgctaggctctcagcctccgctgagttttaaactgtcactgtttgacaggggaagtaaatgatttgatttctacctgaaaacgaagtacctgggtttttttggtttttttgttgttgttgttgttgtttttgtgcctccctggccttagcagaagtcctcagaagtgctagtgaagagcaataatgatgaatgaaagttgttgtagaagtaggcacagacacttagttcatgttttccagcctggaaaagggtacaaatgcaaaatgccaggggtcactgtagaaatggcactaagtactttgactttaagttaaaaggagctttttgtgtatggtaattgccacttgccacaaagcaggaggaacttgctttcccaaggtcaaaccagcactgtgtgataaatgggggtgggaggtgcgaaagtcactctgactaaacaaaagtcaaaggtccttggggcccattttggatggatgtgaggtggctggcagtgtgatcttggtaacaacccttttaggatgctaagtctcaaatccagatgttttttaagtgcagtgtctttttatttgtacctattgtcataaggtagcattctcctgcattctactttagagggttacattttgaaattgcccttattttaattaatgtttggttgtgagttcattacagattcacagtcagaagttagaaatgagacatatcttcctcctgcacatcccactgtaacatcaagattgtaatgttctatgacattgatgtattgcatctcactagtcttttcaactttgcccagttttactggtatgtgtgtatgtgtatgtctctctgcaattttattctgtgtgtatctgctaacatagtcaagattcataatatctctgtcactaccaggattcttcatgttacatatttctttttctttgtttttgtttttctaaatgtattttgtttcagcccttttgttttttgctttttttttttttttttttttttttttttttttttttttttttggactgggtctctttatagggccctggcatcctatttttcctttccacttgctatgataaaataaccctggcaaaaagcagcttaggagagaagggtcacaaggttaggtcacaatgctgggctatagtccatcattgagatgaaaccaaggcagcaagaagcttgaagcagccaatcatgtccactaataagagcaaagggaataaatgtagtttgtgttctctactacaatacagtccaggatctcctgcctagagatggatgccatctacaatgggtgacttttgccacctcaagtgtaatcaagataatcccccatagatatgccataagacaacgtgatctaaccaatcccttaagacactcttcttgggagattctagacgttttcccattgataattactactaaccatcatacttgggtagcctagaacttattataataatgtaacactaataatatattagtaagtgtaatcattattgtctcaaactcacactactcctgccttcacttcccaaatcctaggattacaagccaccatgtcaggctgtgttgctcatttctagccacacccaccttcctccaatccactcactcccaacatctggcagttattagtgggattgatttgacatagaagatagatttccataattatctgtgtttgccacttaatttagaaataaatgcccaacagttgacaggcccttagaagagcagcagaggggctggtgagatggctcagtgggtaagagcacccgactgcttttccgaaggtccggagttcaaatcccagcaaccacatggtggctcacaaccatccgtaacgagatctgacgccctcttctggagtgtctgaagacagctacagtgtacttacatataatgaataaataaatctttaaaaaaaaaaaaaaaagaagagcagcagaatgcctgacatgagcctgcctaatgtcaccccaaaggttggacactgatttttttgtttttgtttttgtttttctgaatctgctaataggataacatctttgcaaactgctgaccgaagtctctgacctgaccttgtaaggccttgtctgtaggatacttggttgtgactgtaaatgccaaaaaatatattcaccgcttccagaagttggtttctatccttatccagcctttgagaatctgtcatgaagcataatctcacagttaaaactggctagctctgggttttcgttgggttaaagaacaggaacgagcagagcagtgaatactgattgaaaggctagactaaattatggttctcccaccacactttggtattcagtctgtgttttcagctagaacaactgattggtgaaataccggtaaaggtcttgtgtgggacctcacacaggaatataaagtgtttttctttctctagaatacatagtgctaagtatctggctttttgaagagcactggcctttgacccttgctttcgctgggtctggagttgtctaggatggctattgaagatgtatgactagcacattttttaatctagttcagaaatattggtggcatgggtaggagaagaattcctccaagtgcttttcctactgtggaaactaagtcctagttgtatttagaaacctggagagatggtgctgaagagcatcaatgcacaagttgacaacccaaggtttaggttctttgacttttaagaaatgctgctgggcagctatgttaccaaccaggaaatcctggaatattcacaacccaaacacccttatacacatgtctgcttctatggacttagaagatgttggataacaaatgagatgaccctcgaggtgtgagtgacaacaaagtagtagaatgtaatactgaccaggatgttcctttgtggcagcaggcggggacaagctctacaaaagagcacagagttatatctgtatcatggctttccttaggcggaggtgggggcaggcagggaaatcacatggggaagtgctgaaagcttagctagagcagcctgactgtagtagaatgtttatgctgagtagaggaattgacttggaaatataagcagggttcaaattgagtttaaggggggtggatttgtaatttattgtagagacagtagaagccattgatgggaacactggagtgctatatcagacttcaaaattagtataaggaaatgctgaagagcttgatgggaccaatcagttaaaggaaagctagatatcaataaattggatgggtttagttaatcacattggctttgagatttgtccagacgccccatgtcagtgctgcctggagtctgagagcagaggttcaagggtttagagataggcagggattagaggtagacgttgaattttgcataagcactgctggggaagggaatgtgggattggtggctccaagcctgagtgctggggctgttgtctctggcctgggtagctttcctggcttagtgatcacctcagtcgacttccttaccttgtctcccagaattatgtcaaaattcttggtggtcagcaaaaagatagagatgtttatattaatattgtttgcttagaggtgtcttctgggctaggaagataaaaatcaaaatttaccataaagaaaggagatcaaaaatagtttaaacagggtgctggagaaatgcctctgggtaaagaggacctgagtgaacacacataatggacatactaggaagcatctataattctagtgctcctccagcaagatgggaggtgaagacaggagaatctcctgaagttgaagctgcttttgtagatatctatatgaggtcatgcctaaaacaaagtagactgtgacagcaaggaccagcatgcaaggttgtcctttaaccttccaatgtgtcatgcagtgtgtacaaccacctaaatcctcatgcatgtatgcttgtgcatgcacacagtatgaacacctaccaccctgccacaccaccaggatatttaaaaggggtgagatgcacctaggggtgaaggccataccctgacaaaatccacattcaaggagaacaaaaaagaatcttgccactttacagaagccaagggagaagcagatttttaagcagaatgtctttaaacccaaagacagaaatgctcttgctaggtagattggtcaaggagaaaaggagattgcagaggaaggtggctctctctgggactgctttttcaaaggattccattgctttgaaccaaggaggacattatttgtaccagaatggtttttttgttagtgattctaacaattgaagctgtccaaatgtgggctgcagtgaatagcataatgtagccccgagcatcattagaaaccatcagtgttcggtataaataaatctgtttcctcttaataaagctgtaatttaaaattattataatattaaattagagaacatggctttttcagatcttgtgtgggcagctctcagcatctgtcagccaacgataatttagaatgaaatcaattggtccaaaactaagctgttgatgtcagattgagatattgtttgtatcaaactatgcagccatttttcaaataccataatagaaaatatggaagcactccaacacaggcttgtgcatgaatagaaacgaaaattaaattgtccagttctgtcttggtggtggaagaatctctgttctgattgactgggagattataggccatgaagtgaagtgccagaacgttgacttttactattccttatattctaactcccactgcatggtgagatttattgttacacttcaatacaatcaggagattttcagttattttccttctgaagcacatagcaatggacctccagatgggaagcgacctatgaactaagccaccaagcttcaatgaattgactttgagcaattatcattcattccttcccagttgcttggcatctttgtttttgttctattctgttcaaatccacttaagcttctggttgccactcctttatgccaccaccaccctcttcacttaaggaaggtgacatttttctctcggtcttgactttgacacaccagacacatcacatcgtagtcaatttgggggccaagagttgcagactttcaagtcagcagacttgattaaaaggatttgaaggctaacttcaacttatcctcagattgttcctggatgaatctctcatggatgcctggtgactatgattcctttggaccagggaatggaaaagtattttcctatgtgttaggaatactgttaagagccaatcaatctcaggatcagttagaaacacttgaaaactcaatcatggtgatatatagctctgtaaatttactacaaattattgttgtgtaattaaaatggatggctttatggtttataatttatacttcagtaaagctgttaaacaagaagtgaattgatttgcattaaaatcccagtggtttttttttttttaagttataggacctgagtttaatctgaaggacccatgtttttaaaatgtggtaccaagtgcttgtaatttcagcacaggggaggtggagacagagggatggatccccctggttcactggctagccagcctagtcttttcagtgagttccaggccagtaagagtctccaaagcatcaaaagctaggcagatcccgaggaacagcacccaagatttcaagatcttcctttggcctccacacacatgtgcacatgcacacacatgaacacagacatatgtacaaaaacacatatatactactcatatgtaagtattgtgttagaaatctctctctcccatacttttaaaaataaccaactatgtagaacaataccaacaatactgtcctggggcttctgacttacgtgtcaaccaatctgttgacatagaactatttttgagctttcttgaaatctccctaaaaccctctacagggtttggggggtggggaagtcatctcttaggcagtgaaatctgcacatttttcgcaggaaataaagcatgtccttactgtccttcatccctctctgaggtgcagtgcaggtggttgcctctagggaaatatagctctatatgtgtataaaggtgttgctacactcatttctccagtacagatggaggatagacctttcctttcttgttctcccttctacctagtgttgaaattgtagctgtgggagcaagcaagcaggaggagagaaggaaatggcaggtgctgagtgcctaccacctgtcttacatattttttctcatcagcatccctgaggaacaatatggtgattatatggttttggagcaaagaactagtgaatagagatggccaagtgttttggcaaagttaactagttagctcggaagaagcagctgggagcccaatgatcaaaactgttctatccaaaggacaggtggtagtggtgtctggggatggtttctgtcatgtcacaggagtagaagtgattcttacttgtagtgagtaaaggccaggaacaccagtgaatatcctatagtatatagaacaaccacataaatgaccaggaacaacaccatctcacatatcagtatcacagaggtcagctcagaagctgaatgggaaactgagaactggactaaggagacagcaccccccccacacacacacacatacctcaaatgtagccttgcatttcttagagttttccaattttcctgagaatctccataaaatgtattttaagagcaatttcaaagcttttggaagctggtgactatctacacacacacaaagtaaataaatattggaatactgtatttaaacatcaaccagtaatgtggttacaagggaagggagagaggaagacagaaggtaagtggggagggaggaagagagagagagaaagatacagagacagagagacagagagagcactcgtgtgtgttctctctttctctttctcaggcttgtgacaagttatgtaccctagaaaaagtgatacatttgacaccttgtttttacatagagagaaaacattatttttgagattcagtatgattgtctgttgatttgctatctaatgtccaaaatattcaataaaacagacatcaaatttaatcagtattagattctaaatctccaggaaagctatgtaaggcatacataaagcaacttaatagcaacctttaacacaattctttttttgtatctttggccaataagtgattaaattcttgcctcattttgcaatagctaccttttcctataagaaatcattttttaaagcttttgtaggcggaggctgagaaaagacttagatcatttggctttgaaccattggcctttcaatcccctatctactaaagacttcctactgtatacattcacattaagatttcttcagaactgcagcgctagttattagtcattgtagcatttcaggtcttgtcctgccatagacaagtccatgactgacatttggagacttctaggtagtctcctggctgagagttatgtgtgaacattgaaccacacctcccagctttctcggggttagttgctcagacatgagaactttcatctgagaggcacagcttgctcatcctgacaccttggcagtgaccttcagacatccttcaggatcatggatatgtttggtattacccgagccaaagactagcaggtgcagttgtggtttttcactcagttaaatagtatgtgggacaatatgggttacacatgtatatgtgtgccactctggctctcatttagggtcacgagtcaagatgaaatagaaattgctatcatgggtatttgagaagcactctgcatttctcagtgtgtgccaaaaacaaaagaggttggtctgagggtcaaacattctattccacaatgcaaaagaggctgcactgcctatgtctgctagatttccccttagcctgcacttaaccatttacattgctgcctggtgcttctgaagatgagtttaattccaaagagctaatctaggcctggccctcccctgcctcactctgagcctttcccaagtgcctccccttccagctcatagcatagggtatcacatagtaagccaggtcagcctgagcactggcactcatttcaaaaggcatctttacgttctacaggaagtagaccaatgatggggttcctcttggttcttcaaagggctgttaactaactggttccatttacagacctttactcttactgggtcacattagaaacaaggtattcactccacctgtgcacccctgatagggcactcctggctttgacaacacatctagttatgattagatttttttctcattaattaatttatttcttcattttacatcctgatagaagccccccactcccagtctcccacacactcagctgcttcccccatcccaccctccccttcttgtggggaatgtggagcctgaagtggctacttcctatagccaagcaggatcaagagtcctagtagagggacaaggacaccaacccactcataaaaccttcgacctaaaatgagattagttttttattgttgtttttaggctggtactagtttcccttatttatttgtaaatttcatacacgtgtacagtagtcagtcattttcactaagcttggaaaagattcacagtgcctccttgccatattggatttgcagatagacccagaattcctctccaggtatttctatcacttctcatctataggcagggtatttctagtctacatctcgcctggtgccttaagtgtctctgtctttgccgtgtatagagatcctctcatcctcaacattacattacaaatttgggggcacaaaggcatcttttacagcagacttctatcataacctttgctacatcctcagaagtcattgagctgaagatggatgtgagagcaagcagggaagagacgttgctcagctctcagacttcatgtagcatttatttggcttgagacaaccccactttctacctactgcttgtaggttcatagatagggagcgactgactctggctttcattttgcctataaatatctgaagagatgtgtgggcagaggagcaaatgggtttgtgcatgaaccatggagttggtgggatagtggtaaatggatttaaacatgtttcctcttggcagctgtggcatggcagcctcacacctggattataaatgccaacagaatagctaatccttatggattctggagatgcagatgttaatgactgctcagtgttcccttggtgtctcagctgccacaggtgttaatttgagctcttaaattggcccctgtttgtcatttgcacagattttcccaacagccatcaaatggctgagatgtggggtgagatttgcttttgcccaccatgtcttgtgatgttgtttcattgcagagaaagcatctgcagtcctgtgggcttagcattttcccatctaagccttgtaaaaccaaggaagggagtttagaccaccagccttgttcttaggtccctgtcctcaaatcctataccttcattaatagcatctaaaaacaaaattccatctgtgtggtataatcacataacctctccctcacattatggaagaataaccccgtgaagctgaaggcccaaataatgcattgttattctccttccctgtcccctccccttcctcctccctttctttcttcctttctgtctttcctctacccttcccttctctctctagaaagcatagctatcaaggttgtttgtcaaacagttaaacaaccatttattgaacgctcattcacaagccaggaatgatgtgaggcctgggaaaacagataaaaggcacaaaagtcaattcagggtgctaaatactgagaagggagtcatgtataagtgggagagagcagctaatccaggccttgaggcacagtctgaccaattaaaaagggaccaagtcattggtattgagcctctacaacacataaggaaggagccaggcagataatctcaggccctttgcacatttttctctggtggcaacatgtggaatggcagaggacttaaagtgaaaaatgcatttaccaggattccaggccagagttccagcggcctttaatggtaagtgagggatatgcagataggttggcttctaaagataccaagagatggcactttaaaccttagcagactcccattgtcaagtggggagcaacttgagcagccgcagtagtgaataaacagagcccatgtatgggctgcacagctcggttagtaacagctgacctgtctccaacttttggctattttccctgttttccagtggctgtgcttttaggtcacctgtggtcactgggaccattcctctcatccatggaatatgaggctccatgttctaattgagctaaatagggcatgactgaagttcatggaaaatgggcagttcctggtgccacaaaaaggctcagcccttgccaagctgactccatcgtgtccaatatgaatcacccactgatgtccacagagggttcctcttccagttgtctcaaaagccaagagcctcttacccttatgaaacttaaaaagaaaggaaaaaaaaaaccctaacctcagtgctagccagcttaatcgttttggactagcttatgtgcatttaaacccttttcatttggaggaaaaatttcccagctaggctgagaaagcacatatcatgtttcagcttgattcacttcaaaaccgccatgaaaattgggacattttcttcacaccacaatgagttagtcatggaaatttttccttaatcacatctaccctggccacagtcatgaggagcataccctaggccgctgagaatttacgtgacaatattaaagagtgtgtccccttcccaatcagaaagcagaagtatgtggcagttttcactctgtggaaagacacaaagataacctgaggttccctttgcagcaagtaacctcatctttgggatatcttcctttgtggtagtttggttccattagtattcataagaatgttctttataagataaaactgtagaaaatgaaacttggctgaaatgtgcattaagagggctaaaagtggctctccatgagggactctgaccctcctcttactgatgagtgacataaacgaggcagacttcttggccatctgtcatggagatgcttgctgtgcgtggctaggctccagcatgcctaggtctttttagtacaaacctcagccaatagagctaagggagctggccaagctccttcactgctgccatggcacacaatgttgccttctgccctgcagctgccacgctgcagcccactaggagctacctctcaagtaggagtgttccttgagatagttaattcattcatttgcttcttcttagtgcaacagaataccaagcgtgtccctcccccaccctaggaatgaggtaaacgttgacgacaaggtcctgctttcctgtgtctcacagtccaaacagaggcagtagacgccacgtttccaagtcattctaagaccatcagagcctgttatatgaacttatccctgggaaagatggggggaaaaaaagtaccctctctcagatagggcaccaaaggcagagtggagtatgattcttgatagcatccaacttgggggccaatgggtttgttggccttatacagcatggatgaggggttacttttagaagcatgaatgatcctacagaagccatgctgccaaaatatctcaccctctatagttgtgtaggtggagccctccttgattaatcttttgctctgtacatactctagttcttccagataggaggtcatatgttattagggcagaatcccatacagtgggctaggaggtgcattcgggcagagtgggaatcttggggcaggggcctattgactctcaaatccctctgtctatgaagggatgaggtagtttcttagcatgaactatctagcatggcctcaagcacctgcaatagaaatagactccttttcctggtgtgaacttagttgtatctgtatgctatgtccatcccatggtgagcccaaggtggcccatcttcggcttatagttccagcacccgtctcctattgcattcttcatgctgcatcactgaacctccctccacctcttgtttccagcccgaagggtgtctgtctgatctgctgtcaactatttgagcctgtaaccgaatgcttttggcaagagcttcaacatctctgtagctttttgcttgtcaggctaacactccttcaccaggtgctagaggagccactttactgatgacatttacttcgtacacttgccttggcagactgtgtactcccagggaatcccctagaacagcgcagtatgggaggtagaaacaggagcctcagttagcctgccagactagctcaatctgtgatctccaggtttagcgagagaccctctctcaagaaataaggtaggaggcaacatcttcttggcctccatgtgtatctgtgtctgccccctcaccccacactctcttttgctctccctacccattttctctatctccttctgtgaactctctctcctcttctcctggctccccacttctgataaaagaattgtctacaggaatcagctccagctacccagcagagaactggagtcaattggcctttaattgatctttaatcacttcaccctgctcaggtttcgcctccagagcttgttttggtttcctggacaaggtgatgatatacattgggcagctcagtccccccggagctcccagtccttggcaatggcttgttccttggacctttcaacagccttctcttccattccctctccttgctgtctactcagcatgtgctcctctgttttgtttccttgctttgctcgctgaggcttcctctgtccttcattgtgccttctgccctccccagccagatctcacccccaccaccagcaaactaccctgtctgaggccccattccctttttccagagcagcccagcatcttcttggctaacctgctgaaagcattgcccatggagcacatactggggatgtttgtgtggagtttttctataatagcaacaaataggaggaggaaggatttaaagacaatttatccaacagtaggaaatagaataggtgataaattgcagcaccaccaaagattatataaagtatgaagaatgtttagagacatgacatccaaggttaaatgaaataagcagagtacaatatgatagataacatgagttataatgtcttattttcaaaaagcctggaggaaaatatactgaaatactaactggttgtctcaatgtggtaagattatcattgactttctttttgctttcatataaaaacctgtgtgaaatgtgtattacttttgtttctggagaaaaacggattttaaaaagatgatttgatatgttaatgtacataatggcttttttttccccacatcaatccagcagtgtaatagggaatttctatttcagacaacacatactttgtagcattaagtcctgtggtagtgcccagagaggaacctgttaagataatcataatattatctaaaggaaaagcgccagtcagccacctctggacaaatatgttccagcagtgcgcatctgtgtcttcccttatcctactggttccctgctgagtcagctggagaagtaagaccttttatgagctcctctcaggtgccagatgccgatgggctcctgactgtggcctcaaagctctgctgattggttctctctttatgatccctgaaggtgttgctctcatcgaggcaataatggtcctcagtcccttcccgctgctcattcctccgagcctctcatttccacacttggtttggaaatccccgaaggctataaaataccaggaccctttgccatgatcacttactgactgtcaaagtaaaggcagaggctttcctcctgacatatgaggacatatgtgactttccgtttatctgattgtccatcactacaatataagcacatttgctggtgtcatcttagcaacttttactctgtgtggcacagagtagttgttcaataacagttgtccagagtgatatttcttgccaagaatcccagtgttgcacaggccagtgctgttcagtgctgctcagtgctgcggagaggcccagtggtgcagaggccatagcttacgttttttttaaatgtggtatatttcagatgtttaaatatggaatgaatggatggatggacagatagatgactgctgacaataatgtcaccaccgaatgatgattctggaaataggacagaattagactcagtgagttatctgagcctgatgcccttgcctaggagctttgtctaacggggtgacacctgatggcctaaccactgtagtccaaacagatgaggcagctctgacatcttatcctttagaatcaactagcattcacaactagcattcacatggccatggctgttatgccttgcggtaactatcttttgtgttgagacttcaagaccgttttgtctactaaaatggttagatttgtaaagagagaagaatcctccttgaattcctcttctgtaccttttgaaagatttatcaatgtgactgttgaagggaaaaaggcaagagctgtttttctcttgcttgctagcatactaagcttgctaagctgagagaaaatggttattgcgttccattctagtcctttattgaatgacccaagggtattaatggcctttgtaaaagacaaagcatactctagattgacaggaggcttattaagggaaagaagcgtgtatatcatactatcagaaccctttgtctttcttcctttctttttcaaaacctgtttcattttgttttagacttagaaggttttgactctgtgatatcatctactgagaaactcagccacccaaccacaagcagaccaaaagctacaggaagacggcctccatcccagtcactcacatctgtaagtgtctctttacttctctatagctgaaaggcaaaaaaggactggagattctggctaaggactcttctgcaagcagatgatgggagacacccagaagaggggaagggaggaagccaccagataaactgccagctaaaaatcctttcgaatcaagcagtatcactttctgtttgctctttgtgtttctgccagcaaggtgtcactccctgtttcccactttccttctgtctccttctaaaccagttcttgtttaaatgtgaagtgaaattggtaaacaaaatatagaaaaagagaccgagccttgtttggtctattaaaaagataaagctttactcaataaagatctgccattatgcactgtgagatccctatttccctatataagtgacctatatctatccaaaccccattatcagcatgcctacagagaaacccatgcagacctccaggaggttgtatttactcatataaaatacatggtttataggcgagaccactgagaacactcagtgataacccacaaatggttgtttttatttgggtagttttaaataacttcttattacaaacctgctatattcgttgtgccaaacttgagcagtgtgatacagaaggaagaaggtaaattttctgtagttgtgccacaagaacaaagaagcaccgtaacgtcttgttgtatccttcacttttccgaaactttgatttgttttttttgtttgtttgtttgtttcaaaactgggatcatgcaatacacatggttttggattaactgcatagcattctcccaagtcattaccaattctcaacatactcaatgactgcctactatgctacagtgtgaggatatgagagtttatctagtgattggactattattgggttttgatgatgattccaagttgttgttataagccatactgacatgaatgtatgaggggagaaaaaaacagcaaaacttaatgtttgttaggtgcaagttttctaaatgtgggccattgggaagtgcattgctttgctgttacccttagttgcagaggtcccctccacgaggtcgtttcccgtccacaagcagtgtgcatgtgttcatctgtctactgatcatctatcagtctgtctgtcatgttgctttgtcctttatagttctacggccttataatctccatccagatataccaagggatttaaccatttgcggatttctcgggttgtttctctttccacctcatcactagtctcacctgtgcttttatcatggcgggcggaggggggcggggagcggggatgccactcccttcgagctctcccatctaatgagtctggaagcatagcttgaattgtcctatttttcttccttgtatgaacgacacctaactttgtattgatactttttctttttttgagatgaagacttgaagaagtggcctccttaaactcttttagaattctgtggtaacttgccttcttttatttctcctgtgttgactctacccaccccagccttcacatacacacccagcctatccagctgcttcttggcatgtttgcattcctactagtcaattctaccactagtgtcttctctataaacccttcctcatttttgttttccttcctaggcttcatcagtcttttaaggtataaggagccttgtgtctttccagaactaaatattaagtggttcaaattgttcccctcttgttgagacagcctgtgttgagagatttgtgtattttcgagaccaagtaatggtagctgatctccaccctccttttaggctgtacaagttgtttaatatcttggtcaacatatattcatagacatctgtcccctgaggacagggcactatgccaggtgccaaggatacacatggtaatgagaaggcttcttttggtgacttaaagcctaacatcttatggagagtgattttatttggacttaaaaccttggtgctttaatgatgtatagtgtgcagatttttgtctctcattcttatccatccccatttggatgtacactcggaatttcttcttcactcttaaaagtagcacctgtcggggttttcctaacaaatgggattagtggataaggaaggctagtgggggaataattgaagaaacactagttatggttccctggcctgggtgctttcttactaattggatctggttatgtttataaaccctaaagggcaagctcatgcaacatgcattgtatagaaggaagctttttaaatcttgaaaggatctgtgtattgcatcctggttgagtaggtaagcctatattaataagaatgcttggtgtgagaggccatatttttggtaattggattttcagattaagtgaagattaacaaataagacctcttgaaacaaaaccttgacttaaaaatccctccccatattttttttaagtttctgtcttagtaagcaggataaaaggaagaaaaaatatttgtgagcataatttttcattttcaaatggtaattctttattaccgttagaaccatttattacctcagggtagaaagcaaagctgaatttaagcttgctgcaatgtatttctagaagacaatttattttataaagaatccttgcaacaggaactcttgatttcatttgttttgttctaaacttgaagcattgtagcaaaggaattacttgtgaccaagagaattctgctgacttgctccccattcagtttttgggtctttatagtgatttcacagtgaggcagaaagggcatgggtgtagaaccacattttacccaatggtactgcctttctataaataaatataccttagcaaatacacaccagaatgggtgtttactgtccataataatgagggcagagattagtagcaaataccaaaggagagagagcatatgctagtgggtagggctatgcactttactcatgatcccctgcctctagaaatggccccctctcagatgcatccttcaagggacgtgtatgtgtaccacgtgtagggtcaaggaataggaaggatccagaggagggtgaaggagaggaggctatgaggcagtctcctattggccatgggctatttcctaccatactgctagcccccaagagctgggaccacttatcacatgttaaggtacatagtaacaaatgtttggagaatagagagactaggaaaagctatacaacagatggttacatggttaaagtgattgatgggcatcaggggcagctcctagattagcttcttctggcttggtccaagtcctgctgctaggtagccatatggttatctgttataagaagataacagcatactttctgcctcacagggttttagaggcagatcaaatagaaatgatgagtgccttgagaagctaacagcatcacataaacaaagctgtgtcagctaaggtatgattctgacgaaggcattttcttttggctttatccagtcttccctttcaagccccgatatctttgactccccaagtcccgaagaagataaagaggaacacatttcgcttgcgcacagaggaatagacgtgtcaaagaagacttccaagactgttaccatatcccaagtgagtgaccagccagggtgaagtgtccctgcccttccatgggtgtactaacaatgggttagaaaccaagcaagacagataaacagacaatgggtatggatgtttgtcattctttagtgacagtgattactgtagtcatcacaattcctgagacacgccggcggtggtggcgtatgccttttatcccagcacttgggaggcagaggcaggcggacttctgagttcgaggccagcctggtctaccgagtgagttcccggacagccagggctatacagagaaaccctgtctcgaaaaagaaaaaaaaaagacaaaaacaaaaaacagaattcctaagacatgctgcagagtctctgagttgtgcatacaggtgtttattttctagtttcacttatagtcagcgttcttcatcctgtcacatttataaaaaaaaaaagccttcagacacccctgtcacctgatcaacttaaaaagctgtggagtatctagatagactacattacatgttgtgctctctgctcataggccttgtcttttatattcaaaactggcaaaaaaattatatatatgtatttaattttatacttacattatctcttaaggaaaagttgacttgaattcatgctttagagtaaatttggcctctaaagcattttaatttcactcggggcccaggaaatggtaaagctgatttaagttgcttgtttctgagaaacaaagaaaacattgttgtgctagcaagcacccacagtcccgcctgctcagcaggttgaagtgggagcaatcacttgatttggggaatttgagcctagatagcatagtaaatgaataatctccatctcaagaaagaaagagacgcagagagacgtacacacgcagggagacacaggcagagacgcagagagacacacgcagagacgcagagagacacacgcagagagacgtacacacgcagggattagagggtagagacagagacaccaagggagagaagcgggtgaccagcagaagtgtgtctcagtggaagaatagttgcctagtgtgtgcaaggccctgggtgagagtcccaccacaaaagagcattgttcagccagtgcatgcagctttgtagaggaagcctctcctgcgcgctcagatcttcctagaaataaatgacgacttttaaattccatcttcttctaagaaaatcgtcaggtcggattgggttttttttggaattttagcaacattttaatgtctagaagcacaaaaacagtagtcatttgaagcagtcatcagcacaaagaaatcaaaggttggatgggatttttctcctcataggtttgagtgtttgcattgcggattttcttgaaaatctgatacagtaagcagaacatgatcctataaaacagatcaattttaattacccacaaagccaaggcagtcttccttttcaaaggattctgtttactgaaattggattcaggccagtttcattgtttagttttctgatgaccataggcataacttcagtttcctgttctctgttatctcaatgatgtctctacagtgacacctactggctgatagtggcttttcaagtttctgatcggcacggctctattccattagcctatttcagttccctggagttgtcaggctgtatatttcactccttcaggaaattccacgtgaactaatttgatcaaggactgtggtgacctagactgtgtgagggactaaaagcatacttgttagctgcagtgggctagtccgagagcccatcagacagaaaatggtgaaagaactattgatctaagaagtatcctgaagcctgtattatgggcgctggtggctcatgagaggtaagagaggaagggaaacggaagaaggagcgagtcctggagtctataatataagcagcaaagaaaacaagagaagagcacagatatttgagctccatcagccacagtcacagtgctggactgaggatccaactggtaaagggggaattgaatgtcagttcggctggttattagttccaagactcagggagtttgccctataggcctcagtttcctgcttcatacagtgtgtgtgcaggctgatcagtttactttgcaagctgatgtccatggtgcagccacagctctgtaactgtcagttctttcccccaccccccatactgtaactcggagtaacaacaaagcccaggctggcggagtactctccctggcagcagacagtgcttttcctcaatggtaacttggcagagaaaaggctaacagcgagactaggaacgatggcccatctgcttttggcacgctctgcccagtctctgcctctagcacagcctgaatctagactctacctccttgctgccgtgccagctgaaccccttcttggcgctttccctgggatggccggctgagcgtctgctgctggaggaaatcccatggttgctgggccaagcttcaccaccagcctcggtctccaccctctcacccacctcctctgctcccaaagtcctagcccactgctttgccttttccacactcgcctatccactcactttcccttgctagtgtttcttctctgggcctgccaggcacttgtagtccctctcacccaaggctgattcccagcctgtgtgttcctgtcttcctcaccacacctctccatcaggcctttcccacctctccatcttcacctgtccatctcccctaacatctcacacagcccggggtctcactcatcggtgaaagcaaacaaaaccttcttccccttctatctcctcgtgaagctgctgcatgcatttgcacgcacgctcctccatagccctacctcacccacatctgtggaaagaatcttcagtttgccagccatatctctcagtgcccattcatcaactggtctctcatctttgggtcactgtctccatagttgtactaccaaatgggttctgttttcctctcaaccccgctgacacacttatccagcctttcttttcctctggggatttccatcagctcagcccttccactgctctttcttcattctttctctcactacttctcaattgtcaagagctctctcccttctcttcttgcctcattgatttataaccccccagcttctaccctgggcatctttgcctctctctgacccacacccatgacttccatttcctttggccaatcttattatatgagttacttgctctgcctactaggtataccctctcagctatctctctgattcctaatattcaaaaccaaaacaattatctgggccctcctcaatgaaaggtaccacctttactcatttcttccctcccctcctatgtttctctctgtgtgtctctctgtctctctcgttccctctctctgtctctctgtctctctccctctcctcacctctctccctagtctgtccaggcctcatctccctgacagtgggtagtgtgatctatgaaggcagggatgccattaaccttacccagtcaccactgcagtcccaggagtgatacctaatggcctttgttacccacatctctcgccatagtcttcattctagaccaccacctgtttctagtgtgcattgtgtcagagtctcagaagctctatctagatccaggcctgccaactctccagcctttctacccccacagcagccatgagcggggtgtgcagccatttgaacccgccccttctcttctcactgccagccttactttctcctcctccctttatctgattcccactgtgttttccttcctcgtctctaggccattgtctaggccctctcctcccctcctccttcgtccaccttcttttcttctatagtcttttccctctgaaaagagggaccattggctgcttgcttcttccatcctggaatgtggttgcttgggtgtgtttctgaggctctctatgcttcctccctcttgtccagtcttcctcctgtgccacagtgtattgcttgtctgtctccactgcccccagtgagttctaaggacctaagtaccatgcaaatgtcttgcttacttcagggtttgtagggcctgccaagcagttttgcatctctgtgtatatgaaaccaatctgggattgtcttgtctagaaagaagatgaaattgaaaatatatacaggtagcccttgggcagtggtctgtctggaccaagcaggccatagatggtttatgaatgagggaataaatgattagagtgtgtggagacaggtatggggttgggtataaaaggaaggtttgacttcccaggacaggaaggcaatccctgcacagatcccaggctctgaagcctctccactttcccttttcacaggtgtctgataacaagacatccctgccacccaagccagggaccatggcagctgccagcagtgggccagcttctctctcttcagtggcatcctcacccatgtcatcctctttgggaacagctggacagagagccagttctccatctctgttcagcacagaaggaaagccaaagatggagccagcagtgagcagccaggctgctatcgaggagcttaagatgcaagtccgtgagctgaggaccatcattgagaccatgaaggaccagcagaagtgagtgctgtttccaggtggctctccattgggtaaccatggcctagttctgaaagcttggctctcactctgcccagagggtgggctaggccttcccattgacaatggcagaagtgctgcaagtaggtatggactacacatccctggctcagaagcctctccaccttcccttttcacaggtgtctgataccatccctgccatccaagccagggatgtgtgtgtgtgtgtgtgtgtgtgtgtgtgtgtgtgtgtgtgtgttcagcctacggtgtgccaaagagcacagaatattcagtggtgagtcagttgcaaggagagtctcagaagacttctaaaaagaaaataaaatttcatagaaatatatatcatttctatgtcaatcagcttcttaaaatcgtttccaattacatttagttagtgtgtgtgtgtgtgtgtgtgtgtgtgtgtgtgtgtgtgtgtgtgtgtgtgtgtgtagggaatagagggcagacgatagcttgcaggacttggttctgtcctcccacaatgttaggtctcagagattgaactcaggtcatcaggcttagcaaccttcacctgcttagctacctcaccagattgtcaccactgtggcaggattttgagaaaatcaacttttaataagggaaggctcagagctagagagagagcttagagggttatgatcacttgcttctcttctagagaactaggggttcgtttcccagcacccacgtagcagctcacaactgtgtataactccaatttcaagggatctattgtcctcttctggcctatatgggtgccaagcatgtacatgctacacacatatacatgcatacaaacatacatacaaaagaaaagcaaaattgaaaagggagtgggtgtgtgggctcatggtttcagttcatggaaattgagcatttgggttggagcagcatatcatggcaaggaacatgttaaggggaaaactcctcaccttatggtagctaggaagcaaaaaggtgacagcgagggggtaggtgtcataatatcccttatatacctaataatctaaaagttcacaacttctcagtagtaccacaggcctttaacctatgaactcttggggaacattcaacagccaaaacaataccagtacatatacaaattcatttgattttgctttcagttacgtgtgtgtttcagggaggaggcattgtgcacttgtgtatagggaccacagagagtctagaggtggacagtcccctaggactggaattagaggtggctgtgaaccatccaacatggctactagaatcagaactcacatcctctggaagagcaatatgcactcttaacctgtgagacacatctctagcaccatctatatcactaactttttctctagtgttggggaaaaatagagcttcttaatttagatgacagataaaacaactggcttgcatcaaggggctataacataggcagaagatgtagggaatctttaaacccaagatttcgctgtcagaaagatgtcttcatcatgagactcaggggtctttcctcatgcatgcccacatacatactttcacatctcttatcctcagggagcacttgaatgagaagaaaagcctgtgaacaaaaataaaatatcctgccgccggattgcctgggatgctccttactgtgagaaagctggtagaaggattagcagcaggcggcacttaaagaaactgagggtcagagactatgaattgagagctccttgtggaaagaatcttaagatacttctcagggaagcatttcatgagcattttgaaaactgacctagaatgaccgggagcagggaactttggcagagagaatagcaggcagctcatgagcaactgaacagcctggtgggtcattgcctccctgggctcctggccaccttggttcagaaggtgcatagggggtgatggtgagagctgtggcctaaatcctgcagcctgggggaggggttctggagctgctgttgactgacatttgcctctcttaaggatggaggaccctgatgtattttgtagtcagacaccttggggaacaattgggttaagcaaagttagtttatcctctgaaggactttttgaagtcttcacctcacattgagaggataaagaagacaacatatgcagttttgcaaatgcatgtaaccacagaactctttaacgtgttctaggaagacggttccaaggaactaactttgaacagtgtaggtgtaggcaggttctgtttcactcaggataggcaatggggaaaattgggcttcctcaagtcacttcctgactggaagagattcatcacataaatatgcagaactggtgaaatgacattggaaagagtttccttaggtcacccaggctcccccaaactccttaaagttcctggttcttgtatggctctagaaccaataggtttgggtaaccaaaggccatctctatccagttgagcacatgtcatttgccaagacagtgactccatgattccatgacatccagctttctggacaggacctgacttgcctagatccaggtctttagaactttacactcgggatgggggagttggggtggggggtgcaaagcaggctggaagctacccacaactctgatagcctgaccttgtctctgagtccacaggcagctgtgccttaataaagcctgtaattggccacaacactcctctcccagccagcatcttatttaatcagtaactcaggatgttaatcacctcttcaaatccttgtgtctcatagccttccttagcctggccatcctgcccaaggtcagtgagttccctccagtcttctaccttctcccctggtgacactttccctgtagcattcaatccatgtctatcctcctcctcaaatgtgccttgctttcagaagcaggctcaccgccctgctctgccttgtataccccccccacacacttccccatctcccttttttcccctgtagacagatacccgtattccctagctcaagacatagtggctttctttacaccatcttccccaactgacttccttttcctagaccacagcccacttaaggccatgcctgccaggttttcctgggggttgggtgctggtttaggacttcactgttgatggctttcctaagccctaagtggtagccacacagatatggatgtacaatgtgagcttaaatgactatgctaaatcactgctcaccagtctcagataaccagtaatcagataaccagtgtcgacagcagtgctaggacagtctcaagtatagaggaccatcactggattcatctgcacttgaactagtgtgcagttgctggttctgtattcaccatgctgtttctgaagccttctgtctgttgttgttgtttcatttcacaaatgtacacatgtctaatacctcccaacaaaagaaatgcagatcttagaccagtccaaagaacagagccccagcttttcagaataagtagctacaatcaactttattacttcaagttggaaaatgcattaggctgtcggtcctatgtttgtcttctttcagacttcatttctatactgttaactcatatgtttaaggtccagttagtctatctttttttttaaagatttatttatttatttaatgtaagtacactgtagctgtcttcagacacaccagaagagggcatcagatctcattacaggtggttgtgaaccaccatgtggttgctgggatttgaacttcggaccttcggaagagcagtcgggtgccactgagccatctctccagccctagttagtctatcttaaggtaatgtcagtctgtaagattttgtgagaattactgaaaacataccagtggcttgttcttaacttaagttctgtataaaagtgaagtatatagagagtggtaaaaatttctgcaatgggtctagggagatggctcagtaagaaagtacttaccacacaaacatggagacctgagttcaaatctcaagcatccacgtataaagtatctgtaattccagcactgcagaggcattaatgaggctctcaggtcttcactggtcaggcagtctgcctgaatcagcaagcatcaggttcagtgagaaccggcctcaaacaacaaggtagaaagaaattgagagtgacacgtgatattatcaacctatggcctctacatgaaaatgcacatacaaggacctgcacatacccatgaacatggaaaaaaacacacaaaaaagtctacaatgaaaattttctataagcacccagtgtcctgttataaaaaagaagttagaggaaagatgacagactatgagcttcagtgctttgactctcattatttgggaaaccaggccaccactctgtgccttagcttccctatcttctcctattggaagaaagctaacctagatcatactaggtcatctccagacctaacagttgaaagctacatattttggtgacgccttcccaaataatggcagacttttctgtccaaaagaaatcttcagacgtcatagtgcaaagtaagtgtgtttgggtgtggtgacatggttcagtgagtaaaggggcttgccaccacctattttagatagctttctcttgctgtaataaagaccatgacaaaatctaacttaggaaaaagatttgtttgggttataggttacagactatcgtcaagagaaaccaaggcaggaatttggagtcaggaactaaggcagaaagcatagactgttgcttactggcttgctccctgtgacttgctcagcctgttatataacaaaggacccacttgacaggggcagcagccgcagtgggctgggccctcgggctgggccctcccacatcaatcattaatcaaaaacactccacagactttgcccacaggccaatctaatggtggcattttctcaattgaagttctttgcacatgactctgtcttgtatgaaggtgaccaaaacttaattaaccagcacaccacccaacagtgcaaaccagggatgacctgagttccatcatcaggggaacccatgtaaaggtggaaggagaaccagctctactaaagttgttctctgacctttacacaatgtagactgcatgctctcccctcccacattatgcatgcatagagagggagagggaaggagagaggaagagagctacagaggaggaggaggaggaggaggaagaggaggaggaggaggaggaggaggaggaggaggaggaggaggaggaggaggaggaggaggaaataaattatgtttggtccatactctctttggaaaaaggtcagatggatttcatattgatacaagactttcttatctctcattgggaaactctgggctttgatttgattccattggcatttgcttttcagacgtgagattaagcagttactgtcagaattggatgaagagaaaaagatccggctccggttgcaggtaggtccctcagcactcgtccatgaggcctgggttcagttgggaatggaggcaaagtcagggcttcaggttgaaaagaaatgatcgctgttgggcatggtgcctcaggctttttaattccagccctggggaggttgaggaaggaggatcacaggatccagacaaacctgggctatcaagagatgtgcatagcagcctgagctaccaagtgacatcctgtctgaaaagaggggaaacaatgaaaaaaaaatgattgctgccacaagaatgtctcagaatcgttatattctgtccttacctgagttccagaaggtcccagggaaggaagagatgaatcagcatactcagttaggctttctttattttaaacacatctactgtgaagcatcccctccggttagtttttaggatgatgatacaggatgcctcatctatattaagtaccagaggacatggcatgcaggagactgctgctgctgctgctgctgctgctgctgctgctgctgctgctgctgctgctgctgctgctgctgctgctgctgctgagttccatcatgtggtccctccagggatgacagatatacacactggtgtttcatctcaactttttacttttccccaaaggccttgttgtttcttccaagccatctaagctctgtcccccacctcgagctgctgatggagatcttgtgggggatcactccagatgaccaaaaactaacttttactgtctattcagtttggacccaacctacttaaaaagaggatagaaatggttcaaaatcctggtgggactgtggaacccaccttttggggtcacccaaagctgccttttatcacacccagatggtcctatttgcctgccctgtcctctggcaaggaatctagaatcattgctgcttctcataaacttgggagcctaggaatctgggaatgactaggcacaccacttgtcagggtaccacttgtcagggtaccacttgtcagggtactatacctatgtgcctgtctttatgtttattttgtttttggcattgttatcaattcttcattcagatgtcattttgacagttttactgctcaatttgtcagcgtgagtcttttcattgcattggtaaaggtatattatctttcagcttctctaaatgcagccatttcataatgtctatatttgctgctttccccccccctctgtatagatggaagtgaacgacataaagaaagctcttcaatcaaagtgattacttgataattgagacatcacattattcatcctgtgtccaagactcagatattctgccccagtcaaaatcatcttgtgccaaaaaattagaggtttgattcatcgtgtccctgtttgaacgtttagcacaaaagtcttaatagcacaacacaaattccatccaagaggagactctttcccatggtgttgtcctgggtctggcagtggttgtgatttatagccaattgtgctaaaggatttttctaccttgagatctcccgagaaatgaaaactcaggcagtttagtccatagtagtactattttgatgatattttccattaacaaaatgtaatttcagattattcgtttataggctttataattttatggtttttttttaaaatcgtgttttgtcacagatgcccctagtgtttgtgctaacctagtcagaagcaagtgtctcactcacttgctgcagatggaacaaatgccgcctggctttgtattcccctttaggattctattacatatgcaatttgaggtctaacttgtccctttccctgccagccaacccccaccactctaagagaaattttagcttatatatgacggtatatttgcaaaaagagaaagaaaaatctggtatttgcaatgatctgtgccttctttctaccaccctcttgattggagcttttgtgatgcagctaccatgattccaaataagtaaaaatcagccacttctccctgtccactagaggtcgctgtcttcacagcttctctcaccctagccaaaggtcctaagaggagacccgctgtgaagtctggcctgctctttggtaccagctgtgacttttcagtttctcctgctttgaggttgttcacgaaactagaaatgtcattccagcttgattgttttatcatcagccaagttaaacccctgcttcctgccttttacacctattgcgtgaacagaatatgcattattaaagcaaaaataaataaaaaataaaatgcaagtgaaaacagggggggaattggattatttcctgcactgggttgtgcgtgtgtgtgtgtgtgcgcgtgtatgtgcgtgtgtgtgcgcgtgtgtgttattgtttaaattgtattcacagtgttgtttgccttgctcacttgtaaccccctcctcggatctaggagaatgggaggagggtctcgtggaaatgtagctattggatctttcctgcacttatggaaatgctttgtctttcccaatgaaactgatgtttgcttgtctgctttctctttatagtacatgaacagttcagccttagactatgtaactgttttcttatctttagctgaaaatggggggagggcattctgtactgcaagattgttgatggggtagaggtggaggagtggtcccttaatgatcccccaaatatgtgtgtgatgtgtttctaaactgctgctttgtctatttcctgcattttatagtgaaactactaaacataaatagattttcactaccacaaagaatgagaattaatgacactgaaggaatgatgcaaaaacttcccatgattcatcactgaaaatatgactaataaatgtctcttcctttttcttcctgtctccatccccatgccttgttctaacttgcatacttgtcctttctgctcgaagctgtcacttccttctaaggatttacagaggcctagggccctaaccttcaggggtggggacacaattaaaggaagggaatgtataaagaaattattcttcattccaatatatgaagatacttgccttttcagcagcgatggtctcagtgtgcttggggcaggagtacatagtttctatgagcgatataaagagttcctgtttcccttcactgggcctaagcctttctgcattacacttgaagccttcagtcatttcctaccacttattacaacagtgaggactggattcttgatgtcttaatttctcatttatttgtctagaaaatccataatgatataggacatttataccgagtgagatcattaacaatgaaattgagagattagagcatcctcactgggtgatggtaacagggaatgtagagggctgatatcttcccctaagagaggcattagggttagagagatggggagggagatatataaatggagagaccgagacacacagagagaaagacaccgagaaagtaattatagagaaataagctggtacgtccagcttcattactatcccttgggctaaccagcaagaagattgtacatcacagaactggatgagccaaacagccaccatctttactcttgactaaatggacctatcaagaatattaaaaagcttggaaataccctatccacttttgaaaaattagaattcctttgcattcagcatggactcagccaggaatctatggaggatttttttttttgcttcattttctaaagttgtatttagaaatatcttatgtaatgtgctttgtaaaagaagatgaattaaaatgaaattttgtgaaaatatttttgttcaaagttgtcacagtccaagaggaatggtatcttggaacacaaaccccttttctctattttacacaatttgagtactctgtcagaaatatccttagaagacaggaagtaatccattaaaatctgtgcctgtgaatttgatttttaaaattgttcgattttacattcctatcgaagcgtaaaatgctagttaggtacaaattctttttttagtgtgaaaaccattaaattattattattggaataattgtgtaaagacatttttatttgtacacagccctcaaggcacattcaagtacacgatccattttttccaataagaacatcctgggcctctcatcacatgtctctgtggttagtaatggtggggtttgatttcctttcacaagcagctcctttatgatcagctgcagggtgtacaatttattgcccatagttgccatggtttgtataaaaataacccccagtttccataaagacttttgtattataacctgaggtcatcatagtctctttctctctctctcttttttttttttcatcagattaggttttagtcctttagttatttttgtacaaactaatgtcaagatgtttctgcactaagagggcttgatgaaagcatttccctttgcttctgtacaaatgagaactggaacaaaacaacacatttatgagtgacagggtgttcagcatggctgattgtagcatctgacggagagaaagttgggtgctcaggacttggcagagtgacagagataatgttcctgaacctagctgggcagggcctcgaaaaaaaaaaaaaaactctttctgatccagaaataaatgtcagccatataaggactattaaggaagatcaactcacttaaggagatgagccttacctacctaccatgctcgagttctctccctggctcacaaggctttgttttcaagctatggatttgaggtggttcctggaatggaccaccacccttggagaaggtgcagttccttgagaagattttttttctttttccaatattttattaggtattttcttcatttgcatttcaaatgctatcccgaaagttccctatacactccctctgccgtgctcccctaccaacccactcccacttcttggccctggcgttcccctgtactggggcatataaagtttgcaataccaagggacctctcttcccagtgatggccgactaggccatcttctgatacatatgcagttagagacacgagttctgggggtactggttagttcatattgttgtttcacctatagggttgcagacctcttcagctccttgggtactttctctccttgagaagatttttatttgtatcttttacttgatctgaaattgcagtggccatggggacagaccattcttgtgaacagccatagctctatacgttcacttgtaaatttggaattcacatcaaagggtggtatttatttatttattattttctttaaggcaagctctccctcaaacttgcagcagtagttcttctgcctcccaagtactttgggatgagggttcagtgagcatgcccagtgaggagtatttcaaccacatcatagaacaatgtaaatgtggttgtaaatctaggttttgatgagtgaggttttttttcccccaggactgtttttccacagtaccagaatttatcaaataacttcacaaggtacagtggtttcagtgacagcaatttaccagctactattaatttccttgataatcctgacctaggtaaacacaagttcttatattccagtcttcattattaactctcagatcacccattacatatagacatcaatataattaaatatataggttacagaatggttctaaagggttaagagaggcccgagaagcaggaaagctcacagaggtatacagtctctcttaagagattactgctgatcacatgtttgagaatggaattgcaattgagtctagatacagaggcgtaagagcaggaacaggttcacacaaaagactgggcagatggaccaacagcatatccagatgggcaaacagaagatgggaagatggcagctgggttaggctgtgtcaacagcaagaactggggcccagccaaagcccccgtgacagttgagggttctctcacatttgagggttctctctgtgggtccttgatacatatactctgtgacggtcagatgacaagttagaggccatcacctttgtagtactagatgtaaacctctttatatggaattacattccccctcccttgttctagtgtctttcctaatttcttgagcttggttcccctgatatgatttgaatatgttcatgtgtccctgcagtctcaatccatccccaataaattaaagagtggcaccttttatactccca

SEQ ID NO: 352 - DNA, 555 bp, mus musculus
ggtcccctctcacacacacccgcgtggcctggactgcgagtcgtggagcatcccgtggggttgcggtggggtgcagcgccgaggctagcctccccgggtgtccgttcgggttcaggctcggccctgggcaagcagcccgtgcttctttcgccaggtgcagaaatcctaccgcccgtgcgccctgggcgcgccgccgggccccgtaccggctccccgggaatgcggccgtcaggtgaggtaggcatgcgtgccggctccgcagcagctggctggggcgctgggctggggatctgcctcttctctccccgcaaaggagaggcctctcgggtagggagggggctttccagagcctcggtgcgttatgaccgcattcccccttccctttttcttttatcttagtttctccttcagatgcaagaagggagatcacaggaatccatgcccgactccagtctaactccgtccacaggcagagagagaattatgaatggatgctgccttctgatgaggaagtcgactggggaggtctctgcgcacggcgcgctccatcaaagc

SEQ ID NO: 353 - DNA, 555 bp, mus musculus; identical to SEQ ID NO: 352

SEQ ID NO: 354 - DNA, 555 bp, mus musculus; identical to SEQ ID NO: 352

SEQ ID NO: 355 - DNA, 555 bp, mus musculus; identical to SEQ ID NO: 352

SEQ ID NO: 356 - DNA, 2281 bp, mus musculus
atgtcaaaaacaaacaaaccaagtctgggtctcgctcttctcgctcaagatctgcatccagatctcggtctcgtttgctttcaaagtctcggtcccaaagctgatctgtctctcgttcaaggaagcgcgggctgaattctaggtctcattccagatcatattctccagctcataacagagaaaggaatcaccccagagtgtatcagaatcgagatttctgaggtcacaacagaggctacaggaggccctattacttccgtgggcgaaaccgaggcttttatccatggggccagtataaccgaggtggctatggaaactaccgttccaattggcagaactactggcaagcatacagccctcatcagggccattctcaaccccggtccccaaagagaaggtccccttcaccacggtccaggagccattctaggaactctgacaaatcatcctctgacaggtcaagatgctcctcatcctcccggtcgtcctccaaccacagcagagttgagtcatctaagcgaaagtctacaaaagagaaaaagtccttttccaaggatagcccgccatctcaggcagctggtgataaccagggagatgaggctaaggagcagacattctcggaggcacctctcaagatataaaagggtctgagagcccaaagccatggccagatgccaccacctatggctctggttctgcatcacgggcctcggtttctgatctgagtccctgggagagaagcccagctctcaaaagccccctttgagagtctgtggtggttaggcaaagttcaccacgccctagccctgtgccaaaacccagtcctccactttctaatgcatcccagttgggctcctctatgtcagggggtgctgggtatcagtctggagcacaccaaggccagttcgaccatggctttgagtctttgagtccatccaaaaagagccctgtgggtaagagtccaccagctactggctctgcatatggctcatctcagaaagaggagagtgctgcttcgggaggggcagcatattcaaaaaggtatctggaggagcagaagacagagaatgggaaggataaggagcagaaacaaacaagtgctgataaggagaagctgaaggagaaagggggcttctctgatgctgatgtcaaaatgaaatccgatccatttgctcccaagacggactctgagaagcccttccgaggcaaccagtcgcccaaaagggacttcgggatgactttgagaaaaagatggctgacttccacaaggagatggatgagcatgataaggacaaaagtaagggaaggaaggaacccgagtttgatgatgagcccaaatttatgtcgaaagtcatagccggtgcaagcaaaaaccaggaggaagagaagacaggcaagtgggagagcctgcacacagggaaggaaaagcagaggacggcagagaaactggaggaggagcctttcacggagagatcccgaaaggaggagcgtggagggtccaaggggagcaaaagtgggcacaggggctttgtgccagaaaagaatttctgggtgactgcatacaagatggtccaggagaaaagttcatccccgcccccaaggaagacctctgagagccgcgacgagctgggaaacaaaggagacttttcctcagagaagtcttccttttccattactcgggaggcccaggtcaatgtccggatggactcctttgatgaggaccttgcatagcccagtggctttattggctcaggaatgaaagatttgtccggatctagtccacagcaacaaaaaggagcaggaattccgttccattttccagcacctacagtcagctcagtctcagcatagcccctcagaattgtttgcccagcacatagtgaccattgttcatcatgttaaagagcatcactttggatccttgggaatgacattgcatgaacgctttactagatacctaaagagaggaaatgaacaggaagcagctaaaaataagaaaagcccagagatacacaggaggataggcatttcccccagtacattcagaaagcgtggtttgactcatgaggaattgaaaagtccacgggaacctggctacagggctgagggaaaatacaaagatgatcctgttgatcttcgccttgatattgaatgtcgtaaaaaacataaggagagagctcttaagcgaggtaaatcaagagagtcagtggattccagagactctagccactcaagagaaagatcgactgaaaagacagagaaaacccacaaaggatcatag

SEQ ID NO: 357 - DNA, 2281 bp, mus musculus; identical to SEQ ID NO: 356

SEQ ID NO: 358 - DNA, 31473 bp, mus musculus
catgcgcggccagctgagccgccgtcagagagggtgggccaagcttcgggaggtctccggttccggtcagtctccctcgaagaccagcggagtcggatcagccagtggttaagggtgccagggctcttgggcgaggggaccgcggcagaggcggcggtgaccccgcgggcgggatgttcggagggttgagcagttggctgggcttgaagccgcccgagggggcggcggcggagggagaagagcctcccagccgggacggggacaagctgtccgcgggagccgcgccttctgaggagagccccgagcggcccgtggagcccactgaggagcagcagcagcagccgccgacggaggacccacagttcctccaccaggccaaaggccttggcagtgagttctctctgggacctgagagtggactgggaggggacgcggggatgttgatgtacgaggagggggacggtcctctctgacatgggctagttggctaaggagctggacaacgccaaagttcaccaagcagtcacttcatctcctcgacgtgcctaaggacttgtcgctttcctgcaaagtttgtaaacttgggaagccggaaagcgatcagtgtgctgctgtcttcagggttttgacaaggaattcggtttgttcaacttgaaaacgttcatttgaatctccaactctgactcccagctagaattggtttagaaaaatgccttttgtcccaagaaaggactgaaaggtattgtctaaagtaacttcgttaagttactcgagccgtggtggtggctcacgcctttaatcccagtactcaggagacagaggcaggcagatttctgagttcgaggccagcctggtctacagagtgagttccaggacagccagggctatacagagaaaccctgtccaaaaaaaaagttactcgagccatagtcattcatgccttcttttgatttttttgaagcagggtctcaatcagccctagatggtttcgaacttgccataaagtcaaggatgaccttgatcctctcacctctgcttccctgtcgcttcgcgatcagtatttttttttcttttcccctttcagcaggacctttttcccttaaggtgggaaagaaggtgccaattgtctgctatactcaagttccagtgctagatctttggtgaataataaatccctcatttcatctattcacaatccccaaggggttggggaaacaagtccagcgttttactgatagtagtacaagtagattttgagccaaaaatctacctgatttcactttccaattttattatccagttgaacaaacagtagttcttaagaatataaatacctgctgtattaattctcgagagactttggcaggcttacatagttaaagaatgtgatttggggggaggtgggccctaagcagaagtaaacataagagaattgcaacaaaaatatctactaaattttgtgaggctttttgttctttttgagatagccaaagctggcttcaaattcatatggccaaggctggccttgaacccagccctccttcctctctcccgattactggagctcaccaccacacagccacgaaattttgaaagttttaaggacttatcaagtcaattaagggtgtcaaagaacaaagacgcacagacttcagcaggaaaggtcctattgttcaaaatgtttgactgtaagttagaggcataggggaaatagccacagtatcaaattttaacagtacattatctcagccaagactcccgaagactggacaaggaaaataaaacttagtgtgataccatgaaatcactagaaaaagaggatgactatttgcagcttagaaaattgggaaagagtagatttggaatatttaaggaatgtgagaagggttcactggagcagaggttgtagtgtagttgggatagattaacgtgggataaaagtcaagtatggtggtgacataggcctgtaaccccagtattttggggtcttaggaagatcagcagcagttcaaggccacatgagacaaaaaacaaaaaagctggccaggtgatagtggctcttgcccttaatcccagcacttgggaggcagatgctggcagatcaggtctacagagttggttccaggacagccaggattacacaaagaatcttctccgcccctctgtcacacataccaagccagcaatcctagctatttaagaagctgaggcaggaggctctctggatctagacctgcttggaatgtgagttcaaggccagccttgacaacctagaccttacctgtaaaaacaagaaacttctgattctcctgtttgtgcctcccaaatgctaaggtggacaccattatgcctggctaaaatttccttgacttttttttttccaagactgaagaacttagggccacacatatgctaggcctctgagcagtatctcctgccatctttcttcataagtttctccagggtttctcttttggtagtggtttttgtttgttctttaccagattgtcttgatgtttgaagaaagtgagtttagatggaactcccccactgccagaagaaattgtttggtaaagttccaggataaatgaaagctcttgcttgcttctgtaatatatgtgactttaggaaaatgtcaaaagtgtttagagaggcgagagaaattactagagatgttttaattttcttcatattggccctaaaacaagttttttttttctctaagatctatttgtggacttttcttagtttggttttacggttttgttgtttgggcttggttctgggttttggggtttgtttttttggttttggggtgtatcccaaggctagcctcaaacttcctacatagctaaggcggacttgaactcctgcttccacctcccaagaatattcactgaacagcaaatttagccataccaagcctgcttcctacctgtgttttaaaaattgaagtatctctgaacttgattcccagtaagtagtttctttagacctttgaaatctactggaattcactgaaagttccatttgttaagcaaacatttgttgaatccttaccttcagggatgctaagtacttcctgtttagtagtgtggtttgaatgtgcttggcccagggagtggcactactaggaggtgtgcccttgttggagtaggtgtgtcactgtggatattggctttaataaccctcatcctagctgcctggaagccagtcttctgctagctgccttctgaacaagaggtggcactcttagctcctccagccccatgtttgcctggtcactaccatgctcctggcttgatgataatagacctctgaacctgtaaaccagacccaattagatggcatccttctaagagttgccttggtaatggtttcaattcacagctctaaaaccctaagattggtattggacagagactgaggtattgctgtgatagacctgaccatgcttttgtttaaaggaatgtggatttggggactttggaaagcagtgaaatgctttcagtggggcttaatgggctatcctagtaggtatatggaagattttgttgctgagggtgacttgaactgtggaaacctgactccaaagttctcagtggtgaattttaataggttgccaagagactgttcttgtgatattttagtgaagaatgtggctggtctttgctcttttctgaagagtctactgaggctaaagtaaagagatttgtattaagtgattgtattaagaagtctcaaaaaaagcccaacagagactttgttctctggttgtctcatgagtgttttgaacaagcatagcaagcttagaaaggaaaactataaaatatatggttcacatattaaagaggtaccaggaagtagaatggagataagtcctatgttctacaagataacagattaacgaagtgggactttggggcaagatcccacccagcatgtggtacacattaagtttcaggagacaaaaccaagcagatctctgagttcaaggccagcctagtataggacaagttccaagtagagaaaagcttaaatcctggcatggtgatacacacctttaatcccaggagacagagccatgcagatagttcaaggacaatctacagaacaagatccaggacagccaagcttagggagttgagggagttgaaaacagaaagctggtaagataataaggaggatcatgttccagccacaggaagcagaagaactccacagctttgaccatatggctctggctttagagcctagaatagaagggactactggaacaactaatgctggttagctgcagttaagaaattagcagtgattaaggagagaccatcgtgaaatcttctaggaagtgttttctgagcaaaaagaagctatgttccagagatagccaaggttgtacctcatgctatagctggatttggtaatatgtaagagtcaccgaggtgatactggttttgaggcttggcactgtgagaggccatggaaggccactggtaaaggttcagcctcatttgcagttgatggcccaggactgaaggggttatgcaaaggagttgatgtttgggaccatgaagagagcctatgagaggtgcaagttggggtccaacttttaggagttgggcccctcctacaaccatatggaagtcattgtcttggtgacaagtttctttacccactaagccatctagccccctcctacttttttttttttgcagagggtgacagaatcttaatatgtatccctggctggcctaggaatagctatgtacagaggctagtcttgaattcaaaggaatccatctgcctcccaacggccagtttaagggcatgtatcgacatactgagccagtttgccagtctccccccccccttgctcttgctctgtctgtctgtctctctgtctctgtcccttctgagatagtttagtttctctgcatgaccctggctgtcctggaactcgctctgtagatcaggttggcctcaaacaaaccacctgcctctgtctctgaagtactgggattaaaagcatgtgccgccaccacccagctccagtttgccagttttcaaatgttttccttagattaaaatacggtgtatggagtaaatagatggttcagtggttaagagctatgtaactatgaggaccggagattggggcccagtgaagatgatttaacacacacaggactatatgggcaaatagtcatcggcttcgtgttgtgccactattacaaaagggacctgagcaagtatagattttggtatccaagagggtgcttgcatgacctggtcatgcggctaccactgtgaggatgcgttaacccattggacttggatgaaggaagctcagaccctttttttctttacagattatttgtataactttgcaagtgctgcaacaaagaagataactgaatctgttacagaaacagctcagacaatcaagaaatccgtggaagaaggaaaaatagatgatatccttgacaaggtacacttcgataacttgtaaaagaaatatataaaagttgtaagtggcaactgtggtcatctctttaactcaagtaaaatctaatgtcctgatagaatttttttagaatgctttttgattcttggacaatttcacacatgtacacaatgtatagtgactgtaattcttacctaatagtaaactttcaaagtaatttggcttttcatgtgtctttttaacagactattttaggagattttcaaaaagaacagaaaaaatttgttgaggaacagaatacaaaaaagtcaggtatgttgtaggtttgtcctactttctcacccaagagtgtgtgtgtgtctgtgtctgtgtctgtctgtttgtggtgctgtgtatcaactccaggtccttgcacatgctaggcattctaggcaagcttccctaccaaattgtattgagcatctaccatgtgctagacctatactaagactgcactaagactatactaagaatataaaaatgtataatacttgggtggagcccagtggtggaacatgtgcacggtgtattcaaggccctgggttagatcctcgacaccaaagattgtatacatatggccaggtataatggttcacacctgttaccccagcatctgagaagataaagaagaattgctgtgagtttgaggctataccccagcctgagctatatagtaaacccaggccaccttagggtacaaaatgaaaatgaaaaacactttttaaattaagaaatagtcagatgtggcaatgcatacctttgatcccagcacttgggaagcagaggcagataaatctacgagagttcaaggccaccctggtctacatagttgagttccagaacaaccaagtttatgtagagagaccctatctcaaaaaaaaaaaaatcaaacacatgttgcgggagagggagagaaggaatgaatgagaattcagtcttttagacacgttagagaagagggtcaatcaaaaaccaaagccaagctaagccttgtggtgcacacctgtgatccagtactaaagaggctaaggcaaaaggattgccaggagttttgagaccagctctgtttagattaacaaggcctagtctaaaaacaaaacaggaaaattagaaattaaaaaaaaatgaacctagctgggtcctataactctagcatttgagaggcaatggtagaaagatgcatgcgtgggaactgcctctttatagagtggattggtctgggttgccacgtgttgggagttagtggagttagagtctattataaggagcaaatggttgcttgaatggaggcctaggttcccttcctaatcagctaggtgtatatcatcttagtatttattttattgttaattatgtatatgtatgttagggtttgttccttggagccgaattataggtgggtgtgagccacctaacaatggatgctagctaggaacttaaccttgggtcctctgcaagggtagtatggcacctgagggtgtcagaatgtatcagagtcccctggaactgcagttacagaagttgtgagtcgctacttatgtgctgacaatcaaacctgggtcttcccagaaaagtagcaagtgctttaaccactgagccatcatcttctaccccctagtcatgaagtctaaaccactaaactatctcttcagctttcttttattttgagttagggttgtactatgtgttttggggtggcctagaactcattgtgtagttcaggatggccttcatttgacagaggtctacacagagaactgttgctataaatctccaacccaaatatgccctggcaatgaaaacacaacacagttaatatgattacatgctgtgtacctggattgggcagctctaccgctacactaccatcttccacatctatgagaccccttatacttacagactctccagaccaggtgcttctcctccttctctccctcaccttcagctccaccttcccttttatctgcccaatcctcagctctcttttattttacaagttaaggtaggaagcaggtttagaggaaatcacctgagtgctgactcactcctagttcacaacctttcacaggagaacagaattaacatcaaatataattagccccagggctatccacaacagagaactgcctgcctctgcctcccaagtggattaaaatggatcctcatgcccagctttttttaaaacagcatttctctctgtagcccaggctgtctagaacttaaagcaattatttgcctcggcttcccaaggatcaagaattacaggcatgtaccactatgcccagagacatataattataatacattactctaacacttattaattttgctagttgacccagtgatgtctttttataatatttttacccagaatctagttaagttcaaaaactagttaaggatatgatactatattctatcatttctcttagccttctttaatatggaatgatttaacctttctgtagtgttctgaatatgtttggcccagggagtggcactattaggaggtgtggccttgttagtggaagtgtgtcactatgggggtgggctttgagaccctccttgccttagggttttactgctgtaaacagacatcatgaccaaggcaattctttttttgttgttgttggttttttgagacagggtttctctgtatagctctggctgtcctggaactcactttgaagaccaggctagcctcaaactcagaaatccacctgcctctgcctcccaagtgctgggatttaaggcgtgtgccaccacacctggcctcaaggcaactcttataaaaacatttagttggggctggctagttcagaggttcagtccagtatcatcaaggttggagcataacagcatccaggtaggcatggtacaggctgagctgagagttctacatctttatatgaagactgctagcagaatactggcttccaggccgctagaatgagggtcttaagctcatgcccacagtgacacacctactccaacaaggccacacctcctaatagttccactccctaggacaagcatataagaaccatcacactctgttgcagaattttccctgtccaatcacattagggcagtgggaggcttgtgattggacaggagaagggaggcagagcaaggagttgaggacacagagagagaggtctgaggaagggagggcaaaccagaatggaggctgacgtggtgttatcaaaaggttagaatacagccaggaggtggtggcgtatgcctttaatcccagcacttgggaggcagaggcagatggatttctgagttcaaggccagcctggtctacagagtgagttccaggacagccagggctacacagagaaaccctgcctcggaaaaaaaaaaaaggttagaatacctgtgttaaagcttcatcattatcatttggttctgaaattattgtattggcatcttgtaattgtgttgttacacaatctgattggctaattaagcattaaaaatcttgattctaagccaggcgatgatggcgccctcatagacctcaacactcctcatagctgccaggaaatggtctgctcctggcttcctttggataaatatgtagagctctcagctccttcagtgccatgcctccctggctcctgccatgcatactgccatgatgatactggactaaaccagaacctgtaagccagccgcaattaagtgttgtcctttataagagtttccttggtcattgtgtctcttcccagcaacggaagccctaactaagacactttcttggtcttttttgaacaggctcttggcagccctgactggcctcatatttgctatgtagctgaggtcgtccttgaatttctggtctacctgactccacctccaagtactgagtgagggtggactgctcttcccttaatttatttttgtatatttgagctttgatatttcctcatggttagaattagattgtgtattcttggtattttgtccttttcaaaataacatattcagggatcctcagtttgtttctcccgtactctttgtgtatatgtgtgcatacatacacacatgtgtaccactttgtacaagtggaggtcaaaggattcttccaccatgtggatcccaggcatcaaattcaggtcttttatgcactgagcccagtgatatcaagtttgattatctgattaaattgctgtcagatttctgtactatgtcattcaagtagattattggccaaatgcatacatgcctaaagtttacaaaatgagcgtggttatttatactaaataaccatatttggatcttattggtaaattgcaattgtggtcttgtaataaccttccttgtttattgaaatgcagattatgataaaactatatagtgcctgaagaagccagaagtgtatattggatcccctggaactgaaattaatattggcattatgagctgccatgtgggtgctgggaactggatccaggttctctgcaagaacagcaggtgctcgcaaccactgagctatttttgtagtccctataagctttgtgctttcctcctgtgcagaagcagctgtgcctccgtgggttgagagtcatgatgaagagacaattcaacagcagattttggctttatcagctgtaagtaccctgtaaataaccgtgtacttaacacttgtctcctgtcatgctacatctctgtccataggactttatctttagctgaatttgtctaatatccaatttttacgtgttcttgtatgggtttgagtatcttgtcttttgggactggtttcactatgtagcctaggctggccttaaactcccactacatagactaggctggctacaactatctgtttgagctaccccagtactaaggttacaaatatatattaccatgcctagcttttacactttggttggttggtttggtttgagacagggtctctggctatcctagaatttactatgtagactaggctagcatggaactaagagatctgcctatctttgcctcctaagtgctggctagaattaaaggcatgtaccattacatctcactttttttttaacataaatccctgagcaccaagctgtatccctagcctttgttgttgttgactcagtgagtttcattaggattgcgaacagtatcacgggtgagacattatttacaggaacatgtccaacttaccaatggctataccactgaagaaaatgtttagatcttcaggcaagagtgcggtcatttgacagtttctcactgataactttcagttagtgcatgcttttcttttttccttatgttaaagtatagcctattacgccaaatcattgttttagccttaaaaagatagaggctgtccaggcagtggtggcgcatgcctttaatcccagcacttcggaggcagaggcaggcggatttctgagttcaaggccagcctggtctacagagtgagttccaggacagccagggctacatagagaatccctgtctcaaaaaacaaacggaaaacaacaacaaaaaagatagaggcttatacttgcaatcctagtactcagagactggtgaaggaagattggcactagcttgaggttaggctgggctatatggtgagactgtttcataaaaagaagaggttcttttatatgatttaataattttgagatatggtagcatatgaagttttagtgcagtattatagtagctcttgtggatagaattattatattccatattttctgtttacctacatatgtttgttggcagttgacattgataaagacagaattccatttactggcccacaaaactttatctcatgacttgaagaaatatagccaaagcagccagtaataatgttgcagatgataatagctagtgcttttacccctctggaacactgagggggctgagactatgatgttaacccttacttctccatgctgtctcagagaacaaaggccaacttgatcaaagctcagagcatggcatatgacttcatgaatccatatttgctttgttttaatctatatgtgtattatacgcctgcatatatgtctatgtgccatatgtgtgcctgatgtacttgtaggccaaaaaaggtgtaggatccctggaatggaagttgcaggtgattacaagcctctctatgggtgctgggaatcaaacccagatcctctggaagagcagccagtgtttttaactgctgaggcaaatgtccacaacttccgttatttatttatttatttatttattttggatttttcgagacagggttcctctctgtagccctggctgtcctggaactcactctgtagaccaggctggccttgaactcagaagaaatccacctgcctctgcctcccgagtgctgggattaaaggcgtgcgccaccaccgccccgcaaacattctcctttaacctatcctccatcccttttgggcctgagggaatgaactcaggattgccttgtggattgtatagcttatgcatgcgctctgttatctctgaactgtaccagcagcactctcgtctctatttttttttctagtaaaaatttgtgagtcgggctggcgagatggctcagcaggtaagagctctgactgctcttccagaggtcctgagttcaaatcccagcaaccacatggtggctcacaaccacccataataagatctgactccctcttctagagagtctgaagacagctacattgtacttacatataataaataagtaaaaaaaaatttgtgagtcttccttgacttctgcctcctccacaggaaagcctgggcaatggtcattgaaataactgtactcatggagtcaaaactccagttctaggaatttcttctaaagatattattttataagccagcaagatgtttcagtgggttaagaaaattcttgacttagccaggagagaaaccctgtctcgaaaaaacaaaaacaacaacaaaaacaaaacaaacaaaaaaaacaaagaaaattcttgactcatacctgagtacaatcctttgaaccctcataaaatggagtaagaaccaaatcccctatgttgtcctctcacttctacatacaaactgtggcacaggggtgtgtgcctctacctccccccaacacacacaataatgataataaatatatatttttttaatttaaagttcactttacaaaggaatacagactctccttttttaaaaaaaataaggtcttattctggaactcaatgtgtagcccagtctggtctcaaattctaagcagtcctccagtgttagcctcccaagtgacagatgtatgccactataccctgctttcagaattctttcaaaaagttagaaactactaaaatgactctggaaacaggtctggtttagtaagttatggtaagttagtgctcatttaatatagccattagagctggaaagttgttcatgaccttgagtgagaaaagaaagtcggctttcatgcttgtcatcccagcagtcaggaggagcaagagtttagggttatcctccaatagaggatgtaaggctagtctttgctataggagactgtttttaaaacaaaaacttaggactggagagttggtcagtggttcagaacactgggttctctttcagaggattcagatttgattcccaacacccacatggctgcttacaacaattcataagttctagtctcaggctctgacaccctgttctgacctctgtagttactagccacacatgttgtgcacaggcatagatgttggcaaaacacccatacacataaaaacctacaaaaaagaaagaaaatatttttttaaaaagatttatttatttttttattatatgtaataagtacactgtagctgtcttcagacacaccagaagagggagtcagatctcgttacagatggttgtgagccaccatgtggttgccgggatttgaactcaggaccttcagaagagcagtcgggtgctcttacctgttgagccatctcaccagcccagaaaatatttttaaaaagtgaattgtcttaagctggagagatggctcagcagttaagagcactgactgctcttccagaggtcctgagttcaattctcagcaaccacatggtggctcacagccatctgtagtgggatccgatgtactcttctactgtgtgtctgaagacagctatagtgtactcagataaaaaaaagaaataactttttttttaaagtgaattgccttatgtatcaaacaagatattttttaaaaagtggtagctatcacaatgtatggactgcctgccttcctacgtatggcaaatcttacctgctggattctctaaaggcatagaactaacagaatagggctgaagagatggctcagtggttaagaacactgactgctcttccggaggtcctgagttcaaatcccagcaaccacatggctggcttacaaccagtgtactccaatacgttaaataaataaacctttaaaaaaactgacagagctgggcgtggtagcgcacgcctttagtcccagcacttgggaggcagaggcaggcagatttcttctgagttcgaggccagcctggtctacaaagtgagttccaggacagccagggctacacagagaaaccctgtctcaaaaacaccaaggaaaaaaaaactgacagagtaaatatgcatattgaaagtagatgtattagcctggttcagatagttcaacaactgtctgagtgtaaagcttgaaaatctagtagttatttactccacaaggctggatgtctctgcaatccctgtctggtgctacagtcccagaagattcctggatagctgctagtctcagtctacatgggaatcctaaagcagttttatttaataccagctgcagcaacagaatagatgaatttgccgtagagagtaaggacaaacaggcaaaaagaaggtttttcttgtgtctttatatgtgggctgccagttttagggtgggtctttctgcttcaaatagtctgattcataaaattgctcaccgaagtgcctgccagcttgggtgttagttgattccagatgttgtcatgttgacaaccaagatttttcatcactagcagggacaccacatatattagacatagggacccaagggagtgttacattgaaccataaattatctgtaactagtaggattctgtgttgtattgtgttgttttactttgttgaggctggccttgagctcattctatagtagaggctgctggccctaaatttctaatcctccttccaggtacagagattacagacatcaatactatacccagatcttcaattccatgcttttctgaatgttttgcagaggttcatgttgctggtgatggctttcttttttttgttgctttgtttctggtatttatttatttattttcatttttggtttttcgagacagggtttctctgtgtagccctggctgtcctggaactcactctgtagaccaggctggcctcaaactcagaaatccgtctgcctctgcctcccaagtgctgggattaaaggcgtgcgccaccactgcctggcctggtttttaatttttattttccgtgtagggatgttttgcctgcatgtctggatgcaatgcctgaggaagctggaagaagttgtcggatcacctagaactgcagttacagacattgggaattgccctgggggtgattttagtgggacctgggtcctccagaagagcatccagtgctccttaaccattgagcgatcacttcagcccatatcctcgctttcattccaaagaccctagggattaaattcagatcatcaggcatggtgacaaacacctttacccactgagtgatctcaccagcttaggttttgtctttttgagacagtctcatgtaacccaggctgacttccaaacctctgtacagacgatgctgactttgaagtcctaatccccctggcctctactgcccaagtggtgggactacaggcatgttccacactgtgttttggccttgagttagaatgtttctaaacctaaaggtgtttatatgattattacatgtttatatgatttttaactatgttgtttcaatcaactgagtgaactgtctggcttcctgggagcctctgtccaggtgagtgttagaaaaaaacatgaaaggatggattgttctcctatctcatttaagtgggccagtcagtgacagctcagtggactttgtgactgaagactgttaaaattcagtatatcgatccatgatactttgtcataaaatgcaattaagacaccccctttaatggtttttgcctccatttctcatcacaggacaagaggaatttcctccgtgacccaccagctggtgtgcagtttaactttgactttgatcagatgtaccctgttgccctggtcatgctccaagaggatgagctactaagcaagatgagatttgcccttgttcctaaactgtaagcaccatgttttctaaagaaacactgctcactcctgcagtggtaatttctatttcacagtagtatagtgatttcactttcctaagggctctagttatatgcataatgttagggaagagtcactgaatgaaggccagaaccctccctacactatctgttcatccaaacaggccctgcagcccttcagaggccctgtgagcttgactgcgtgcccagaatggaaggagagggcagacttggcaggaaagtcaggttgatatgtgctcttttgcccagttaaacagtagaacatgtttccatcagaaacaacaaatagacccaaatcaaatcgggtttgtaaaggcttgccttttccctgaactcccatggcttgtattcatgctctgcgacagctgtgcttgcttgttttgttttgttttgttttgttttgttttgttttaaaccaaagaaaggcccatcccaattcataaaatcccaggtgccctttaagctccaaagcaagcaatattctgtgatgctttgtcactggtctgccagcagagggcagtcttccctgctgcagcgtccctggggctttgtgtccctctgactttcctggagggtttttgttgtgtttgcagtactggaaattgaatttaggacttggctcatgccaagcaattgttttagcattgaagtataaccctggacctctttttgactttttgacagagtcttactagattgcctagctgggccttgaagtcactgtgtatcctcagcaggccttgaattttcagtcctgctcaggctcctacatgagtgggtttacaggcctgagctctcaagcttagtcagagggaaggggaagaagatgatgatgattgtcattgctattattttgtttatatttttgaagccagctttcaaaacagagcttggctcaagactataattttagtacttgggaggcagaggcaggagggttgtaagaggccagcctaggtcataagtgggagagcctgtttctaaacaaagccaaagacaggccatgatgacttgcacttgtcatcccagtatttagaaagttgagacacgagaatcactatgagtttgaggacagcttgggctatacagtgaaaccctatctagaaaaagtaaaattaaaaaacaacgaaatctggtattctttattttgtgagtgtcccccttctagagtgtccttaatccttatttcatggttgcaaaattttaccattccccaagggtacaatttatagttctctcaaatatcttctttctgtaaactttcctcagaaactggttggagctctgccttctgggttatgggctccattcccttgccttctgcagtaatggcactgtaatgaggatacttaatcaccttatgttgagatggccttttacagctggagagacttaactatctgtgagtaggtagcttcccgctagaggattcttcaacctccttgccagctgcaggcaacaccacaagggcctggcctggcctggcctgccacgaattcgtgtgtaggctgtgccccacagcttcagtatggcatcacagccccagcctcaactgcaccaggtgagcctgtctcccacataggaaactgttaggccgatctcataggaaaggcagaaggtaggagagaatagagccatctccccactcctcatgagcacttgtggcctctgttccagggcctgtccaaactcctgcccagtaagcagacctgcttcttgcaggtcactcatcccatgggtagcacaactccatagaatacatttttgtttgcatgttgacttttcaacttcctcagtcctgccttctcctattcccatctctgtaggatttatctgtgcaattcctcttctgtgatttctgggctgttttcagagggatcatacattagcttatgttcattatttaatgtttagctaaccacataggggttttggcacgtatttcctagtccttgggaccctatggcagctcgggtctgttgtctttatgagaatacttccttagcaaagttattctagcctcaggaagccagtgatatagaaccttttctttgtgttttcctctatagtgaaactcttctctctataactatcagtatactggtggtaaattaagttttattgtcacttggcaaattttgttgagctagattggcctcaaatgctgtatgtagttgaagatgaccatgaagttctgatcatcctaccttcacctcccaagagcttggtttacaggcacataaccactagagacagtctcttagcaagttgccctggcttgcctgagactcactatgttatttattgaccagtctagcagccttaattttttagggatcttcctgcttctgccttccatgtgctagctgctgagattggagacatgagtcatgacaaccagcctttagactatggctaacatagctatttataattaaggatacaaagaaatgtgctgccaggcagaggcaggcagatttctgagttcaaggccagcctggtctacagagtgagttctagaacagctaaggctacacaaagaaaccctgtctcgaaaaacaaaaacaaacaaacaaaaaaaaagaaatgttctatctactcctctgctgcatatgcttacaaaaccctaagaattgacttttttatatattgtttcaaacaatgcagggatgaataaaacacatattctgtcctgacagatggtaccaattataatttctaactgggcatggttgtgtaccctgatcccagtattcaggaggcttaggatacagtcgaaagccagccagggagagaaagtgtaaaagtgtgtgtgtgtgtgtgtgtgtgttttcattgaggaaaccctatataaaaaagtctaccttgaaagactggagagagcggggcatggtggcacacgcctttaatcccagcacttgggaggcagaggcaggttgatttctgagttcgaggccagcctagtctacaagatgagttccaggacagccagggctacacagagaaaccctgtcttgaaaaaccaaaaaaaagaaagactggagagatgactcaatggataagagcactggctgctcttccaggggacccaggtttgtttcccagtgccttacatagtgacccacaaccctctgtaactctaatttccaggggatctgatgctctttatgacctctgtgggcacaggcattcatgtgctgcacataatacatacatgtaggcaaaatacccatacacataaaatattttttaaaaaaatctacctcgacctggtgcgatgattcagtggcttaaggcacttgctgccaagattgagggcctgagttaagcccttggggttgcatggtgaaagaaaactatgagacttgggagaactaaaattggccctgcttacctttcccaatgtcttaagccataatgtgagagccaggtaaaaggggagttgcagctgagtgtttaggagcctgaggcaagaagactgctatcgtgtttgaggccagttggggcctcatagtaagttccagacaaagcttgtgttacagactaaagaaatattgaagttgtgaagaactgggctgcatatgtatcttcaaggccacttttaattctgagctctgtgaaatcatcccacatgagctaaccttgggttgtatcaatgtctctgtagtgactcatgggctctgtttgctcttttcatgaacaaaacatttgggctgttttctttgccagattccctcccccctgatggagagaggcaggcatgttgcagaaaacttctgcatcgccctctaggaaagactcactccagatgtcattgtaaagttctaaaaggtcctctgacaaccctattgggcacagctgtagctcccagactgctttttctgcttttgtggcagatcctactgctgaggcattaggagcctgtggctagcccctgtgagaaacactcagcctttggctggaaaacaggtggtttctctcctgctatcagaggacctcagggtgtgtctgtgatgcagccacagtgcactggctgggttcagactaccgcagggaagtgctaacatactcgtgtgcattttgaaatataggcccaattcttcattttctaaatgaagtgactgtttttcttcagaaagagtatcccagatgatcagtgtgacacccagagaagaaaagtctagaagtcctatatttgtttataatggcctgtttttgcttttatgttgagggtgtctcttgcttttttttctctcttcttgtgcctttgaggtttcatggttgtggtggtttgggttttctgtggtcggttggcagtaaggtctcacatacccagtgttgttgttctgaaatgctatatataatggaggagaaccttgaaattgtgattctcctgcctccaccctggagttctagcattatagatttagggcattatacccagtttacatgatgctggagttagaaaccagagttttgtgtgtgccagggtaagcaagtagtctagaggctttgctctgtctgcagatgtttacgctttctgatttgggttaggtttgtcttccaaactagagattataattggagaaaacagtcgtcaatttttttcttttggttttttgtttgtttgtttgttttttggctttttttgagacagggtttctctgtgtagccctggctgtcctggaactcactctatagaccaggctggcctcgaactcagaagaaatccgcctgcctctgcctcccaagtgctgggactaaaggtgtgcgccaccacgtccggcatcaattcttttaattagtattttgaaacaatgaaaagttagaaagatttgaagtgcaatacaaagaccatttgtaacccaaatttatttgtgtttgcatgcacacacaatttgtgtgtgtatattcgtactgtacttccgtctttacatgggtcctgggatcaaactcaaagtttgtatggcaagtacccttccttacctgaagggggagtccaggagacggcgtcagatccttgggacctagaattacaggtctacccagtgtgggtgctaagaaccaaactcaagcagcagtggtcttgaccactgacccatctgtctagcctcctgttgttgttcttattgatgcttttctactagttttgagacagtctcctatgtaatccaggctggacttgaactcaggatccttctgcctcagcctcccagagaacattttttgatttctcaagtgaagacgtttgttttcacctgatgtctcatgatcttagattctttttttgtggggaaggagtactggagatggaatccaaagctttgcacatgataagcaactgctccatcactgagccctcaagtccaacctgtttgtttgtttgtttgtttgtttgtttgtttgtttgtttttcaagactgcgtttctctgtgcaaccctggctgtcctggaactcactctgtagaccaggctggcctcgaactcagaagaaatccgcctgcctctgcctcccaagtgctgggattaaaggcgtgtgccaccaccgcccagcaagtccaaccttgaatattttgtttcctatggacattctctcacaacctcagtgtgtccatcaaattagtccacatgtgaccatcagatcacccacattattacaatctagtttccatgccctattttaatgttttatttgttctggttatgtttttagcaaaagaattcagttaatgtcacagactgcatttagttcttctgtctcatcaatctgcttccattctttgcacctgtgtggggcacactgccatctgtccctgcacagttcacactttgttcacttgaaggtggtgtctggcaggctttttaactataaaagtacagttctcctctttgaaggtaattggtggcaggcattatggtaaggtccaaatagcaaattcaagactagcctgggctatattttgagaccatgtttcaaatgactataataataataataataatttattactactactactattattattattagagattggcatagttgtgcacatctgatcctactactggggaggaagattactgtgggttgcatagtgagttgaaagccagctttggatacacatctgttttaataaacaagcaaaggctggaaaggtggctcagaggttaagagaacgtggtgcttttgcaaaggattcacatttggtttctaacaatgttgtatggctcacaatcacctgcagctccagctccaaaggatctgatgccgtcttctggtctctgcaagtactgtaagcacttgataagtttaaaaggctggggttagtggtaaatacatttcattctagcacttaagagactgagacagaagaagagttcatagccagcttgggctaataatagataaaggtgagctatagagtaagaccttatctcaaagggagatggagagagaggaaagaaaagctaatttttttgtgagtagagaccttgatggggtgtgtgagtgtgtgtgtgtgtgtgtgtgtgtgtgtgtgtgtgtgtgttgaaacgatgtctcatgtatcctgcctggaactggctgtgtattcaaggataacctttgacttgggatcctcctgaatgctgtgttttatagccatgtgctccaccatgtctagggatcaaatccaggtaggactttatacatattaggcaagtattctaccaattgagctatatctcagcattaaagacttaataaaaacatagtatctggggagtgagagggacaacttgtgtgagtcagttctccttccaccatatgaagctcatggagcaaactcaggtcattatcagcaagtgtgtttacccactgaactatcttatgggcccttcagggactttgaaattttattctgctaatcacagttccatatattcttgtatttatatccatataagcacatgcatttgatgcagtaggttgttacttgttattttgatgctcacatcatcactttgatgggtggggactcagtgaaacatatttttagcctttggtgattgctctgtttgagacagggtcatactatgtatccctggctggcctaaaacttactatgtagattaggctaaccccaaatttagaaatctgcttgcctctgcttcctgggattgaaagcatgtgccaccatatcaagctccaagctcattttattcttacctttctctaaccctatgacccaccatttatgcagaaagtgctggtacctcttagtggaaaataagagttattcttctttattagcatatattagttaaacgtaataatgggtttcaggaaaagacatgtagaaagcaagaactgagcagcattgtgataccttttccagtaaagatcactctcgtgttcttctgccatgtttgtaactccctgctctggcagataaagcctagttctgtgacctttaatgtttttatttttcaattttttccatgtaactaagttctcgtttctgactcctccctcctccactctctttctgcctggttcttattgtccttctaggccacctattgtgtgtactcaccataccccacttgggcaccaatgcctcatgccaggcaagtccaatatgcaaccaagtttgaagaccgctgtgagttctcaagttgaatagaaagaacttcaatatttaccaaccatctcccagatggtcataggtataatttgatagtagagtgcttggctagtttgtacaaagcccgggttctttccccagatttgctccatacccaaagactttataaccatctctcattttgtttctactagttactagttattttagcaagctgccagctgatgtattttctgaggaataacatcaagccatgtatggtacaccacatgtatgcaaacaccagtaatcttgggtgaagcaggaggatagtgatcttgaagtcagtctgtgataagtgggactcggtctttaaaaacaagcaagggctagggagatggctcaccaatgaaaacacttacctgcaagcatgaggactagacgtcaaatgcttagaacccatgtagatttcatgtgggcgtgatgagtatgaaaagggatactggaaaggatccttcgaaagaggatgaaggggatgctggaaccagctgagcaactagactagcaatatctatactggctgtatcaatgagctcagggtttaattgtgagatgctgcctcagtacataacaaagtggaagggcagttgagggttgttcccagtattcaacattgagcctccacctacacatgtacacatgtgctcacacattcagacatgtatacacaacaaacccatgacaagtagagaacaaaaaaatgacacccacaatagtttcttcccactgcctaaaagcagatactccttcagaaaatagcaaaggactcatattgtcctgactctgcttccagtccccctggttagtcatactgccacacaggaatgctttattttcttctgccaaggaccatttgtgtgtgtgtgtgtgtgtgtgtgtgtgtgtgtgtgtgtgtgtgcgcgctcgttcacgtgcaagaaataggccaccaagatagctcagcaggtaaagccacttgattatcacatgagttcatgccacacctggcagaaaaagaaaacaggctcctgagagctgtgctttgcatgcatgcacatacacataaagaagtaaatataatttttaaaaaaggactggaaagatggctcagcaggcaagagcactagctgctctcctagaggacccaggttcagttcctaacacccacatggtagctcacagcaatctgcaattccacttccaagggatccagtgcctcattttggcctcataggccttgcatacatgtggtgcacaggtatgcatgcaggcacaacatccatacacatagaataaaataagaaacaaaagtaacaagaaatactgaaattccataagcattatataacctatcttttgctgctgtggaaaatatagtttggtttatcctattatttagctttcacttgtaaatgatcatttcctttggccctcacaagatctggaaagcactcaaggagtgcatgcacctttagcttggtaggaaaatgccggcttgcctggcatgcatgtggaaccctaagtatcacccctggaaccaaataaatagatgatctattctagtctctgccatgctaatgtgtgtacccttgaccctctcactcttccatgtgtcactgtctatcaaaagtgtgaaggaagaagtattctggaggaactacttctaccgaatctccctgattaagcagtcggcccaactcactgcactggccgctcagcagcaagcctctggaaaggaggaaaaaagcagcaacagagatgataacttgcctctgacaggtacattctggggagaagaaatcatgctggaagaaaagaatattcctgacttagatatgctaatgagcttgtcatcttgtatgtatcaaaaatgttgacatctgtacagaaaaattatttcctttccaaaggaaattttttctttggtgccctttctgacccagcttacatgtgtcttccccaaatgttctttttctttactatctcattgttggttcttgggatttttttgttgttggtttttagtagtagtggtagtagtagtagtagttgcactcttgaatgacaatcatcttttctatgtctcttttcttgccctttgggctgtttaattttgggggtcccatgcagtccagactggctttgagctcctgatcctcctgccttcaaatctcaagtgtcagggttacaggcatgcgctaccatgtccagatgtttctcagacttctagtcatcataatttccttgggacttgtagttgtagagtccagtagttcttattccagttaaattataagtacccagctctgagctaagctcttaccacctggtacttgcctcctattatataaccctgctctagggaacaagttttatatataaaagtatttgatgatactgattaacagtagagacgactcagttaagaacacttccagaggacccaagttcaattcccaacacccacatgaatggtttacagttccttgtacttccacttgcaggggatctgacaccctcttctgacatccatgggtactcagacatacaaataaaaacaaagctggggggctggtgagatggctcagtgggtaggagcacccgactgctcttccgaaggtccggagttcaaatcccagcaaccacatggtggctcacaaccatccgtaatgagatctgactccctcttctggagtgtctgaggacagctacagtgtacttacatttaataaataaataaatctttaaaaaaaaaaaaaaaaaaaaacaaagctgggtgtggtggcacacaccatcagtcacagcaccccagaggcagaggcagtcagatctgtgtgagttagaggccatcttggtctacatagagaattccaggccagcctgggatagatagtaagaccctgtctcaagtaaataaataaaaattaaaatatatattgtatttttattttgtggcactgagactgggtcctggagccttacaaatactaggcaagaactttactgagctatatatccccagcctttcatacttcttcatttttcatgaatgcctgcgatatgtatagatatgttctaattacaactagaaccatctgacaagtgggacaatttagtttgtgaaattttaggtataagaagttgtacagactactagcaaaagctctgaaactacactcaaggtcaagatgtctcatgaagcccagagaacattcattctttatcatatccttaaattatggttggtttttggctttagagaatagctttttgagacagggcttcactgtgaagccacagctagtcttgaactcctaatccatcctcctagctctgtccctgaaatgctaagattgtaggcatgagctaccattccttgctttctcaaattaatgatattggagaattctggactgggaatatagctgagtgatagagcacttacctagcatagtgcactgccaaaacagaaaagaaagacttcttttccaaagactgcctgtttaacaaaatggacttaaaatattcagtaaagacagttggccaggcgtggtggcgcacgcctttaatcccagtactcgggaggcggagacagaggcaggcggatttctgagttcgaggccagcctggtctacaaagtgagttccaggacagccagggctacacagagaaaccctgtctcgaaggaaaaaaaaaaagactgtttacacatggataatatgataaggaacagttaagagtgaatgttgctctttacaaaggacccaagttcggtccccaaaacccacattcttaggcagctcacaattgcttgtaactccatcaacaggggattcaacaccctcttttgccctctgaggacaccacataaaggtacacatacacacaaacaattaaatttttataagctaaccagcagaatgctgagatggggcactttgttttcctttgtgctatctaaccaagttgataacagggaagcttgagaaaaagctttattcttagcaccctaaagggaagaagagactcagtctgctaaccctgaagtccaaagatgatggaaagtgacataagggacattgaatgtgcttgcacttttgttttttgttgttgttgggttttttgctttgttttgttttgttttgttttgatttttcgagacagggtttctctgtatagccttggctgtcctgaaactcactttgtagaccaggctggccttgaactctgccccacccccaccccgagtgctggaattaaaggcgtgcgccaccatgcctggcttgcagggtttttttttaaagatttatgtatttattatatataagtacaccgtagctgtcttcaaacacaccagaagaggccatcagatcccattacagatggctgtgagccaccatgtggttgctgggatttgaactcaggaactctgaaagagcaatcagtgctcctaacagctgagccatctctgcagcccctgtggttgcagttttaaagacattcctgcctagcatggtggtgcacacatttcatcctagcactcaagaaacagagaggcatgtggatctctctgagttctagggtagccagggaacataatcagatcctgtatctaaataggcattcatcaaagtaggaggttgatacagttgtgcctggctgtgcttgtcatatcttcaggagagctaaaaacgcaccataaaagctcatttctgaaaatgatttaatatattttagctgttctttttttataatttatttatttttaattaggtattttcttcatttacatttcaaatgctatcccaaaagtcccccagaccctcctccctccctttagcagttcttataatatgtatttagaagtaagtcaagcaattattgtctcttttattctcacttcatagaggcagtacggcccaaaacaccacctgtcgtaatcaaatctcagcttaaaagtcaagaggtaatccagttttatattatacatggtagatgatgtctgaaaataaagttactgggttaactatcttcttaagggtgtcggtcttctgtctgctagataaggaggagcgcaggacttgattgaataatggctgagagctaaggtgatttcctagcataaataattctagatgtgctcaggagaaatcagagagaatggtttgagtaactaaacagtgagggagaataatagcctcaggtggtaactcactctgttaccaagcaactgccagttagaaggttgaagagcagtgaggattgtcttacagctagcagagaagaacaaaaaatgagaatgtgttaaattgtgagacaactattaaccataattctagtacataggtgtcactttagaagccattgcaagagctctttggttgcatttcaggatgaagaggaaatctctactagcccaggagtttctgagtttgttagtgatgccttcgatacgtgcagcttaaatcaggaggatttaagaaaggaaatggaacaacttgtgcttgataagaagcaagaggaagcaactgcactagaaggtaacacatacacacagaggttaactttgttcttttagcttcaattccaaagttggtcgaataaaaatctcattttaaaaccagtggagctagagacgaaaagatcagaaatttgaggccagtcttggccacatatgaccctgtctcaggggctggagagatggctcagtggttaagagaattgactgctcttccaaaggtcctgagttcaaatctgagcaaccacatggtggctcacaaccatccgtaacgagatctgatcccctcttctggggtgtctgaagatagatacagtgtacttaccatataataaaaaagtaaatatttttaaaaagaccctgtctcagaaaaataataaagccaatcaacaaactatgtgtgatagtatatactcctctaatcccagggaaagtcagaaaaactgacatgaatttaaagccatcttgagttacatagtgagtttcagagctacatagcaatatcctgtcttcaaaaaacaaacaaaaaactaaaaatgaaatttagctttactttttaaacagtggcgggaattgaaccagtgactttgcagatttgctacacctcactcacattcccagccatggttttgtgttgtttgagacaggttgtcatgtagcccagatttgtctcattttcattgtgtcgtctgctggctttgacctcctgtgagctgggattacaggtatcccaccatgctgcctaaccttcctttttaaatagcagtgttttgttttctcactcttctttttctaacactttgcagtttctacatactgggtttaaggtgctggtttctatatcaggcatcaagtgatcaagctgggtacggtagccgcaactatagtaggagaacgtggtggtagaagcaggaggattggaagttcagggttatctgccaatagtgagttggaggccagcctaggatatgtgagaccctgtctcaaagacaagggctagagagatggctcagcagataagtgtgctcactgtcaggcctgatggcctggattggattcctagaacccacaaggtaggaagcaaagaccaaatcctagaaatctggaaattatcttctgaccttgactagctatgtctgctactacaaaaagggctaggcctttgaaccaggtcctctagaagagcagtcagcactcataaccaccgagccatctctccagccccaggctaggcctttgttaggtacctacaaattgagtgaattgtagttcaatgagcacctttttttgtctctccctttgtttcctatagaagattctactgattgggaaaaggagctacaacaggagcttcaggaatatgaagtggtagcagagtctgagaagcgagatgaaaactgggataaagaaattgagaagatgcttcaggagagttaataattgtctccgcaaaccagttcttaacattgtgtgacatgaaattctcatgatcgctgagtcagaaggcacaaaaaaagggtgtaactttatgcaatttgaaatgattctttttctagctaaaacttgcctcttaaatgaacagctattgtaataatcagaaacaacaggatattgtatgtaacatttcatacatataaaattagcattcttataagcagcagaactatctgtgccacagaaacacaggtaaatactagagtcttttttctagaaggttggcaacataatttattctttagttatgtttttctatatatgcctttttgttgataaatggttaaagtacttactatcagaaagtaatatcttactatcaaaatgaccaaattataccaaagaaatcaaaagaaagcactttcaaaatattttcttgccggatattttctaaaattctatctgaaagacaaaagctgagatatttctgttcacttgaatgacataaatatcacccagtttgacatgctgaaacactttctgtgcaggactagggagggatgtggtgaacacttgttgttcacagtgctccaggttccatttccactatctcagctaaaagtgcaagccagatttgtttaaataaagttgaacttctccctagagccttctcattttgctttgttaagtataccacaaattcaacgttgtgctttttgtaggaactgaggtcttcagtcctttttgtattaataactgtcaagaagcctgtttaccgtaaggtttgttctcctggtaatagtcactatgtataaatgtcttaaataattatcctttatagaatggtcttccttgatctagaacctactaattaatacttcttgtattctgctatgccatc

SEQ ID NO: 359 - DNA, 747 bp, mus musculus
atggccgaggaagaatctgcctccaccacgtcttatactgaagatgatttctactgtccgatatgccaagaagtcttcaaaacgccagttcgggtcgcggcctgtaagcatgttttctgcagaaaatgtttcctgagtgcaatgaaggagagccggctccactgccccctgtgccgtggaaatgtgactagaagagaaagagcttgtccagtgagggctgtagacctcgaaaccatcatgagacattttcctggtaattgccgatgctgttcccagcgcgttgaactctatcgtatgaggcagcactacaaaacttgcgaaaagtaccaggatgaatttggagtttctacatctgtttcaagcttccaacagtctccaaactccgtgggcaacagtaacaacgaggcaccggcctcagcgaatgctgaggttttacaagaagaggaagagaacgcaagcccacctgatgagcccaccttcgattgtcctctgtgtgaagaagtaaccatgagcaggcaacgtttgctggatcattgcaacagcagccaccgaggtcgtgtcgtttcagtcacttgcccaatttgcctatctcttccatggggcgacccgcctcaactcaccagaaattttgttagtcaccttaatcagaggcatcagtttgattacggagatttcgtgaatcttcagctggatgaggaaacccaatttcagatcgccattgaagagtccttccacgtcaacatctag

SEQ ID NO: 360 - DNA, 747 bp, mus musculus; identical to SEQ ID NO: 359

SEQ ID NO: 361 - DNA, 747 bp, mus musculus; identical to SEQ ID NO: 359

SEQ ID NO: 362 - DNA, 747 bp, mus musculus; identical to SEQ ID NO: 359

SEQ ID NO: 363 - DNA, 312 bp, mus musculus
cgctcactctagaggcggttggcgccccctcggcagcttggcgcgcggtctccggtccgcctctccgctcgccgcagcccgggctcctcctccgtccagcctccagggcgggatctgtcggctcgccctaccctcgcagcctaagcctgccctccaccagacgggtcccctccccgcggcaccacggcttcccttccacagcacggcgacgggggcttcccctcagcagctgccggcgcctcagtctccgcggccagcccagctccgccgcgtccgcggcccgccgccgccgtaagtgctgaaggagtccgc

SEQ ID NO: 364 - DNA, 312 bp, mus musculus; identical to SEQ ID NO: 363

SEQ ID NO: 365 - DNA, 20557 bp, mus musculus
tctagaggcggttggcgccccctcggcagcttggcgcgcggtctccggtccgcctctccgctcgccgcagcccgggctcctcctccgtccagcctccagggcgggatctgtcggctcgccctaccctcgcagcctaagcctgccctccaccagacgggtcccctccccgcggcaccacggcttcccttccacagcacggcgacgggggcttcccctcagcagctgccggcgcctcagtctccgcggccagcccagctccgccgcgtccgcggcccgccgccgccgtaagtgctgaaggagtccgctgagctggcagggatggaaagagggagtgatggctgggacgcgccccccgccgccccgtgagcgccccgacgaccccaccccgagtcctcccggggcgccgcgccccgaaactcacttctgccggcggtagcgctccgctctccactcggcagcgcgccggtgatgcaggggaaccggtcctaggttccgcggggaccccgcggcacctgtggttcgctgatcgcctcaagtttgacggggcgttttggggaggggctggggtgacggcgaccgaggacttggcgcccctggcgggccagcggatgccattgtctctgctccactccttgccggtcacctcgcccagctttgggtactgatggagtgtagtcccgggaggaggggaggcgtccgagactgcgggaccccagggatgctggaccagagcccactccaaggctgagctcattgttgggttttttgttttgttttgttttgtttttgttttaataccaatctggagaaattgttgtcccgggatttgcggcaaaaatcaaagcgagggaaaaggaatacttgtgccgcgggtttcgtcccatgttagcacatcatttgttttgaggaaaatgcttggtttcttcgtcctccaaagtggtagggcggatactggaccccgctacagatagcctagagcacaccccagtcattagcaaaccatctctcctggtcaagatttaagaaaaccgatcggtcccttccccaagttctgataacggtttgcgttcaatgtccagttctttcgatgccgttcttttcgatgccgctgtcttcaggacttacaagggtggcactttgctctcaatgaattatatagtgttgtgtggggtaatagccaattttaactttattaaagttaaatggctacgccataaatatccggatgttttcttgatgcctttttgggatattgcgaggtggatttcctgtctagagccaatttgattttatattagttacgtaaattcctcctccgggtgttcaaatttaaggttgtgtggtgaatattaagaatcgcccttgggtggatcttacttgcactgtcactgttaaaggaacttaaaaaggttaaaacaaaacacctatccaaattttaccttcaaattagctttacaatacagctcgcttttaccagttgaattataaaatacatgccttagaaaatatagactgaccaacagacatgcaaatactaagtaaatcaatgcaaattagcttcggtataaaacatactcaaatccagcataacattcaaatgtggtttttgttttaaaagaagtattctgtgcactgtcccaaaaatttgttgttttaaattaaatatcttgtgtctcgatatgagtaactttgaataaagctttttaagcgtgtattctcttttacatacattaactcagttcttgagtgcttgtttgtgttggattttatgaaatgcaaacataaaaatcgggcttttgtctttaaaatgtgttgtttgtgagatctttttgattaatattgtgattttgcttaaaatatgctagcataaattgaagggaatgctttaaatgacaagcagtttttctgcaagaaattcagcctggaactagaatagcctcagggtgaaaaatagtaggtctcctcttcctagacatgtaaatcaacatcctaaatcaactacctgatgtctgcatttgcctttaatgcacatagagtggtggagtgtggaacaggtagaaaattgtttcttgaaattatcagagtttttgttcttcaaaattttcactccagcttaccacctgttctgatttccacacactcttccacacttacctacatatagtaagatctttccaatagaatttcctgctattataacctgcgtagaaatgttgatggcttattgatcatgtgtcagggtgtttactgtacccccaaagcagctctgaaacatcatgtgatcttgactgttgatcctaggtaattgtatgtaattttgattttatttattttaacagatgcagtttatgttgctttttagtcgccagggaaagcttcgactgcagaaatggtatgtcccactgtcagacaaagaaaagaagaagatcacaagagaacttgttcaaaccgttttagcacggaaacccaagatgtgcagcttccttgagtggagagatctgaagattgtttataaaaggtatttttgtttttttttatcagaaaggtaaaatactgtcaaatattagggttatttctaatgaggaaattgcagacttttatgtcaataaacaaagattaataaatattaaatgaaataaatttaaaggaaaactttccatttaaaaataagtaactgctattttgattgcttgccttaggctgaagcaatagcagcagggaatcatttttaaattaattatataaaaaagacagacaattattcctgcttaatcaccattttagaaaaatttagtaaattcattactggggtaaatagggtattttaaatttttaagtacttcgctaaattcttgcatgcatagataacagtgtaataattccttgttataacaaatctataaaataattactgatatttggtatttcttttctgacttttagaattaatcttattcataaagatcctggacacatagaccatctcagtatacagatgtttaaatactttgtgtatatatagaatgtctttcctagtagcatttattaatttaaaatagactttttgctgtgaaggagttatgtttagatatgataattttaccaaggatagattttttttaaagtgatgtttcaaaataacttgtaaaaaaatagcttttttacacagttttttctttaatgctacatatctttattttgttggtaaccaaaagttttctaagcagtttaaaagaaatataatttcttcttttataggatttttttgagggaacatttccttatttcttccccatttctggtcccctttgaataatttactgaattcaacataaaagcatttcttcatataaaacatggtcttgtatggggagtactcagagaacagtatgcaattcagtgatggtggagagaagtgtaattttctatcactatatttcaaatatgggtgtgttttatggaagaggtggcaggggaaaacagagattaataggacattgagaccattagacttcttctttcatagtaaatttcatcagcttgggtgatttttgtatccaatgtttggtttagtatttgttgagaaagatcatacatagcatttgagaactggaagaatccttaagaacacacttacaatctttttgcccagggttagaatcttgaataaagcaaatagaaatagaattgcttttgtggaatcagaaaaaggaaccttgtactctggctcagttggtctctgctctctgcacaagagacaggtactggatttgaaaaaacagtttattgttcaaatttcaatttataaaagatgagaatttgtgagtggtgacttggcccaaggtcatatactagtgatgggctttgggctacaatctaagtcttaaatgtggaggcaatagttttaaataggtgtggaaagacatagagatcagatttgcattttctgcaaagagtgcagtaaaacaatggctgaggagtgggctgagactggcacctgcaggatcagtaggggactgcatgatgattggttcctgagctgagaggccagaaagacctctgagagacctgttacctaggaaaggaagtggagtcaccatgtggccttttattgttcccttgttctctgatgggatggggtgggaatagacatggaacttgagggtggaagttagacatagcatagcagataatcagcaggtggaagggataaagaagcagccgagtgtgtcaggtcagtaaagtcatggaggcagagcgacttgagagtaagaacactaatgccaggtttacatgaaggtcactaagactgagagctcttggagtcttacggtgagcgtttcatgcattgactgttgccagaacattttcagtggagtagagacagaacttttgatataatgaggcaaaggtggagaggtggagaaatcaaaatagcatgtatagagagtatataggagagctttgccaaggccagaagaggttgtaactacccatagacatgaattctggattcctggacagggtttataaaaggtgtgagaagtttaagcttattctagatagtgaaaggagtcccccgtgtggaggaggaaaattctagcaagagaacaagcccatgaatgggccattccaaggaaagagcaggttggggtgcacagacagctgccacgcagcccatccctgtccatctgtccatctccctacctttttcagaatttcaaaaagaactccaacctgatctgataattagatcaaagatttttttcaaacctaatttggacttaacaaaaaggaaaaaagctttattgagatgttttgtattcagaagacaaaatgtataatgcttttctttatccatatcaccctgaaaacctcatctgctagccacttaactgtgtactttgttattatcaggtgatgtgctttccctgttccgactggaagaccttttaagccagagactttctactgagcgtctaagaaattctgcgctagcacttgaactgttcctcttagcgtgtttgttatgccgcccttgttccctgagcatttgccatgcatgttttccctcgtgagaggaagcaccggctattacaattactattcataatctctgcaatagaatgatttgggtaatatcgttgacaatctgaggacttgggtggtgttgccatgtgccattatctagtattttgactttgactatgctgggctttgcctttgtttcctcatcttttaagtaagtgctcctgaagctcgcgtagagccaggacactgtgtgccgagtttgtgcagcatttcagaggagaggcaattgaattttggtcttttaagactaatgttaaaatgcatccccatgttaccagcttgagaatttgttgaaggatacttaatgattttctttactaacaaaagaaatgttaccaacatactagtgggtgttgagaattgtttagctacattcacgcacagtcagctgatatttagctgactgcggagaagtcatgtgttttgaatataagaataggcactttcagatgttctgagtgccagtaattagagtaagccctaatccatggtgctaaaaataactaaccatacctctctccttactagtctattattaattttacttcagatttagacttacaaatatgtacttagagaacaaaatgagcccattattgagttttaaagcaccatttggccctaaaaatagggagtattcttcaggttctcttggtaatcttttactaaatcttttttttaatctctttcccttcttcaaagctcttaatatattgcattgagcatattttaattttaaccaggtgcaggattattttaatacagttcgcagctgtggtttttaatagaaaatttgggctccagggtcaaatttctgttctgagccggttactcaagcctgggtctcctataaatgcaaatagtaatgctatcttagtaaggctgttgtgaagattaagatgtaaaatatgcacaagccttggcgaacatttattgtctcgctgacggtgaggctcttcctggagcttgctgctctacttgcttcttctgaagaggtgttcttatcatgctaagaaggaatacttcttcaagttgcccttttctcccccgtcttagtgaaggaggcatttggaggattgaagttgccactggatagcataggaaaccctgattggatctctaatatgactgaaaaaaaaattaactgctgttgagtagttttcttcttacagtgttttaggttggtgcctagacaatcagtcctgcttatttttaaatgcatgactggtataatttaggaccttcaggtgttttgttgcttaaatatttttatttgtaaagaaagaggcagtatgtagatcaagaaacaaggagagagttcccataccagatacctacctaacattagcatgggacaagtttgaaaataatcttatcccaaatttactattagtaatctctgcaaaagaattatttgttattctgttcatagaaacaattgtatcagccttttgctctgtcatttttatatcatttactctttagttttcataattcaaagaatcccttatatcggcggttctcaacctgtgggtcacaacccctttggcaaacccccatctctaaaaatatttacattatagctcatagcagtaacaaaagtatagttttgaagtagcaatgaaaatacttttatgatagggggtctccacaacatgaggagcagtcttaaaatatcgagcatttagtaagggggagaaccaataccctatgtagtttgtgccaggctctccagatgctggcatggattagggagcatggagagtcggaatagccttgcttttctaaataaacaaaacaaggttagaatgggagcaagagcaagtgttttgctcaagttagagatggtgccctgttttgtctttcctgacttctcttactcgggacaagggaacacactgaaaggtagatctactttgagagaccacaggcttgcagattaaagatttctgtgtatacattgcccttcaataccatgttctaaaacattgacaatatcttcaataagcccttcagttggataaattgacagcttgttttctcccatttgcttgtagtgtgaatcaatcacactaattaagtaaacttaagaaaactggctcaattatatttttcaaatgtgtagaaagcaatctgaaaggaagaagagcaagatcaattactccttctaagagacatgattgaattatttttctcttttctttttgcctgtgttttccaaaatttctcttgcacatttattacttttgtaatctaggagaaaaagaatttgttttaaaagaagaataaacatgattataataagcatgaggacttgtacaacagggcatgaaaatatatttagataacatgattataggggtaacatttttctgtaattctgtttcattacagatatgccagtctatatttttgctgtgctattgaggatcaggacaatgaactgattaccctggaaataatccatcgttacgtggaattacttgacaagtattttggcagtgtgagtagtagttttagggttttttttttatcctgtctctaacaggcttattatttgaggattctaacttaaggagaggacagggctggctctttcttgttgtcagtgtttctagtcaacttttcagaatctctggccccacagatgtactcatttaattataatggtgagaataagttttaaaatagtaaaatagggatgttggaaagatagctcagttggtgccatgcttaccactcaagtatgagaacctgaattgaatctcaagtatgcacatcaaaagccagcgttggctgctgctgctgctgctgctttttaaatgttgtatgtatgggtgtcttgcctacatagacatctatgcatcaattgtacactggtgtccacaaaagccaaaagaagatgtcaaatcccctggaagtcgacatacagatggtgatgagctataatgtaggtgctaggaaatgaaccttggtcatttgcaagtgcagacagtctttttaaatgatgaaccatctgtgcagcccctggcttttgcttctaattcccagggtggtgttgacagatggatctttggagctcactgatcagccagccctatcctagtcagtgaggcctaggtcccagtgagaaaccttgtctctaaaatccaggtagatggctcctgaggaacaacagccatttgcacatcagtgtacacatgcacacacatacatacatgcacccacacacgaacacacgtgtgaaatagagttctattactgacgttaacattctggaagagtaaagtatatcattcagaattgttagcagcttaatcacattactcaaaaactgtgtatttaaagatcagttttgatgagtggaaaattattaagttgactacatagggagtgtgcagagccagatcttgtaggcattgtgctgtcaagtgcttgagatttgacaattaagcttacttaaatcaatggtgcttaatcagcaagatttccatttggaaaagaattaagatcaattcaatctgatgagattttcttcactgcccagtagtgaataagcatctttggcttaagttttatcaggccttgtttttgtttgcttatttcttttcttgttgcttttcaggtatgtgaacttgatatcatctttaattttgagaaggcctattttattttggatgaatttctcttgggaggagaagttcaggaaacatccaagaaaaatgtccttaaagcaattgagcaggccgatctcctgcaggaggtaagctacttaggctcctgaaaaggagctagcatgtttcgctttgctagggaaatctcaggcatcattccttcgagttttagaagtgacctcaaagcatgctttgtatggagtgttcatgtgtcagtcacatcaactcagttatctatgaatgggtggttctctggggagatgggcctccccatcgggcttagaggacagacagctttaattcaaataaataaatgaatcaatagagaaataaatgcatatattaaaaggggaaaacaattggccaaaagtaacaatcatttaagaacttgccatcctttgtttgaattacttaaagcccctccacctttttcattagtatggataattaggagttgactgtgagattatggcatttcctttccaaattggttcatgttttcacctcatgtccattaagaataaatgtagtcaagcaattgctagtgttttctaattaaactttttagagaaccctctggctttgagttaagaaaattaacttaaaatgaattagtacttctttgttcttttgaaataactaaccatattctgtcaaaactgttatattcgtgtcttaacttccttaccccagaaccatagcaacccctttcctttctaattgccttcaccgtcctgagctaatcatgtgcttgatgctgaggtaccaagctaaattatgctttagagcttatggtgcttattaaaatacagagagtttagcatgaaaatgtgttactaaagaaaatataggctgttttcattaaggcatatatatatatacatatatatatatatatatatatatatatgacataaatatttgtgtcccatggattcatttactagaagtattgaaagtaggtttctatttctcatttatttaaccctttcttatctattacatattaatgtttaattagtaaaataaactttaaaatcagtgttttctagtatttctgaaattgctacctttaaaggaataactaaaagaagactaactttaattttccgttataatttctttacttttggtatttgtagtggagggaactcctcgtaaagcctctgtatcagctgtagggcctgcttaaaattttcttgatatcacccagactctacaactgctaaatgtgaggctacagactgtgtgtttaatgtagtagttgtcagaaaataggttggtgagtacaaaactgtagtatttcagtggcggccttcacaccatctgctgtttggtagtcaaatgaacacagaccgtttttcttgtgtacacagtttgccatgtggattactgattacaaacatgccattttggaggtttgtaattctaacatcaggtctgctgactttaagactatagtctactgttataaaattggttttaaagttagcatctccttctgttgtttactatcaaacttaagagacaacaaacaaacaaaaatgatgaggttaagttaggggtgtagaatgtttgcctacctttcatgaagccctgaggtcagtccctagctcagcataaaccaagatatggtggggtatgcctgaatattagcacttgggaagtggagacagaagaatcaggagttaaaggtctgggctacaaaggaagttttgagggaagcctcagggtaacctgaggccctgccaaaaataaaactaaccaaaagttaggccccaagattgggaattcaaaattcttcatatttgtgtcttgtcttaatgtttaattattatagaactataatctcttgcagaacttatttcttctaagtttttcattattttctggttaattttttgttcttttcaagacatttttaaagctgttaaaagttcagtttttgcttttaatgatgttcccagagagtgatgcttagggcactaggatctccttgaccctgggttactttgtaaatgctactagaaaatggctccatgctttgcactaggacaaggccattgtgtttacttgatagtgtgtatttcccttgtgaggggatcaaagcattcttagggcagtcagtatgtgctatttaccacttcttaggcctgaggacagtcactgttgttgttaccagtagttagaacttttcatggatatggagatttatagacagtattttcaaaagtctcttcttgttagatttaccaaaatgcctagaatataatagcttcgtaggtcttataatttgagatatattagtcactttgtcaatgtcctgaagtgattttgtttctaaaattgtctaaggatgctattgtagctaaattcatcctaaactttgcagtgaaagtactaaaaacctgattttaatgtaatttttcatgtattttgacttttctatttagtgtcaaaatctttatttggactattttgagcactgaagatgattttgaattaacaatgaacttcatctgttggctgaagaatatatataaattaatatagttttgattttagatattttaaaaatttctattcagaaaatttattaaaattttactttgcacaatttatataaatatgtaatttaggtactctttcatcttgtgggcagatattcagtggctaaagtagattttcttgttatcatgctacagaacaaaaagaatgtatatctgaataataactgccaaaatattagcaaacattgtgatttaatagtatatttttcatatttgacatttgcaaccaactcgtgtttataacttttggttgcatgaattcataattaccttttggagggaaatcccagaaattggcctgttattcaatttgttactacttgactgttggaattttaaacatgccatcttaacatgccactggtactaaagttgatttttatatgaacatatgacatgatgagattaataaagttatattctttacaatgcttagcatatttccctccccacatacctagtttgggggtgggcatctgagggctaatgatgcaattgaacataaggaaataatagtatggttgtttttttcctgtgaagtcaggcacttaccagcttttctctgctccttaattttatagagccagaatgaagaatggggaggtttgtctgaggatatcttatgataaagaacagtctaagactttagttcctttgatccccaacttatttattggtaactactaaatttaccatttttgtggcatgaataaaatggcactatgcagagactgttgcacgtgagatgatttcaagtccttgcttgatctgtgaagatcaaatagttaaatattaggcatcaggcttgatataaccttagcggtacatgcatgatggtgttgatcagcgctttgagatgtgccgacctttctttcttatactaacagcatcactttgaaattcgtggggatttttttttttttgagctttgtttgctgttggtattgcttctcactaaagtaatccatggaatggaaaaaggtgaggtgccaaaagcaagcactgtactcatgaatttgcttctacttgaagatgatccagtttatgaatagggtcatgggacttgcagatgtttgtctcatctagaacatgatagtctatggagaattactgctgctcaaattgatttgttttagtgctgaggcctgcatgaaatatcttaaatagtttgctgtgtctttgtaaaagtaatcactgatctgtgggactgcataaaaatggaaaggtaagaatcctgagagaaaggatggtttctgtaaaaaaaattgaggcttttataataacgttaagcaaataaatatttcttaaagtatcttataatgtgaagatttaaatttttcaaaaaattaagccttgctacttaagaatatttaggcacgctagtgagattcaagaatatcttaaattgtttaaaaagcacatatcttttcaaatatataaaattgtcatttaacagcaaaacattttattataaaacttttcctttatttcctgttataagataaaaccccttaaagtcttttgtaagtaccactctttcatgttataacttttaagcctaaaactctttctttaactgggttaaaagttaaggctatagttattaatgcaagagtactttaaatgtagtttgggatctgctagaacagatatggagaaatgagattttattgatacttgaaatagacaatccagaagcaggcagatatacaaggtagaatggatctctatcctttagctttatttttagtaccatatactatgactagtgtcactggtgtctggctttcaaattgtaatcattttgttctatgtagttttagtcagcttcctcttcctcctcctcctcttcttttttgtttatcctttgaaattttttagccacacccccctttgtttcttttctaactcatggtggctagctactgtgagctctttgtttcttttttattattattattattagatattttctttatttacatttcaaatgctatcctgaaagttccctataccctccccccaccccccgccctgctcccctacccacccactcccacgttttggccctggcattcccctgtactggggcatataaagtttgcatgtccaatgggcctctcttcccaatgatggcccactagaccatcttctgctacatatgcagctaaagacacgagctctggggtactggttagctctttgtttcttgtttgtttttgcagcaccttgggccagaactcagggtagagtctaccctaggcaaacccttcatcacagtcctatatccctagcttcacttggctttttgtaatgattaaaaattggaatgatttaaatagtcaattataaatttaatcttgaaacaatttttacgagaacccatagtaatgcagttttatattaatgcatttatattactgtttttatacaaagtacaaaaattattgaataatattctcattacttgctgtgctctctcaaattttgtcttctattctattttttcctttttttaatgtcaatcttaaccttcataattgatttcatgatcctagagttaggacctactaagagcatattgtgagtggtcagtggtgattttttttcattaaacagtacttgctgaaaaattttagatttgagttattcccctactgacattataatttgttttgtttcctgttactttaaaaaatttaatttccatagtagaaaaattagtaaatacaagccaacatacttgaatataatcttacccaccaagcagagccaaagcagtgcatagcatctcctaggtagagaccaaggacactgttaaatatcctattctgcacaggacacacctaccaaagaattagccagcccctaaaatcagttgtatccaagttgagaaaccctgacttactttaacactttgagctaaaaatttcatttttcatttatgaactgttacatctttttaatatgtagtattataatgtagtatatgtaatattcagtataaatgatggctgaaaattagaaatactaagaagtgcaaaaactttaaaattgtgaaaagaagaacatgttaacacataaataactatagaaaaatcacccctgtgattcatacaaattacctttgcctgataactagcaactggggcaataatgtatggttgcctttagaacctaacccacagcaaagcttatgggatgtcatggaatgatctaatttcctcagcaacaactagatctgttcacttctattaaggtaattgagtttttatgtggaaacaagattgactctaccctgcaggcaggcagaacactattgaattagttggtgattttctcatccactttaggatgggatcattccataaaggaggactaaagtgaccagactttccagtcagactttcttttgttacagagtttttgttcttcctcatcctatcagacttgaagagtttgtttgaaattctgattctaaggaattgtttgtttagaaaactggctaaatttagagaatttcggggcaaattcaccgacactagaataagcttaaatatttctttaatctgagctaatttttctgttgttttatttttttattttaaaagtataattagatgccagagaaagtaatttgtccttagtatcttataattaacaggtttaaagtagcatttgtaagacataattaaaaattactcaactcgttctttttaagaaaataataatagaaatagatgagtagcccagtatgaaagagcagagggcatgactaagtcagggatgagaaaaaaaaagtctttccaaagggaatacaaactaaaacaccaactgacccttttaactattgtcttacaacaatcagagacattcttgttactgcttgtaaacacttaacgttgtattccattaaggattggtttttgtggtgtctgtttcatgatgaaacgtgtactatacctgttgtcccattacatatacatccaagtattttatccaactaagaaacacacacacacacacacacatatatatatatatatatgcacacacacataccatgcgtatgtatgtctatgcaccaagacatagtctcagcatgatattaagccattggaatttacccaaatgtccatcagtgggaaacaattgaagagaattatagtagtcatatctgccattgctaatctaactgtgaaatacaaaagactaaatttccatgtaatgatatggaaagatactcaagatatatgaaattacaaatgatcaagaagcagaatactgactatgagatagcttctacctccatttttcagataagaaaaccaagcaagttttaaaatatttattttatattataaattttttggtggaagaatgctgcagtctgaatgtataacaacacaatgtaacattgttacattgtgttgttacagatggactacaccatgagccctgtcatctttttgttttgttttgttttgttttttggtttttttttgtttttcgagacagggttgctctgtataaccctggctgtcctggagctcactttgtagaccaggttggcctcgaactcagaaatccgcctgcctctgcctcccgagtgctgggattaaaggcatgcgccaccacgctcggctgaaccctgtcatcttaaaggtgccttataaactgttttcaatccttctgtttttaaaattcattgctcaaaatagatcttggtggttttgtatattgtgaggccctttggggctttaaaacaaggtacaaaatacactattttataatacaaggagtatggaaagaaactccttttaaaacaactgaagtaaggtaataaacttgaaatcacactttcttatattatatatatatatatatatattatttcttatatttattattatatataattttttctcttatcacattgaactagaatcaggagagtagccattcagtcttggatatgtaacaccattaggttatttaagtatctctcagtttaacagtacttaagctaatacaattgctattttaggagtatttcagctttctggttagttttacttatgagccacataataatcttataatggtgaatgaatatctaggaaattttatggtatttagggagacagtgattttgaaaagagagctaagttgattcttgtctgatgtttttgacatcttaaacttgccacactacatctagtccttttgtaacttgagagtggaattattcttagtacagaggaaagatgaaaaagcatgcatactgacgagaaggagctcatgcaaagagtaacgaacattagaaataaaggggtttaaaatatgctggattgaaagggggatggggcagaatcaaaagcactggttgtaggcaagcaatgtttcctttgttagaaggcactagtggagtaaagctggagatctttcatgagttgatgagcaaacttgagaagttcttattcttggacttgaaaaatggcatctagaggagacccactggggactggggaaaagagaaaatagcaagcgaagtgtggggtttggcaacagactcaccaaagaataaataagtgctgagcaaagggattgtccaaaaaggaaggctcatttcaggttggaaataatgcatttgtaatagtcataaattcagtttgctgagttttatatatgtgtgtgtgtgtgactgcttccaaaggtgcccacaggaagttcaagatagtagacctagttgtgcagggtcttttgtatgttgtgatgggctgtaccatcacctctaatccttatgtccttgtgttttactcagaaaatgtactgataagggtccagaatggtgtttatgttgaattgactgtatatcctttgcatatgagacggggagagtcttggtcaattacatagttaaatcttttacctaaaagtccagatgttaacagtctaaactggacatttcctagtatcctaaaaatgattaaaggataccatttactatatataccaccatttatttttgagcattttagaggtgtctttcttgaaggatgctcttccagtgaagaggggtttcttcctataaagaatattcttgacaattgataggtgctaatttcttgtttcagtatagtagtgtggacccttggctttaaaaaagtagtttggattatcatcaacccttttgcttaccaaagggtcattaaaaacaaacaaacaaacaaaagaaagaaagaaagaaagaaaaacaaactgaaacctgttagttaaaaaacaatggcagtgcctggggtgaccacatttcaaaaattgtccttgtaagttttctccaggaaggaatgactgcattttattctatttttacttttattataatttactttattcagccctgttgggaaaaccgcctttgtccttcaatgggcataaaaattattgtggttagttttcatatgacatgatataaagttgagaagtcaaaaactttaaaaactgtaacataaaggcaaagaattggtattgaagtataaggttttttgagacttaaacttttcttgttctctctccagaaaacagagactatgtatcacagcaagagtttcattgggtataagaaagcgtactagaatacgtgctggaagtacagacatgcatcaaaatgtagtaggatatatgaattcagttctaattatcattttgtcaagtttattatttgtgttttggtattatttggaaaattaattgcaataccaatggatagccctattatttcattaaattgatgggttttaggaaattttccctgtaattcataattgagattataatttaccttttatacagaatattgaaattgggtgagactcattgacaaagtattcttaaatattgtaaatcagtaatgttatcacagatgaagccttccctgtgagaacgaaagcttctataaagtgaagcactgttactaatgttgctttacttgttttatccttgctctattctaaatgggaaaggggcagcttttgtagcctaatattttagagttctaactttaaaattcatcggggatgctgtaaggtccatttcagaccccaccttgggatatttttgtcactttttgatgtgaaaacatctaacatcttgtcagatatatttataagcagatgtttaaaaattttagggagttccttagaatcattttgaggactttcaaaaaaattaatcttttagcttcaaagtcacatttttttaaagtaagtcaacaattaaaagctttcatacttaacaataccatatgatggctagttttaacttgttgggaggaagccttttctctggacctctccttagtgtaataggaccctgatgaatgtgacacactggtgaaagggagttttctaactgaacttgccactaattagcatttacttaaactggcaatcttctcagattagtagtaagtacagtgctttaggattctgtgaaatgtaggttatcttgtttactgttacataccatgaacttgaaaaagataaatctgaactgggcattaagaacttaagtgttcagccacaaaccaaagaacaaaagcaaatctgatgctttagatcattttactgtgaactaaacattctgattgtgtctccatcagcttgtgtactgtgtgtaagaatatatgcatttcttttgtagccacgccatgaatattttaatgtccctgtgtactaatgactgctcatcgactatgcagactttcacagaggaaatagagaactgatatacttatgaaagaaaatgtcctcagcttggtgactaattctcctgtaaaataatatatagcattttatagctagtacctttatgattgtatttttctgtgcctattcctaattctatttattctgtatatgatatgacatagttttttctgtctactactgatttcttctttacaaaatatgacttgtgaatgttttaatattctaaacacatacaagttatcattagtaaatcatctgtgattaatcttatgagggtataagagaaagaccgggaacaatcacaaatgtttaccaaagaaaatagttaggaactcaggcaaaattaggagcaccacaatatttaatgtagtttgatcttccactgttgaagaaaaccaagctttatttagcactaagattactttatagtctgtacaagctaatatgttggacagtatcacataaaaatgtgttgaagcaatataagaaaaaaatcaattgtataattctctaagatctaaggttaaaacatttcaatttttaagaaattttgtattgccaatatttattaagccacatttatgcagtgtcaaaagtcctttaagaactatcagaaagctatgtcacaaagtttcttgtattgttgctcagtaacagcccttgagtcagtagtactgagcctacttatgtgatacaaaattctgatattcattttcaatattcaaacatttatacttattagttaatggcttcctaattaatatattaagccttcttctaaacactcagtgctgtgttaacaatggttgtatattttggaatactaaaagtttttaatattaattttataaaaatatgcttttaataatatttatcaaattctactattaaaataccagataactcatttgtctatctagagagtttaaaacctaagtaaattgttactaaacagtaacttaagtggcatggtagtgcatgcctgtcatcctagtacctgggaggctgatgcaggagcaagatgagttactatagtacctagggcatccctgtctcaaaagacaaaaactaaatatgccaaaaactctaggaacttcagaaggtacccaaatgagtttcccactgaaagaagatctataaaatgtcttaggaaatgtagtgttaggcagctgtacaggtcagctctctccattaccatctgaaacttcacaaaacattggtctttcatttccatttttcccatcctcccacactacatgttgttcacctgattttaatgttgcataaatatgcattgtctcatgcctgtttgttttggatgctgtgtgctgagctgtaacaaaatgttgtgtttttgtgagggggagggggtatctgtatacagctgcttgctttaaattagcacattctcaaatagcttttcctgcatgtctgaaataaagtattgcatgta

SEQ ID NO: 366 - DNA, 20557 bp, mus musculus; identical to SEQ ID NO: 365

SEQ ID NO: 367 - DNA, 265 bp, mus musculus
cggagctgcgccgcgctgacgccgcatcttcccgcctcccagtgggccgggcgcgcttgggttaggcttctgagtgcggactggtaacaaatggctgggccctgaaagcggagcgcccttgatgggggtggtttagggtagccattcgcggcttcccgccgctgtgagaattatgtcagaaaagaaggccttccccccaggcaggggcgtcacgcgtggccgcggtggccgggggcgtgaggtggatttggcccccggagcccgg

SEQ ID NO: 368 - DNA, 57900 bp, mus musculus
cttcagggccgggctcttcccgggtatggatagatacatcagctccgccctcggacttcagtcaaggggcggtacaagggtctgttccaccctgggcggtccccccttttaaacccaagtctcgggagaattttacccaaaccatgacggatctggagaagcccagtatcacaggccacatgttcgacgtagtcgtgattggaggcggcatctcaggttagtttggatctttaatagtagcataaggggccctagatgaccaggggtagggaacttgcagtgtccctgttgtgtttgggagggtctttctcctccgtgtgagtgttaactataacagggccccagatcctgccagatgggagcaggggcttgtccctttgcatacactggtggagggaggcaaaataatttgactcctaactacttaatactaatgattaattagctcttgttttgcaattacatttagcagattacatgagtttcccctgtcttcaacagtgtggtgggttggcaacacatttgctattttacaaaaccaagcaactgtggcttaagagtttcagtaactgtcctggtgtctgaatacctccctgggaagccacagacctgttttctcccatttaagaccttcacttccaattctataggtggttgcttagcctccctgacttcacatcctctcctctgaatagcacaacagccagtctatgtatgtactactgaagtagtagtaggattagttcagttcagttcttctctgaagcaccattgcttagaaagtgagtaggtaaaaaaaaaaaaaaaaatacggagacagcatcttttagaaaaaagtaattttttttttaaagagctggaagtttcaacgtattcctgctgggtttttttcagaacttgtataaaagtgtagtgaattgttcaaagggaatctcttgtatgcttttgctgagagctgcactgtctaaatcttgtcctgtggtattggcttaaatggctcatcaagtaaggggaagatgaaatttttttctctattttcctggagacctcataaatatatgtatattaaattgccacctatattgtcattgtaaaaatttaggagttattctttgtctctaggtagaagtccaagccctttctctcaagtgttaataatttcagagatgtgtgcaagatataatttagagggagaaagacagtaggaaggagtaaatagggtgcccccacagtatctattttaatatatgttccctttgagtagaccataaacgtgcttatatagttattttagatataggtagctttggactcagcctgttcaggataaacagtctaattatcagattggtatggactgttcctttggctatcctagccagtggcagcaagtaataggcctgtgtgttgcagtatcagaaggaagcaaatccttgtggacagtaagaaaagggaacatatatcctcccttccttccttccttccttccttccttccttccttccttccttccttccttccttccacacttgttgagtgcctacagtttagtggattggtgttttcaaaaatctggttcctttaggcaattaccctagaagcaatgtggttgttgatcattgaagtagaaatatgatgataatttgtagtatacatcgattaatgctataccacaatttgctgttttgctggaattttattcttttccttttcttggtttgtccccagtgttccttaaagaaagctttgtcttttaaattgtttttgatgttggtctagcctttaatagctgaactatttctccagcctgcctttttaaaatttttatgagacagtgtctcatgaatctcaggctggcatccaatttaacatgtagctaaggatgaactttgatttctgattctctagcatctacttgccaagtgctcagattgcagatgtgggatattatgcctgccttatgtagtactggggatcaatgccagggcttcttttatgcatggtaggcaaacattctatcaagtgagctatatccccagccacatattttgtttttcttttgtctaattgcttggtctttcttccttttcatacttgactgttcatatttagatatcagcagagtgtatttatcatgtagctgatgaaccttaaaactctaggtccgttctgattctcattccaaataccagctctatactaagtcatgtaaaacttttgctttcttttgttttgtggtggtggtggattaacacagggtctcatatagcataggctggacttgaaatttctgtgtacttagaatggctttgggcttctaatcctcctggctacgccccaccaagtacctggcgtattgattttttatttcttaaagagagcatctaaattatatgaagtgccgcaaaaattctgtatttattcttgggaattattagtacatttcaggggaggagggcataaagaacttcttttctctcaataattcacgtgcttctttagtccagacacaaactttcagttcaccagcaacagtggaacttgccctaagtgttatttttaccagtcagatctgagagattgtagcagccaaactgactagaaacattgctttttgtctgtgttgccatccaaaatgaattattactaacatagatgtggatgcctgtctgactcaggtattatgtacaggctttatgtttcataaataggcaagagcattctggggaactccacatgtctctttgtgtatgctagtcatatcccatggtatgattcccatgatataatctctcagtttctttgtttgttttgacgaaggtctgatgtaattcaggctggcttcaatattttgcattgatcatgtagttgaggctgccatgaactcctgattctcctgcttccatctcccaagtgctagaattaaaggtgttgctatctttccaagctcctgaatcaagtttatagagtcactgaagcagagttagagaatatttttttttaaaaatgatattactattaacatgaattttaagcacaagcgataagggtcagtggcaatctgtaaggaagttaagatacactccaaagcaagggagtaggcttttcaaacaagagtagctttgtgtcagttttaaatgctttggaatattcttgatatggtacctatttaactataatctatggtcaataaatagcatttgcaatgttatgcttgtaacataacatacctcctagaagactacagattctaaatgacattcagaatttattcacattaggaagctttatctttatacaaagaataatgatatctctattttgtcatttaaaacataaaacatttctaacaagcatgacaccctattttctgtccattatagtaattatatttttaatcttgtcttagtagttatgaagggaaatggcccttggtataatccataatctgtaacccagaccttttgaaatactttccaggttttctgtgacactattgaattctgaacttttatcatacattgatcataccttttccatttttgaaattacctcaaggctctgctgtaagtcactcctgggctcttatactctctttcttattatattcctccagtgttcccttatctgtagaaagcttttaaatctttaatttaaatccttttctttctctaaactcatatcccatagcttatcttctcactgatattttgcactcaaatattgcagattcaacatatctgctgcagttctttgattcttttctaggataccatcttttctatcattttgatatatccttttatctattttatttatttctgagatagggtcttacatagtctaggcataatttgaagtcaccatatatccaaggatgatcttgaccttttaattcactcgtctctacttcctgagtgcgaggctcataggtgtgccaccacacccaggatttttttctttttctatttttcatgcattactagtaatggaacacaggcttcatgcatactagatgaacactaccaaatgagcctcatctatagttgttatgtacttttcttttatacaatgagataaatattgttatgagtattaacaaaatattggtaccttgagaaagaagtatgatttgttataatagatggtgataaaacaattgaaaaaaaaaagtcataccaaacagtagataccagaggagcattgctttagggccacgagggtatatgaaaaagacaagtagtacttaatgtaagcacatgaccagggaaggaaaatagttttcttttgggcctctaggaatgtgatcatgtgagctacttggatattcagtgtgctaagtgcatggggattctatgcttctgaactgtgaagggtcaaaacatatataatgaaaatgccttagtcagaatgctgcatggttcctggtgaataaaatggtttgttttcaattaaataccaaatatcatgtagaaagaactctcactatatatttataaaacattacatatttttatctatgggccatgctttactataaaaattgagagctccagctgcctagaacctggtagtgtattaaactaacagggattgagttttttcatgatctaagatagaaaagacatttttcatgaaaactaatatattgagttctacatactgaaatttctccctttctgaaatatatcacctgtaaaaatcatttctatgaggaccatcttaaaattttaacccagaacagggtggcacatactatgttgctttgcagtgatttttaaaaagcttacattttaaatgagggtactagtttttgatagcttagttattggatactgaggatcaatgagaatgagaattttgtgtcttttagtatacttcttgtatttagtttgatttttctttttcattaaaaactctggaggcagaggcaggtggatttctgagttcgaggccagcctggtctacaaagtgagttccaggacagccagagctatacagagaaactctgtctcgaaaacaaaacaaaacaaaacaaaacaaacaaacaaaaaaacccatgagtatactttcattctattgtgtaaactattttttgttgtttttgaacagtgatataagagttacatttattggaattcagagtaaaaaaatcttttctttttcaaatggtcaaatgtacttttggaagatctgacattgaatgatcatgtttaacatttaatcagtgctagttgatttcgatttttatataactctcagctaatgtgataaatgtttttataagactataagcataatataattacatggaccacagagaccaagtacagagcaaaggtatgtcataatacattattgatgaatattgtacccagtaatctttgtagttgtagtggcgagatgttttaacatgaaagatcttacagtaattggatttggctgtagccagaaatcatgaggatttattgtagctttttttacatagtggaacttgtaaaccacaaaaccctgtgatttagaactgtatacattttataagtatttgcctggtgaatatgcatgcatatttgagatgcatagatttcataataagtttttttttaagactggatgattagaactttacaaaaatatattacattttctaaatgttgtgagaatttgagacaagttgattgtttaggccatttgatctaatacatttgtattgtgacaaatgtataattttaagcaatgatttgtgttttcctttaggtaacacagtccttatattattatctagcattgtgaattagggaaatttaaagtcttttaattgtgattttgttatttagtaataggattaaatgggagtgtagcttagcaataaaatacacacatacctgctataggcaaaactgtggattcaatcccaaatactgcaaaaaaaggagatggcaagggatatagctcagttgacagagagattggcaatataactgaagcctgggttttgtctccagcactgcataaaacaggcatggtaccatacacctgtaatttcactcaggaggtaaaagcgggaggatcagatgttcatggtcatattcatccacctaatatgattgaggccatcctgggatacatgagatcctagaaataagatctcaagaaaaaaaaagttggattacattacatgtatgttttctacatatttttcagtattttttctttttctttttgataatcagcttcataaaggtttttatctttggttttacttttgcatcattccttagcactgtttccttccatgctttattctgaaatttgtttgcatttttttttatactgaaaccctataggagcttaaatcagtcccctggtctcttttcagatatgcattcacatttccccatggtttctcttagttgtttaaaagcacttctccagtaggtaagccaaagtaaacaaaactccacttattaacagtatttgactgagcagggcaaaagtgtcaataagaggttaaacaaagtgattaactttgagaatttattatatattaaccatgtctgaggggcttaataactgctcatatgatttcaaaaggaccaaaatggacgttcagaaaggtggatgaattatcaaatgtcacagaaatttcactggcatgactagacttttgatccttaaagatatttccaggccggacagtggtggcgcacacctttaatccttgcacttgggaggcagaggcaggtggatttccgagttcgaggccagcctggtctacagagtgagttccaggacagccagggctatacaaagaaaccctgtctcgaatatatatatatatttccaccccaccaggacaatccttttctattccctaaatcctttgaaggcttatccatggatctatagtaacctttgtaacttactttgaggcttggtgtactataatctagtgctgttatctgatagttatttacacatgtgactatattacagtgctgttgcttcatggacagttccattgaaaaatgtgggatatcctattaggtttgacaactttcatgtgccaaacatatctgcttttaaatgtttattattattttgggtatggtgtgtgtgtgtgtgtgtgtgtgtgcgtgtgtgtgtatgtgtgtgagtgtgtgtgtgtgagggtgattgtggctatgcaagtaccgtagcacacatatgctgtttttcttttatacctttatgtgtgttctgtggattgagcgcagatcaccagacctgtattgcaagtacctttaccaactgagctatctagacagcccatatatacttttatttatttctttttgtaaatttaatttaattttattttattttatatatacaggttttttgttttgttttgtttttgcctcacacaccatatatgtgcctggtgtctgagaaccagcatgaaatcccttgaaactggacttatggatggttttagatcaccatgtgggtgaattgaatgtagttcttctgtaaggaggacactttctcataacttctgagccatctcttcaggccacttaatcctatatccttttataatggtgaatttaggatgccgtatagggattatacaatttggaccaaacatacccctgaaaatcttggtatgggagtttatgttttaaactctagttctcagaaagctgatgtaaaataattatctcaagttgaaagtcagcctggactaaatggtgagtttcagatcatcttgagctgtagagtgagaccctgtttcaaaaaccaaaagatgctagggaaatggctcagtgggtacaatgttttctctaccagcatcaggacctgagattagagcctggaaaccacagaaaaagccaggtatggtggcgtacatcttatgagtccagtactgacaacagagagagatgatttggactggggctgtggacatagacagatcttggggacttatgggccagataatctagccaaaaggcaagttccagatacagtgacagaaatttcaaaatatatgttggtgaagcaatagaagaagatacaagtcaacttctgacttccacagttgatcacatgagtgaatgtaacataggcccccaccccccacagaaggtgaaggggaagagtgagaagtaggagaaagaagatggagggaaaagaaaccctctgaaaatctggtgaaagctatttgactttttcatttaaagaaggtcatattttcagacataaagtttatttgcttttgtactgggttaacagtatacattcctgaaaccttttctgtgttataggacttgcagtataatttggcctgattatgatgtctgacagaagtggtaaaacatacaaattatatcatatccaattggatattgagatgtatgtttgtaatctcagcatttaggtagaggcagaaggatcaggaattgaaggtcatctttggctacatactaagttcaaaaccagcttgagctatatgagaatttgtttctaagaatttgttttaaacagaaatgttatttataacataagaaagttagtaaatagactatgatgcaattgttaaaatattcagattgaaaactaatgaatataagttctcttttgttctgtttatttccccctcctttttttttttttttgagacagtgttccatgtgcttaaactggcttcaaactcatgtagctgaggatgactttgaacttcttatttccctgtatccacgtcttaagtatgggggcttccaaaccagctctttttgtgctgaggatctgaggatcaaacccttggcttgctttatacatcttatataagcagtctaccaactgagctatatccccagcaaatgagattccttttagtcattttacaagattagtatttaaaatcatgtatttttaagtgcagctgttgatactgaatgtgcatttatttttattatttattatagattataaagaacattgtcctttcaaggcattggataaaattctaacccacactaaagagacaagtttgatcagggggtgtttgttctctagtttatctgttagctcatttgtctatacagcaacttgtgtaatacataggaccctctatgaggcaggggttatagctatgaatctgaagtgctgctggtactggctgagtacccctaacttgaagacaaaaacatctgaaactttttgagtgctgacatggtgccacatggaaaattctgcatctaatattatatgacaggttacagtcagaaagtgtgtgagaagtatcgtataaagctactttaagcctatgcatacatatatggtgtataatgaaacaaactgaactcagtgtttagaccccccccccagttacctaattatatatgcaaataaagaaaatctaaacataatctgaaattcaaaagacgtgggattctaaacactacaagatgagggatattcagtgtatgcttaaggatacttcacaggggcaggggcacagggagcgaacagctaattctccctgcaggaaattataagggaattactttatggaggaaataatgcttgacaaatgtgctgtggactttagataaattataaattcgaatgaagatggcatttaaattgatcatttctaaattaaatgaattagctgtgatctgtggcttacgctaaaaccgtttttattctgtgttatcattcattcattcattcattcattcatccatttattcatccattcattcattcaacatttgttaatggagtgttcactgtggcagtaaaatttctgaggttctctgtttttctggcttggagaatattgcctacaaacttcaatgtaagctgatgtttgattatactttttattgtccaagtgtacaattatgcaagaattatgttggtcagggaccacatcacaaaatagtcaggaagaagttaactatatatattctgggggcaatgatcaaaagtaaaagttagaaatgtcacttctaagaataaagagaataattttgtgaggtattagaggaaaatccataactatatcaaagctttgctcccatacttagctcatgttatagacattaggatgttatttaattagggccctgcctatgggaatttactactataactatttgagcaatcttaaaggtgattaagccagtttttccaaactgtattttgacatacaggtttttaaaaaagaatagcacagtgtgaagaaatgctgaattgaatgataatgatgatgatgattattattattttgctgctcaggacctttaatataaagtgttctctgggatttatcatcaagagagaagtataagtatcgcaacttttaagaacactattactttgccttgggatatcttatctgaggaatggtatttagtatgtttgggggaattatggcttaaaatttaacctttcctagtgtgcagaatttgagaatgtctgtgtggaacacttgtagtatatttgaaatttcaataaaagaattggacaaataatgaattaagaagtaattacatctcccaactgaggtgagatttgtttatctaaagtgaagataaatgctggacaataatcaaataaattgagactgtctagacaaccagtcttttaaattacaggcaaattgaagttaattgttagtttaattctatttattacttgagactgcactatgttttcagcttattaaaattgaaaggattgtaagatttggcctttttaaaaacaaggaatggtttatctgatagtgagcacaaaatccagacaagaatgtttgtatgtcttagtaacaagcatgtgtgcatactgatattctttgttttcttctgtcagcaagcatgatgctagtttaaaaattagaaaaatggggtgataatacttagagtattccaaatatatattgacctgataccctatccttgttaagctttcttgattacttgagaaaaaggttatgtaatggcttgagaaagctcagaggtcctttcttggccttgctaacatgtacaagttccgggggattgaccagtaaaatccaccctactgcaaaggatgttgctgaatgtttttaatttcagcagaggcagaagctggcaaacctctctgaggctacacaaggggatctcacccaaaacaaagcaaaacaacacaacaaaaccccaaacaaaaccaaacaaaaccaaccaggcaaccaaccaaccaaccaaccaatcaatcaaacaaacaaaaaacacccaactattctgttacactcacccacatgaatatggttttgtttcttagtgggtagttttttgtagtggttgcagcaagtatttggactcctgcaacattccaggctcactctaagaaagtaaagttgtattatacattcatattttcaagaagtgggtttttgtttttttgttttttaaatcaagttggcattgtaatcccatgactttggaggctgaggacaaaagaatctaaaatttaaggcctgcttgagcttcatatcttgtaacttttttatttttctcctgattagttgctatctggacatgctagcctcactgtttatagcacacatatagaacctctagacatttcacagcatattttgaaaacacaattcttgctatttcctcataactcatttttttactgacaactttttaaaaaataatctttaacccttctctttcctcttcctttttctttcctttcttcctattacttctttcattccctggtaaatatagtcttgctacacagccaggctagcatcaaaattgcaatcctactgaatgagccttctcagtgaaggaattacaggtatgttacaccatgttcagttgagatctattttttttctaaaagtggtcattgaatttcaaagtgactggaaggagggtagaatgcacaatgatatacaaagtaggttcaaaaatagttaaggagtgtagtttcagagacttatatctgatagtaggtaccatcttttgttttccttcacctcataactaaagttgttatattagaagagcttccctgaagctggacttactgctatatgcctgtaatcacagcactcaagagattgaggcaggagggttgctggcagttaaaggttagcctgcgctgcatagaaagaccttgtctcaaaaaaaaaaaaaaaatgttaagacaacgcctttctagaccacaaatgtttgtctgctttacctgctaggcattaaaaaaaaaataacacttctgcgtcttcaaaccttttatttttcattaaaattacttactagtcattgtctttaccattgacataagaactgagattcatttagtcagcatcatggaaggaatgttttgcatacacagtcattctttgatgtctgtgatgtggagatttggttccagaatctgtgtgagtaccaaaattggaggattttttaagtttttcatgtaaaataatatagttacatagaacctctatgatcattctatgtactttaaatcatctctatattacttgtaatacctaatatataaattttgtgtaaattgctttcatgtaatttatataataatgacaaaaagcttgagtatgttcactatagatccactttttattcatcttaagtaatttttggaggacagggtcttatgtagcctggtctggcctcaaactgacaatacgtgtgaggatagatggccttggagtccagatcctctccctttgctgccaagtgctggtattctgtaggtgtgcttcacgatgctaagctagatagacccaatctctagcaaaaccaaaccaaacaacacacacacaaaacctgattgaatctgaggactaacactagttgatttttctcaaataacttcctgtttaaattttaagatcattcagattcatatttagggtcacaggggatttttactcaatcttttcattcatctttatttacatgttaaatcccaattataccaacctgatgtactctgtgtcctatactacattacacccctgacaggcccaggataacagatctggtgatagcatcacatatatgctaattagaaaaacactattttgaagttcttcttgtttttgcaacaaacttgtactgttataaattactggattttataatcactctaaatagcacttctctttaggtacattaatatgtatcttgatattttaataatatcatctctactgttactctatttctttctaacatgctgattaacctttctttatatcatatttacctctatggttgatttcttttgtaacaggtggtgcgaagataaacaaatattcagatagcatttgaaatataataaataagtatatacacactgtatttccttaatgtgagagctgaaagtttgtgcaagcaggggtattccagtaattatgagcacatgaagtaccacattttggtttctaattttattccccaacaaaagagatgaaggctcactacagaaatgctgataacaaggataggataggcagggaagatactgtgaacctggggtatcctatagcacaagaaataaggaagttcatgcacatgtacaaacacaaactgatagaggaatgtcaaggggcacacaggaaccagttaaaagagctcccagtgaataatttcagcagtaaataatatagtattggattatatactaaagtataaaggaaatatttgtgagcccatactaatgattaaataaataaatgaggaaaataaccaaatgtgtactgctgaagaattctcaacaattcatatacagttccctcaaaatggtagaccacagctttgtattgtataatgtagaatatgtatagcattccttccaaagagtagagtattaaaaggaaagtgactatataactttatagtggagaaactttggaaacccttgctgagcaaggtgattaaattgaggttaccgtaaatgattatacatattgatagcatgataaaatggtaatttacattgtcttttctactgctacaatgttggatttgaaatgtacctttaataaaagcttgtatttacagatgacaccctgttcttagctttgagctaataaatgaagttaagcccagctcctagtatcttagtgtctagaatattagactccactgaaggaaatgagatctaggaacctgagtcctatccatgtttatatagttacaatttctgggtgatggctgagaagagtctctaagtacggtatgactattccagaaaacaaaaaaacatgttcaaaaagattacattttttctaacagctaatctttaatacaagatgaataagctagtcatttgagaatcctttatgagagttaataatactggtaatttttttttagaataatagcaaaatcagcagattctatgtagatctgggatgtttggcatttagatgttaacattttgtctctattattttgcctttaggattggctgctgccaaactattgtcagaatacaaaattaatgtcttggttctggaagcccgggatagagttggaggaagaacatatactgtgagggtaagtgatttcaagaccttatggcatgtcatttaaactataaatggggcacttgaggtcatagccctagaggagctctcatgaaatcacatagttaagccattactccaacaattctaaactattttattgagtaagtggacttttctttcttcatttttttggagacagtgtttttctcagtatcttaggctagccttaaacccactatacatacctgactgacctcaaattcatcctcctacctcagtcgtccaagtgctgggattatagacatacactagtatgcccaacatgtttttttttttttttacaagtgctaactgcatagtgatgggctctgacttcagtcactcacattctagaaacacacccaatgggaacaaataacttcattacaatattgtaatgtctatattatagagtcaaattgagtatgtattacctgtggtagtacaatagtatgactggactaaaagtgattttgtatccctaatgtacacacacatgcacacacataatacacatacatacacacacacacacacacacacacacacacacacacacacacatgctggagtagccattctaatatcgaataaaatcgacttccagcccaaagttatcaaaaaggataaggagggatacttcatactcatcaaaggtaacatctaccaagatgaactctcaattcgaaaagctatgctccaaatgcaagcacatccacattcatgaaagaaactttactaaagctcaaagcatacatttcaccacacacaataacagtaggagacttcaacaccctacttgcttcagtggacagatcattgaaacagaaacgaaacagagacacaatgaacctaacagaagttatgaaacaaatggatttaacagatatctataaaacagtttatcctaaaacaaaagcatataccatcttctcagcacctcatggcaccttctccaaaagtgaccatataattggtcacaaaacaggcctcaacagatacacgaagattgaaataatcccatgcatcctatcagatcacgatggactaaggccggtcttcaatgacaatctaaacaatagagtgtccacatacttgaacaacactctactcaatgataacttgatcagggaagaaagaaaaaaaagaaagagagaaagagagaaagaaagaaagaaagaaagaaagaaagaaagaaagaaagaaagaagaaagagagagagagagagagagagagagagagagagagaaagaaattaaagactttttagaatttaatgaaagtgaagccacaacatatccaaacttatgcaacacattgaaaacagtcctaagagggaaactcatagctctgagtgcctagagctatgtccaatacatatgaagaactcaagaagttagactccagagaaacaaataaccgtattttaaaaatgaatacagaactaaaaaaaagaattctcaactgagttatatcaaatgactgagaatcacccaaagggttgttcaacatccttagtcattagggaaatgcaaatcaaaacaaccctgagattccacctcacaccagtcagaatggctaagatcaggaacgcaggtgacagcatatgctggcaaggttgtggagaaagaggaacactcctccattgctggtgggattgcaagctggtacaaccactctggaaatcagtttcatggttcctcagaaaattggacatagcctgagaatccaggtgtaccactccaggccatatacccagaagatgctccaacatgtaataaagacacatgatccattatattcatagcagccttatttataatagccagaagctggaaagaacccagatgtccctcaacagaggaatggatacagaaaatgtggtacatttacacaatggagtactactcagctattaaaaacagtgaatttatgaaattcttaggcaaatggatggatctggaggatatcatcctgagtgaggtaacctaatcacaaaagaacacacatgatatgcactcattgataagtggatattagcccagaagcacagaatacccaagatacaattcacagaccacatgaagctcaagaagaaggaagaccaaagtgtggatacttctatccttcttagaagggagaacaaaatacccatggaaggagttacagacaaaaagttcagagctcagactgaaggaatgaccatccaaagactgccccactggtgatccatcttatatacaatcaccaatcccagacactactgtagatgccaaacaagtgcttgctgacaagagcctgatatagctgtctcttgagatgctctgccagtgcctgacaaatacagaagtggatgctcactgccatccattggactgagcacagggttcccaaagaaggagctacagaaagtacctaaggagctgaagcgctttgcagccctatagaaggaactacaatatgaactaaccagtatcccccagagctcccaaggactaaaccaccaaccaaagtgtacacaagatgggactcatggctccaactgtgtatgtagcagaggatggcctagtcagtcatcaatgggaggagaggcgcttggtcctgtgaaggttctatgcctcaatgtaggggaatacaggggcatgaagcagaagtggttgagtttttgagcagggggagaggggagggaacagggggttttcggaggggaaaccaggaaagggcataacatttgaaatgtagataaagaaaatatctaataaaaaaagagtgtcagtagtctaaataaatgtttgcacattacatgtctttttttctgtctatgttaaagtaagagaaatctattggtgttttattctttaaaacatgttagagactaaagaagcttcaggagacagtatggatagtgaaggaaaacatgaagattgtgatatccagatttaagaagtcaaaatagcacttcactactacttctacagtataatggaaaccacaagtaactctcctattcaaataagtaaaatgctaactaaaatacactatagatctaagagggaagttagaaattagtagatatggattttaaagtgacatctcaaaatcaatcatccaaactggtgtgtgtgtgtgtgtgtgtgtgtgtgtgtgtgtgtgtgtgtgtgtgtgtgagagagagagagagagagagagagagagagagagagagagagagaacccagaccatagtggacaggaaatgaatcacttagctaaaacctcatacttagagtacattttttttcataaggaacataaaagcagttacttcagagagctgctaatatatttctttgtggtagaacaatttcttatcatgctaaatgccaaacaccatgccaaggttcccttgccaacaactttaaaaacatgactcccatacaacaactcatcaaatacttggggtcttggtcagcacttcaagagcaaccttcatcctatacagaatctgtcttgcatttgtcttcaaaatacttttgaaatccattgcttactagtattgttactgctacatcatggttggaaccactgtcacctctaggccaggttagtgttccctgcttttatttgtgtcccttttattaatcaatttttagtatcacagcagtgaatgtgagtcattgagatcaaagtcatgtcttcgcactactcaaagccttccaaagccccaacttctcacttaagtacaaaaccaatgtctctccagtgtcctgagggacctttacttcacagattctctgactgatgttcttccttattcactttgttccagctaaggtaaataagtgtatgaggagagcttttcagcccttctcttcaggttatgttccatcttagaactaagtgtaaagtgcaagaaaagttcatatgtgcattttctcctagcttcaaatccgaaaagaaacagttatctggtattattagtgtctcataaatcttttctgaaaaaaatatctcataccattccacctatttctgcatggttttcaactacattggttgttacacaataaaatataatcagataagtacgggtaaataagcattatgtccacgcaaaaactgatgcaaacaatagagtagaaggaaaccttagtgaacttattgcaaatatataaaggaattgtaggttaccaatattcaatttgtttaataaatcaaatatgttagtaaaaactctagaaattggagaatttaagagggaaaaataaaatactttagtgcctgagagaatttacatgtttgtaaataattagttatatgggtattttatgcttttaaatattattttgccatgatgcattttccccggaaatattttaaaatatcagcaggagccaatgaatgtgggatgacttaagatttcaactggtggaaatcagggagttagggattaataaatccatgggcaactcctacagcaataatggaagagaaaaatgcacataataagttaagtgattttcaaaggatctagatcagcaggatgtattttagagttctttctgtattgtattgttgaatcaacctcgtcagtagctctacaaatggacatgcctattgaattgtcagacagtgttctccagttttaagtggaagagaaaaaagttttgaattccagatgtacattataaaggacatgtgagacacaattaagttatcaaattaaaaatgatttttcatcatgaaaggtttctagattacaaaatttaggtaatctactttttctctttcttcagaatgagcatgttaaatgggtagatgttggtggagcttatgtgggaccaacccagaacagaatcttacgcttgtctaaggagctaggcatagagacctataaagtgaatgtcaatgagcgtctagttcaatatgtcaaggtaagtctgacttttatatatatgatcaatacatgaagattttatttgagaaagcttttgtttatttgtgattattcttgtctttttttaaaatttatttttaaaaattatttcattgtgaatattcactttacatggtacaatgtatgttatataagtgtattattatcatataagcatatattggatgttaagcatattttttctcatagtcttatacctctttttattccccctcccattagccttctttattcttgtttagacagttttgtttctacttttataatgtcataaaatctaggaactgcaaataaggtaaaatataatatttctctttcttagattgtcttattttggctaatataattgtcttcagttgtttccaatttcctgcatatttttgacctatatagttaaaaaaaacgttcttgttaatgtatatcatgctttcttgtatgacacctaagttgattctataatgtagttattatgaataatgctgcagctattattaatatgtaagtatctctgtggtgctttgataaggagtcctttgggcaaatacccaggaatggtagatgtgggccacatggcaggtctaattttagttttttaagagacctccacactgatttccatagtagctagactatgatttccatagtagctagtttacattcttactgaagtggtatatatggattttcttttgcccatatttcccccaggatttgctgttatttgtttttaataatggccattctcactatagcatgatggaatcttaatgtagtttttatttctcatcttttgtgaacttatctgttaatgttattagtcagtttattgatcaagttcttttatttcttattgtttagggttttttgtatttttaaaaataaactacaaatattaattctctatcagatagacagctttttttctcactgaaaatattgttttcatgttcagtatattctgatcatggtttcttatcccttatctcctcccatatcctatctcctgatccattaggagaaacagggaaaacagatagattaaaaaaccaggatttaaaaaataatagaaaaaagcataagggactcacacacagacacacacacacacacacattcaccatgaaaatgcaaaagcttagaaactgaaatatacaagtaaaagatcattaaggtaaatctccaaacaaatcaacatgagacaaaaaaagaaaaaaaaatctacaaaaatactatttctggtcgtggggcctaaacttagtgtggcttgtagacctggttagattccaatggagcaaactaattcttttgaaagtatgtgctggttagaaatagcttcctagggatgagtacttatttaaacttctccaatctcagcagtctggccttagctggcttgaatctgtgcaggcccagcagaagcattttaatttcaccaggtttccctttgtcagttggtggcattatttcccgaataacaggaattctatttagaaaaatccctaaatatacctaaaccttgaagtgattctctacgttaatgtagcagttttcaaagtctcaggttttatatcctctcttagttacttttatattgctctgacaaaacaatgaccaaagtaagttatgaaagaaaatatttaattggggttatgatttcagagagttagtctttgatagtggaaaaaaatatagggtagcagttcacctgggagattacatccagaactgaaagcaggagagaaagaggtgggtgggagggagggagggacggagggagggagacacacacacacacacacacacacacacacacacacacacacacacaggaagagagagagagagagagagagagagagagagagagagagagagagagagagagagagagagagaaacacatgagaacactgggaatagttcaagtcttgaaatctccaaactcatccccagtgatgcatgtcctccaacaaagccaccactccaaatccttcccaaacacttctaccaactgggcatctagtattcgaacatatgagcctatgaggtcattgtccaaagtaaattctgagactccaggtaatagtttaattgttaccacttgtagaatcaaaaaggaaattacacacttctaaagtgcagtgccatagaatatatatttaccattctaaaagggatgaatcaggccatagcaaagaaatactggaccaaagaaatattaaaacccagcaggacaaactcaaaattgtgtagctccatgtctgatgtcaaagggctcagctagctctacctttcggccttgctgcagcaaagatagttttttcttgggatgtttccactccctgtgtgcaattctccttagtaaatatgtcataactctggcagctctaccattttggagttccaatactatccaggtttcacattcactgctctatgaagtggcttgttagatccttcctgctaggacacgcctgccccactccttgccttatcagctcttcttagccctggaggaagattccacaaccctattttacttgtattatccttcatgattctaaagccacagccatgaggacaacattgccaagtttgactactaacttgggttgaacccagcatcttagaattacatttgtagcagctgtgatttgtcattgattttaaggaacagaaatttccttaggccttttctttttataagttggaagcttagttggatgggctttcttctgagggcatcccttcctttatcctaatgcagatcaggccttgccttgatctcatcacctctttcagcaaaagccttggctccaaagtttcctagtgctctttttctcttcaaactatattttttgctccccttgttatttttcactgtagacttgcttaagagtgattactcataaccaggcagcagagtcaatattatgctgcattgaaatctctgtcaaagaaattagtatattaagtttcaatttagccttaagcaaatatttagcacaaaagcagaaagttattacatttttttgccaaaataccacaagaatggtttctagcctgtgtgctcatattgttctcctgaagtctcttaaggtaggctttcatggttcacataactttaagcactgttgtaggccacaatcctactagggtgacatattaagccctacttacagtttatggttctcataggctcatatatttgaatacttggtccaaagttggtgaaattatttgagacggaataggaggtatggccttattgaaaaaagtgtgtcactgaggtttctaaaaacttgtgccatctccagtatctctgcttcctacttctaatcaagatttgaactctcagttgttcttgccaccagcctttgatctgtcactatgcattctaaccttttgaaatggtaaaaccaacaaaatgctttcttttataagttgtcttagtcatggtgttttgtctagtagcaatagaaaagtaactatgatacctacagaaactctcccaggatttaccctactccccttcctaatacatttgcatcccacaggggatggagttgcttagacagacagatgaacaaagacaggcaagcaggtaaacacacacacacacacacacacacacacacacacacaaacacacacacagacactcgcccctatgcaatcttccatagtcccaagcaactcctgagtcatgtaagagccagttagttttaaaggccccaaagaacataatttgaggccacattagcttttaacttggtgcttctcctgcattctcaccaagcatgtctttgaataccttgttcctttgttttgtgtttggcttttccttttggaaaatatgctttggtggtgcatttcctagtgtttgaagaagaggttgtttaaattcagttccttagatctgcctaaggaacaatagcttttgccactgttattgtttctcacggaagccaaacatgtagtgactggaacctagaaaaatgcttgagaaattaactttccaatctgttattgtaggccatttcctgacttatgtgggaggggctcatttacatatacaaaacgacaggatttccacaccagtcaccacacctctttgcaaaagacacatctcccctaactgcatacagggggccaaagcattaggagtttcctaggacacttgggatttgttcacagtgatgttcaaccaataagtcaggaatcttaggaaacctgataaacatgtaacttgagatgcctaggggtgcatgacaataacacatttgagaaaataaacaagtagcctttggaaatattgagtacctgtggattaagagaagatcaagaaatattaagaggttttacaaaatcgtgacagctgaaggtatatctcaggggcagagcatttgcatagtatgtatgagattcaatcaccaacatcattaaaattatacaaaatattttaaaatattggctttattaggctatagttaaaagagttttctattttctcatttttgcaaagcatgatattttcctaataacagtaagaataacagcagctaccattatggaaattttttacattttcatatctaatgtgaagaaggaatccaaatcctttatgcttaactatttaaacagccatgcactttaattggtaactgtgaaaattaacctgaaagctaacttagcagacttagccatagtatttctttctttcaatgagtcaagtgctgaataacctttattgttcctagaggctaataagaaaggactaagttcttttgtgtatgaactcattatattcttacatctgctccactaggttgtcctgatttcccccattctacagaagaaaaaaaaaaaaaacaacaactaagattcagtgaggtagagtgatttgacaatactgtaagagtaataacagtctattaatccctgaaagcatgttctttattacttcactatatattctagaaaatgaaactgagtcagtgattagaaaagcaacaggcctttgatatttgtaagatatcgtaccatcatttttttagtgaagactagctgatcaataagcaaataccaactgtatctgttagtgaaagaccatttttttcacttcctgattgtcagtttcacaatacttttgtatagtttaaatattgataatttgcagttatgtactcagctaaggactttctagtttcatagttatgcccactgtaagattttaacagaggcatgtggtaattcaatgtcccgtcccccccccccccccccccccgccgtctctctggaccttattgattcagctatactgagtggccagtaggactcagggatctgcctgtctgtcctcccaatgctgacatttagatagtaagggaaacattggatattaaatgcttattggagtgattaattactcatatttgtaaataagatgatccactattacatttgtttttttgggtttttgtttgtttgtttgtttcgtttgttgagacagggttttctgtatagtcctggatgaatgagttccatttaattgtggaagccttttattaaattttgcggtgtatagtaaaggatgtggtgagggaacacccagataggatcaacacaaacattttcaggacaaactttgatacagaattgacatatgcattctcaatttctccctacttttcacatcctctctaaataaaactagagtcagaaatatgcggcaaatatttacttttaaagagtggtgtaataaagctttatttgaaacttcagaagctttcctgatagtaacagcctggtaaacatttttccctagtgctggattttctattctgcttatggctatttactccaggtttctgaactcaaacgcttttcagaatgtgtgtgttctagaatactaagtacatgctttgctaagagatgagatttgtttcagccaaaatgtcttgtagaagacaaaagcttttatgttactttgtctcaatgcttactaatatgaccttgcttttgacccttggtttacaagtgtttcttttgaataaggggcatttaattttaagattatttagcatcttttatataggaatgtatagtacatatttcttttgtttgaagagaacgttggattttcactttcaacccctttcagacagaaacaacaaaaaaaaaaaaccccaaaaaactaaaggaatgttgtttatcccttttacttatctaaatgtatcctttgtgagtctgtgatactattattccctttcaaatgcagtgtgcttatagatgctttaactcatttggatttctcatttataaatagatttttttgaaacaggctaaaatatttaaatattattagtttgatctatcaaatatagaatataaatatatatgtaggaagctcctgtaaatagtcctgagtaatacacacacacacacacacacacacacacacacacacattttcaaaatccttaatttgttgcttatgggttggcagaaattgagatgacagaattatgtttaaagctttacacaaggctaagattaggggtagctcaagggtagatctgggttttctcgccacgatgaaaacaaagggcactatcaatttctcatagaggctccgttctatgtactatatatttagaataccattaaaaattggtttctacaatataaatactctactcagtcaaagtggcagcctataaaatatcaaagcaagcttaggagatttttctatcattccttaccattttaggtgtacagttcagtaacattaagtgcattcacaccattgcacaaccatcaccaataactttgtatataatccccctttttcatggtaattacaatgaaacacagggccttgtgttaaccactgacctacttcttttgtcacacagaacccctttggtctttgcattcctctttaatcctgattcccttctcttctatcccttctactatggtttgtctgcctgactgtctgtctgtctgtccgtctgcctgcctatctatctatctatctatctatctatctatctatctatctatctatccatccatccatccatccatccatccatccatccatctatctatctatctatctatctatctatctatctatctaattgaagacaaattctcactatcttgcctcaacctccaaagtattgggattagagagaatcagtggcattcctggctttttcattcagttttaatcaataataattcactatagaaattatatctagccattcactgaaaattattagaattgctctgtcttcttggagtggttagatataaatgatttctcttccattctgtttgtggatctgcaatcaccttggcagttgtagtattggtatttggattaatagaataactttctgaatggaatggaatgttgaataagcagctttctccagagaaattgaaaatctaatttctgtagatccatactgctgaggttgaaattctgttactcgtctgagattcaaatttcttagagaaagctgactctccttccctcaacagcttgtcaagtgcgaataattccttacctaagtgtgggacttcatgtccaactttctgtgtagcccctgataaatcaacagtgctccagtggaaggtcacacatccaagaatatttgagcagaataacttagttttaatgggtctggctttatttttaaaatggacaaaatgttggatgggaagtgtatggaggtgggtgtgagaagagttggtcaaatatgatcaagacatgtttgaacttcttaaagaactcataaaaatatagttagaaaagaaaagtaaaaaaaaaaaagaaaggaaggaagaaaaaatgctttccttttccttgctttctgcttctttcctgtgtccttcgctgtaacccctaccctcatcctacaagacacacacaaacagcaatcaaaaggctcaatgtttgatcctaacttttcaagctcttgcccagttgcattgtaactattgatacctgaaaaatacttcaatgtcctatgagtctcattcttattccattctggccacttcctgaagaagaaaacttcagctgtcccatgaatgaatacatgttggtttcaccagaaagtgatttctgtcattccccagtactctgacaagattgctgttacaatgtaattctctgtctcaggtatcgacttttcacctctaggtcaaatttaaaaaagaataattttgggaagcttagtctcagcattctagtgactaattctactgagataagaaaacagttttaagaatgatgttggttcagggtcttatggaaataacacaaaaagacagttgtgaagcctcattaataactatccttgcaaaatagaatttgaaataaggacacaaataataataataatgccaaaacctgatgtttgagtagttcagcactatttctataaaactgctttttatttttttgttttgcatttgagtttcatgaaatcagaggaaaatcctcaatcgaaccatacaaatattctcaaatattaactaccactcgggataatgcatagctttgccttgaaggctatgaaaataagtattttttattcaataagattgttctcgtcttaacactttcaaacaaaggggttaattactaaactcttccattccatttcattcccgtatctttcctgtaactcacaggcctcacatgtgactcacaagctgagatttaattttgtgtgtttgtcaaagtgctctgtggcctagtttccatagctatatccaggaggtaaatgtctaaaaaataatcatacttcagagacaataggagagaatcaattttgtaaaactttctgactagtgtgataaaagcagacactggagcacagaaatgagagtagttgctaattgattatttgggtacttactgatggaatagtcctaaacacctgtggcagtttaaaaacatacttctctgatgtccaaatactaggaagattgtacttatactccaagcataatcttcatatgttacaccatcattgcctccatcatcatgatactagaataaccagtgaattaacttcttccagttcaggggcaaactttcatctgccctatcacttgaacatataacattgacatattcagttgtctagctaaaaattctattccacctttgtttttgtttttgtttgtttgtttgtttgtttgttttaccttctatgacataatttcttacttggttgtcttgtgacaaatagataagtactcatggcagagattctgtacagagtccactagatatggaaaccatttcagtttatttcaattgtcctactcagtgtaatgggacaattacactgtccagaagggttaaatgtaatgtcttcttacaggttataggtagaagctaaattgttctggctatcattgctattctttcatctcatgttttctcatactatctcagtctcctgccagcggtagccagaatgtgaaaaaaataacatctagggaaatattttctgagtgtttgctgtctgaagaacatcagtctaaaaaaatatactgtagaaatttagtagtcagatacattttggaagtactccatattctaaactcatattagacagtcaagattctcattagcaaattagaaatctgagtcaggcagtaaaaaagtttacttcactataagctaagaattcccaaatttatgaccctagagcccattttcatatagcatttggaaagattagtgtgagaaatgctaatgtatgaaaagattttagagaattacattcccaaagggactaagtctttctccttttaagttctagtcaatatgatagtaatgttgggtaaattttgtatgtagatctgatactaaaagccagtgctgagttaacatttcataggtttttattttgggagcggtgggtggtacagaaagaggaactcatttgtgttgaaaatgaccagacattttctgggaaaagtagatgtgatacaaactaggctgtaaaaagcagtcacttcatttccccctttgtacctttatttaacaaacatttattggaattctgctagtcacaagacagtgtaagtatagcattataaacatttgaagcattgttttctttggtgcattgagaataatcttgaaagttagtccatataaaaatcagtgagcctggccaaggtcagcggcaatgttcttgtcattcatcagagaatcacaaggagtttatgactcacaaggagtttatgacctaggtacctaggtgggattattgagaccacatatttccagatcattgtttgctcagaactatatcttccaggtctaggagtgaccctggtaagtttttaaaggaggatccagatcagtgactttgcaggacagatttgccaactcttagtaacatggagagtgatggaatggtaggtggcatgaggcaacctgaactaagagcatagagacgtgaactccattctatctgttaggcactaatagggtttaaacacaatgtatatacacatacacacatacacatgcctctctacaagtatggtaaaattactatagtataaacgattgaatatcttcaaagatatatataacttataaaatcatccaaagctacccaaattttattaccttatggtgcatcttacatatgatgatatagtattatctgggggtagtgaaagcaagagaattataagtaactcagaacagcttatgatattcacagcttataatatctttattcagcatagtttctcatttcaatattttagatcagataattatttatcatagagggctgttcttttaattataggatgtgtaacatcatcccgtgcccagttgtaacaattgtaacaatcaagactatctaccaacattaacaaatatacctagggaacaaaaatctcccttggttgaggacccttatgtagtctaatagtattgatcattttaggttaatgaagtctaatttttttaaaactctaaatagccaaataaaatgctgttaaaatggctaacctatgtatcctctaatgtctcaagtacttaaacataagggactcaattataagcttctatgggacttggtataaggtcgatagaatcgccctcaaatgctcaaaagatccaagtgattacaatatgacactttattgggcctggtatatagaacctgaagactgtgttatggaaagaccctggttcatattaaaccactcaagtagtggtttaggagacaagtctttaagataaggattaaaaatcaataatcccacaaatgaaggatgatagaatctcaacaactacatacaggttgatagaatagcaacagccaggaggagggttctgagagaaatgaaatgacttgttagtttcattttagtgctgtttaagatagttttaagccatggaaagaacagttctctttggattttagaagtaacataaccatactatttgctcattaattccacaaagctgtgcttttcagggcagggacatagttaagtattagagaacttgtttagaatgtgcaagactggtgtgaggtgaccacagggtatcccatatcagggtccttttgattaacatttccctgatgactaaggttgtttgcagccccatggggggagcaacattgtcaacaggccagaccccctggagctcctggggactggaccaccaaccaaagagtacatgtggagggacccgtggttccagccacatatgtgtcagaggatggccttgttggacatcagtgggagcagtggcccttgggcttgagggggttcgatgccccagtgtaggggaatgccagggctggaaggcgggtaagtagatgggggagcatgctcataaaggcaggggtggggggatgggatagaggatttccagaggggagacctggaaaggggataacatttgaaatgtaaataaagaaaatatacaataaaagaaaaaaaaaagaatgtgcaagactctgcattgaatctatagtatgcataggtaggtctgtaggtatgtatgttggtaggtagtaggtagatagttagatagatagatagatagatagatagatagatagatagatagatagatagaaagatagatagataggatcattgaatgaagtttagaataataattatcaaattgttctacagagttgcaatctttagtataagctctcattgtcatttctcttctgaaccatcagacctaatgatttggaagtgtcatggcagacagagatgataacctctacgtaaataatttgagcataagtctcttaagatttaaattttttaacctttgaaacagtcttttatagcccaggctctttttgaacttatgatcttttatgaagattattttagccaagagtttgatgttacgctgggtaatatagagagagcatctttcaacccccttttcagagtcaccaaagtgagtatggatatggtagcacacacatataatactgactcttaggaggtagagacaggagaattgtgaatttgaggctagtctgtactacattaacaagactttatctaaaaaaataacaaaactccacactctctaaaacagttattatcaaaaagacaaaagtattgcatacggacaaaaggcatcagaaccctcatacattgctaggaaaaacctgaaaaatagtgcagccacttttggaaaatagtttagcaattcttcaaaatacagtgggggagaatagagaatgactatcaatgagtcagagtttcttcacagggttgaaaaaatgttataaatttggatatactcatggttacacacttacaataccaaaatccactgtattgtaactttaaaaggatagattatgaggtgtgtgaatgataggtcaatatgcctattaaacagctgtatatcatcccaatatttccatctttcaactacccttttctcctaaattaatggcatttaaagtgaaagaggaaaatacttttaaaagactgtcctgccagtgatctttagttatgcaagagactacaggggaaaaaaattctaaacttaatattctttctatcttaattcctggggaaagatcacctaaacatttatttaagcctcttcagtcttgttgtaagagcatcatttataccttagtgtgaatcttctttttctacagtctgagatactcatcttaggtatcaactgtgttaactggttgttgtgcaaatcttgaaatgggggcataatatgataaggactagttcatgagcaaaatgcagaatctatgagatgcagaccacagtttcatactcatgaacagagagaacagagacaaaaatgtaaactatagcactgtataaatataacaacaaaattaaatggtagaaaagttgcctagggaaatagaaaatgtttggttgaggaaaaaagaaaaggttgaggatggaacctttgaaggctcagtggatcaaagaatggggagaaaatgtttggcaagtaggtggatatttgggaaaaccaacacagttcactggggtgcatcagatgcagcaaaatgctaatggtatagacaaattcatacgggttggaaaagcatgttcccaagccaatccaaaagctatttgttttctagatgattaaagaaaggttttgttttgttttttggtggcctctcagttacttaaaatactatgattgtcctcacttccttttggttaactaaagtatgaaggtataaataagaaaactttttccatgtgccagtcagtaagtgctacttgcttagtataaatttagctcatcttgcagtttaggggagccataaactatcatgtcctgttaataacatcctattattatgaacactgagagattaaagatgtgatttctcaaatggacttaaatatttgggagtatgattctagaaacactgtgctctactcaacacaagtaatttctgctatgccagtccttcagagattaagactattttggaaaatagtacggttttagaatataggtagaaaatgaacagttgttactctggatttttttatttccttttatttttaaaaagtaatagttatttggaagtactgttttagagacccttgaggtcacgaaggtcttttcttttcatttcatttcttttcttttctttattagatagtttcattatttatatttcaaatgctatcctgaaagtcccctaaaccctcccccactctactccccaacccacccactcccacttcttggccctggcattcccctgtactagggcatataaagtttgcaagacctaagagcctcccttcccaatgatggctgactaggccatcttgtgctacatatgcaactagagacacaagctctgtctgagggtactggttagttcatattgttgttccacctatagggtggcagaccccttcagctcctttggtcctttctctagcttctccattgggggccctgtgttccatcctatagatgactgtgagcatccacttctgtatttgccaggcactggcctagcctcacacgagacagctatatcagggagggttctttcggcaaaatcttgctggcatatgcaatagtgtctgggtttggtggctggttatgggatggatctccaggtggggtagtctctggatggtctatcgtttcatctcagctctaaaatttgtttctgtaactccttccatgggtattttttccccctattctaaggaggaatgaagtatccacatgttggttttccttcttcttgattttcttgtgttttgcaaattgtatcttgggtattctaagtttctgggctatatccacttatcagtgagtgcatatcaagtgacttcttttgtgattgggttacctcactcaggatgatatcttccagataaatccatttgcccaagaatttcataaattcattctttttaatagctgagtagtactccattgtgtaaatgtaccacattttctgtatccattcctctgttgagggacatctggcttttttacagcatctggctattataaataaggctgctatgaacatagtggagcatgtgaaggtgttttcttgatgagagtttgttttacattgagaaactgctgagaaactatggagtctactctcaggcttgtttccctcagccaagagccaatctgaggccttttaatgaatattattttagagattcacacatgtcaaagtagtctccagttttgaaatctagaagtgtgaaaaagaagaaagttgttgccagttccttgtagcatatatatgcttttatagaagatttatgttttctggaaaatggagacagaaaagccagagactgataaagatgaaactaaccaattatttacctacttcgtgcctttgtcatcatgctaaaagtttacatcttttagactatctatagcttccattattaatgagattgctagggtattctcctctcaccctgtcctttaaccttttctggatctttgtgtctttgtgaagccttagattgaggggatctataagtattgctttgtaaggagattttcatcagcaatatgacacatataatactttaatgattaataagaatattttaaaattacttttctttgccaggtgtggtgttccatacttttaatcccagcacttgggaagccaagataggtgaataactagctgttagttcaaggccagcctcatcaacatttcaagttccatgccagccaaggctacatagagagaccctatctcaaaaacatttcttttcaaagcaaaggtcaatttttggatatgactattcattattctttgagtacagattcactttatagagagaatatagattcttttgagttttcaaattagagaagaaccagctgttccaagggcttcacagcctctctcctctccagaattttttttttcttgtgtaaaatgtttgtccatttctttcagaaaatgtgtttgcctttcccaaagatgaccatgtttctttgataatcatacccctgtacatttttctttgtaattttaatattagaaaaaggacagatacatggagggtatttgtaagattatatgtgagaattctctttattttattgtggaactttaaaatgcatctataacaaacctgtcttcacattccatcaacagtatatgaataaggaaatacattttatgaagaaaggcttccgaggagaaaattatactgtttcccagctattttcactaggctttagtttccttatttataaaatggaaatattagtagttcttgcctccacagagctgatgggaacattacatgagataacgtatatgaagagtttcagccactgccaggcatggagaaagcttaatgaatgtttgatgatggtcatgacagtgataaaggattttgagtctcaaaaagttggattgtagcatttcatcatagtgttttgtgataagaaatcagatcacataatcaaccaaggatatttgaatttgctagtggaaaggaaattcacttcttttcatttaatggatgccaggtattcttattcaggtgtcagggtgggaagactttacgtatactgtcacacctcgtgcctctgccttgataggattattttccttgtacctttttgaaagcctggcacacatttagtattgtgcagtgcatgaagttgactttctacagaatttattaatcaaaacatcaaactttcatgagaaattgtattagcagaaaagatttaggctttataaatattgagaatttatttatttttaactataattgtcccttggtatttataaaggattggtttcagaacttcctgtgaaaatcaagatctgggaatacttaagtgaagtgttattttcatataccttattcatattctcctgtgtgctttaaataatatatagattgcttataatatctggcatatgtaaatgctatctaaataactgctataattttttattgagggaataataacaataaagacatctctacatgctaagtatagcttttttaaaaatactttttatctgtagttggttggatctgcagattgagaacctgaggaaccactaaaggattcaaatttgtagattgtgccttataatcgacctaatctttcttgtttttctaagagtccaccatctatttacccttgttttgcttagcatagtatgtgttacacaacgaagtgaaataaatgatttctaaatatcaagctatcttggcattacacgctttagtactaagccgaaaaaaacaacttgagctaataaagagagtttatgaggctgaaacttcacacttcaaaatctacacaaagcagaactctaacaaattagggaaaggattcatggtctttataacaggaaacatctgtttggcatgttgccttggggaagagaatccacattccattctcttgtgtacttggtttatcatgaactacagggtcaaatcttccaagagtatatgattagccaaggtcagatcaaaaactcatagctgggctagatcaggagttgggcagaagaaactaagccttcctacctattttaatggcatctgggaccatggtccttacataataataattacacaggggagtgtcagttttgcaaatggaaatcagggtacatgtagaaaataaaaatggatgttaaacatttaaactggtaaatgcctattgttccacactgcagaagtctgattctttacactaaacataatagtctttgcagtgttcgtttaatctgtgtaaacctttaaagcttgatctgagacctgcattgtgtgtatccaaagatggtcttccatttagtcactcatatatgatcaccattccaggaagatttaataagaatgttatggtttcagcatttacactaaaatgagttttatctttatttacttatttgttcaagtacgtaaaaaatgagtcaaaaatctataatttcctataaactaaaacagctaacacaacattggggaaaattttagtgtttttgttaaaattaggcttgtttaagtgaaatatatttaatttccttcaatgggaatgtttttggtatggtagaagatccatttgcttttaaaatggtttaggtgggagttggaagatggctcagcagatacagtgttttctgtgcaagcatgatgatctaagaacagagccccagtgctcttgtaaaaagccatccacagttagtatgtgactgtgatttcgggctaggagtgcaaaagcagacagatcctagagccagtctggtcaaactagtgatcttcacattcagtaacagaacctgtctcaagaaaataaggtggagagcatcacagaggatagctaaagttcacctgacctccatgtatgtccacacaggcaattctgcctgtgcatatttgtggctacacaaaccataacttatgtctctttcctccttccctccctccatccctcctctctcccccttttctctgtctctgtctctctcactctcacacacatatacatacaaagaaatggtttatattaattggtttaaattttttttatttacttatttttttgtagtgttagggagtggaacacaggcctggcatatgctaaataaacactctaccattgacacctcagcactcttctccctcattttttaaattaatttaattaattactttacatctcaaattgagcttctcctctccccgcccagtccctgcctctctcctcccctctcgcacagcctccagttctcactttcttcctcagagaagaaaagggcaggcctcccatggatataaatctgccctggcatatcaagtttcaataggactaggtgcaacttctcctagtgtgggttagacaaggcagcccagttaggagaaaggaatccaaagacaggcatcagagtcggagactgctcgtgctcctgctgttaggagtcccatctgaagaccaaggtgcacaactggtatatatgtacagaggggcctaaatatgccccttgtatgctttctggttgacagttcagtctctgtgggcccctacggttccaggttagttgattctgtaggtttccttcttacttttaagacagaatctcactaagttgctcaggctgtctttgcacttggaatcttcctgcctcagtttcccgagttcatgggattacagacctgcctcacagcctggttcttgtagttttagaatgccatgtaacttaagtattatccatttcaaatagattccctttactttattccaggggaaaacttacccattccgtggtgcatttccacctgtgtggaaccccttggcatatttggattacaacaacctgtggaggacaatggatgatatgggaaaagaggtaaaatgtgggtttggtttgcacatagcatattgctgaagaatgaaactaattaatatcctttcaaggtacaagggacattgctgatttgcactgatgcatgctctttccaatatatgcagcaactctgcaacagccaggatttccacttgacagatggagacaatgaaataccaagtgtttatataatttactcaaaaccatgcagcaagggtactagaattcaaaaccactctttcttatactactgcatgtgtgccttcttctgtatacctctgagtgtgtctgtgtgtctgtctgtctgtgtgtgtgtgtgtatgtgtgtgtgtatatatatatatatgacacatttctgccaaatatctatttacagttatgtatctacaatgccactttaaatagtaaaggaaggaaggactttctgcttcagagtttatttattctcaggctctatagcattactctcaaattttagttgggagcctaaattgactgtgatcttacaataataatatcgatattgataatgatcatcaccatcccaattacaaataaatttatacgtgttgtaattatgatcactattactactgttgttgacaataaatagcattaaggtgtgaactccagattcatctcacctctctatagacttataagccaattacagagaccaagaaacaagtttttaaaggttcacataaaggcttccctgaaaagagaggtagagcagtggttattgttctcttcactcatgagtgtttcattgcagatccctgttgatgcaccatggcaagcaagacatgctgaggaatgggacaagataaccatgaaagatctcattgataaaatctgttggacaaagtatatctgactacttacaatcttatttttaaaatcttcccctctaatcctttgtaaactgtcttgagtagtagtgctgtttttagtgacttacaaggaaagttaagaaatataataatctttttagttatagcagatttgagcaaaaaatgaataaaaacttaagaaagtatgtgcatagagtagatcacctttggacaaaagggtcattgaggttgcctgcaaaggcagtttgtaaacatattttttttaaattaatcccataggctagagagatgactcaggggttaagagtagttatcaagaggtcgtgagttcagatcctagtccccacattagagagcttacaaatccctataactctagcaccaggggaatctgaccctctgtttggtttgcaaggactcccaacaaatgtggcatgtgtacatgccccttccccatattaaaaattaaagaaaacagattaaaaaataatttccatatagatgtagatatgaaactaatctgggtgaatgaaaatataaaccatataatgattttaattaaaatttattattagcactgtaacttacagtttaatactatagtcatgactcaatgatatggatactttttaagaattatagtattagtcaatttcattgataaatattccagagtatatatgaactaagatgactaatatggtatggaactactaaatatatatatatatatatatatatatatatatatatatatatatatatatatatatatcggtcacagcaaaaatactatatggtacctgcttatatttatttttcctgtatttgaatcaacacatataatacttacatacttgttagcatatatgtattctaggcatactatatgaagacactgatactggctaaggaatagtggtgaatttattagtatttagcttcttccctcatgtagtctatattcttctagcaggcaagatgaacactgaacacataattacatagtactagcagagtacctaacaaagggaatcttagttgatctaaaaatagaaaaatcattccctggtacagcttatgttaagcttggtagctagactaaccatattggcaagtttcagattcaattgagagatactgcctcaataaatgaagtagagagaaatcaacgaaactacttgtgtttgacctttgccccttgttcacacacatgtcaaaacatgtatatgtacatacaccacacacttacatgccaaaacaacaacaaacagaatgtataatagtgctgaagggggaaggacgggactataagagtgatgggagaacatattctaggtggccaaaggggtgagatggtatcttctatgtataggccaaggttggggtaagctaacatagtaatagaaatatctttcagtaataagttatagcattatttgagagtcaggaaaagatagatagcattagatgctaacttccaggataattcagagggccaagggtagagagacaaacatagataaattagggacatggcatttcctatgaatgagccaagaaacatgataccttataagaattaccaaagaagcatgaggaaagaggatgtttgaacgaattgttctggaacagcatctttcaggaattgcatattgttagaaaaggagagagtaaaatggagatgtagttgggatgttaggaaatacttagaagaggggagaagataatgttaaggaattatgcttctatgaataaccaagttagatgtggaaaggttcagacctatgagtggtgtaagggaataggaatcttctaagcggagaaaataaggagtaacttttagaaatggcttgagaagggaagaaaattggcacacttgaacaagtgagtgatcagtttggtggatgcatagagcaagtagtgtgtggggtagttgaagtcataggttaagcagcctgtggtacatctataatattgtctatattcaatgtttgagatgttgctctattttagaccattgaagaatttttaaatgttgttttaaaacttttttttgtttttagttttgttttggttatttttgattcagtgaaacagtgtttcattgtgcggaccagcatagtctttaacttgctatcctctttcttttgcctactacatgctgaaattccaggccttattaccatgctcagcttaaccactgaagtgttgttaaagtactcattatgtttagcatggcagagaatattaaaggtgatgtagggtgataatacaaggaggtcaccactttctctgtgtaagatattgtacagtagcatggaccagagtggagtcagaagagatgggaatgtgaggaaagtctttaaaataggttagaagtatgcctagttagtgtagttaggtagtatcaaagatattgaatctttagatagactattttggagctaaaccatacttcttaataacagaagaaaactttttttttctcaaaagttaacaaatgctttcctatggatgctgagaccatgaggttttgattgtcttgtcttgtcttgttttgtttgccaaaatagcagaaatagtttctacttgtactatattacactttgtaatggtgcattcctctgacttctgtatatattttcaattatgttgttattgatgtgtatgtggctggttcatagcatgtatgtgccatgtatgaaggtcagtggataactctcaggagttggttatctgcttctttctacatgtattgacatgtgattttcactcttattctgtgaacagaactgctcgagaatttgcttatctttttgtgaacattaatgtgacttctgagcctcatgaggtatctgccctgtggttcttgtggtatgtgaggcagtgtggaggtacctctcggatattctcagtcaccaatggcggccaggtatacattgtctgttctgaaactaacttgcccagaaccatccttgctaattccttcgttgtttctaatcatttatggtagtataaaatgacctaaaaatatgtctgaattttttctcattttttctatattcctgtaaagttcattgctaaagaatattgcatttgaattaattatatcttaagaattaagttccttcccttaaaatgtaggaaaatgaagctatttatatcaaagtagctaaactactaaaaataagttaatttccaagaaaattatagtgcttataaaattagtatacttaaaattatcttggttctttaccacttgtttctcacaggtattctttcatgttaactaatgtaaaatagaaattactcttctaattcacacaagtaatttgtgtccactttttgaatagtaagttgtgtagtttggattttataatttagcttacttgcattttttttttgcttatatacacttctattaccaatgagtaagcatatttaactcattgactaaatatttaataaattaacagcaaagccaaaatattaaattcccaattccttagatcctaacattcattgcaaagatgtatctcccttattcaaagaaaatgtgccttatttaggaatgttatgcatgagtgagatgaggttaattaattaattgcagtttaactttagtttatgctgtgctacttgagtcccagaattttgagtacattttatgaatttagactttgtcttcaaagtaaattattgttctttggagatcaccagaagtctccaagttgttcttgcgatgtgtagagttattgctcattggacccttggtttttacaaatataggacttttgcattttaaaaatgtgtacttatgaacagagactcagtattatttctttaattcatatcttcctttctgaagtatcctactaataggttatttgtatctttcatttggagggggacaaaatacttctaaataaaccctatatgaccttttagaaagtagagttcagattttgcactcaagctattatcacaatatctttcaaaagacattaacttttatccttttataatttaattttaaatacacagaaaagtagatagtgaacaaataaaactagtccaccttttctgtttgtttagtatactagagttcaaggcacctatttggaaacatagtaagattctgtattaaatgattccagtttcttcagaaaggatgcatcataaatttaagtctgaaccactctgtgatcattttcataaagaacttcagtggtttcactaaacaccagttttaaaagttgctgcttgtctactcataaatgggatattgcaattgccagttgtggtctgtccctgctttactgacatacatttctaatcactcaaagaatcgtctgcaatgggctaaaagtatttccttggttgtaaccaaatatgctgtattaagcacttttctcttagattattcttaaacaatatctatgctgagaaatagcatattacagagggctgaacacttctgatccatagtgatgctcaagagaaatacttgacaatgttttaaggaataaacagatacttagctatcaatattctgccttgaaaatgaaatttgcagttagttttgagaagaatatattcaaaagcttaaattcagtttcataggacctgatttggctatttttgatagtgtattgctaaccctaatagcaccctgaacctgttctcttagactcacattatctataatataatattttctatatccttacctgctccgatatgtaactccatagggagttagaaaccacagcccctaggatcaactatatagttgtttcaccttcccagagctccttgtatacaccatactcatagacatttgaagttctcagacttgctatttgcatgtggtcagggcaccaccggcatagagaacatttacttctggtctctgattttatatgctagtaatggcttttccttgctagaacatgtgctgagaataattgaggtaccttggttctgtcctaatgattcttccctcaattggatatgtcaaggatagaggcctggtattgacattcttggagattactaattggtggcaaatgttccaccactctccttttataacttgtcttttatgcctactttctctaataggaacggaaatttgtaggtggctctggccaaataagtgaacagataatggtcctccttggggataaagtgaagctgagctctcctgttacttatattgaccaaacagatgacaacatcattatagaaacactgaatcatgagcactatgaggtaatctattatagacaaaagagtttatggtaaatgggttttatgccatttgtactttctaattgtatgtaatctaatctgtagtttaattagatatagcatatatctactttaagttttccagattgacagacttggtttacttactgtcctagtttgcttctctgttgctgtgataaacaccatgtccaaaagcgagttcaggaagtaagggtttatttggcttacaggtcctgatcacagtctatcactgagggaagtcattgcaagaattcaaacaggagcagaggcaggaagcatacaggagttcagctaattgacctgctcccagtttgctttcttttattactcaggaccacctacacaaaggtggcaccatccacaatgggctggatagtcccatatcaatcattaattatgaaaatgctggggatggagagatggttcagtgattaagagcactgactgctcttctgaaggtcctgagttcaaatcccagcaaccacatgttgtctcacaaccatccgtaatgagatctgacgcgctcttctggtgcatctgaagacacctacagtggaattagatagaataataaataaatcttaaaaaaaaaaagaaaatgctacacatgccagtctaatggaggcaatccctcagttgcagctccccatttccaagctaactctaactatgtcaagttgacaaaactaaccagcccatctaccttgttctattttgttgcttcacagtggattgatttcggtattttttctccttaaatgatgcttcataacttctgcaaaggctatatacctcatgtttcaggtaatattttgcatattatatttcagtgcaaatatgtaattagtgccatcccaccggttttgactgccaagatccactttaaaccagagcttccacctgagagaaaccaattaattcagcgtcttccaatgggggctgtcatcaagtgcatggtgtattacaaggaagccttctggaagaaaaagggtaggttgctcgtatttgtgtttaaactattaagtacaaaaccacattttgtggatattgaatagaatatgctgaatacaaaaagataaatgtattcaaatttgtagagaagttattaatctgtctctacaatttcacaaaatggcctcaagagagattgacaatgggaggaatagatgcaagcaagcggtgggtatatcagctatagggccactgtcattcgtcttcctacttattcttcagaagcagaatgagaccaaggggcccagaaactggggccctgaagtaagctgtttctgaacttcatcagcttatatttttttttattttctttcttttttttttcctttttttttccattttttattaggtatttagctcatttacatttccaatgctataccaaaagtcccccatacccacgacccccactcccctacccacccactccccctttttggccctggcgttcccctgtactggggcatataaagtttgcgtgtccaatgggcctctctttccagtgatggacaactaggccatcttttgatacatatgcagctagagtcaagagctccggggtactggttagttcataatgttgtttcacctatagggttgcagatccctttagctccttgggtactttctctagctcctccattgggagccctgtgatccatccattcgctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtctttgtaactccttccatgggtgttttgttcccaattctaaggaggggcatagtgtccacatttcagtcttcattcttcttgagtttcatgtgtttagcaaattgtatcttatatcttgggtatcctaggtttggggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccagaagaggtattgctggatcctccggtagtactatgtccaattttatgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaggtgcttctctgccatttggtattccgcaggtgagaattctttgttcagttctgagccccattttttaatggggttatttgattttctgaagtccaccttcttgagttctttatatatgttggatattagtcccctatctgatttaggataggtaaatatcctttcccaatctgttggaggtctttttgtcttattgacggtgtcttttgccttgcagaaactttggagtttcattaggtcccatttgtcaattctcaatcttacagcacaagccattgctgttctgttcaggaagttttcccctgtgcccatatcttcaaggcttttccccactttctcctctataagtttcagtgtctctggttttatgtgaagttccttgatccacttagatttgaccttagtacaaggagataagtatggatcgcttcgcattcttctacacgataacaaacagttgtgccagcaccaattgttgaaaatgctgtcttttttccactggatggttttagctcccttgtctaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccaccagaggttcttttatccttgagaagactttttgctatcctaggttttttgttattccagatgaatttgcaaattgctccttctaattcgttgaagaattgagttggaactttgatggggattgcattgattctgtagattgcttttggcaagatagccatttttacaatgttgatcctgccaatccatgagcatgggagatctttccatcttctgagatcttctttaatttctttcttcagggacttgaagtttttatcatacagatctttcacttccttagttagagtcatgccaagatattttatattatttgtgactattgagaagggtgttgtttccctaatttctttctcagcctgtttattctttgtatagagaaaggccattgacttgtttgagtttattttatatccagctacttcactgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatattggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttttataatggattacattgatggattttcgtatattaaaccatccctgcatccctggaataaaacctacttggtcaggatggatgattgctttaatctgtttttggattcggttagcgagaattttattgaggatttttgcatcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccatctggtcctgggctttttttggctgggagactgttaataactgcttctatttctttaggtgatatgggactgttgagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttccttttttttctagagcttttagatgtgttgtcaagctgctagtatgtgctctctcccgtttcttcttggaggcactcagagctatgagtttccctcttagaaatgctttcattgtgtcccataggtttgggtatgttgtagcttcattttcattaaaatctaaaaagtctttaatttctttctttattccttccttgaccaaggtatcattgagaagagtgttgttcagtttccacgtgagtgttgttcagtttccacgtgaatgttgttattgaagatcagtcttaggccatggtggtctgataggatacatgggacaatttcaatatttttgtatctgttgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctatttccacgatctgtccattgatgaaagtggtgtgttgaagtctcccactattattgtttgaggtgcaatgtgtgctttgagctttactaaagtgtctttaatgaatgtggctgcccttgcatttggagcgtagatattcagaattgagagttcctcttggaggattttacctttgatgagtatgaagtgtccctccttgtcttttttgataactttgggttggaagtcgattttatctgatattaaaatggctactccagcttgtttcttcagtccatttgcttggaaaattgttttccagcctttcactctgaggtagtccctgtctttttccctgagatggatttcctgtaagcagcagaatgttgggtcctgtttgtgtagccagtctgttagtctatgtctttttattggggaattgagtccattgatattaagagatattaaggaaagtaattgttgcttccttttatttttgttgttagagttggcattctgctcttgtggctatcttctttttggtttgttgagtgattactttcttgcttgttctagggcgtgatttccgtccttgaattgcttcttttctgttattattctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaagtctggtgtaattctgataggcctgcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttctttatgtttgggaagttttcttctattattttgttgaagatattagctggccctttaagttgaaaatcttcattctcatcaattcctattacccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagtgttgcctcgctttgggttttctttattgtgtctacttccctttttagttctagtatggttttgttcatttccattatctgtttggatgtgttttcctgtttttctttaatgatttctacctgtttggctgtgttttcctgcttttctttaagggcctgtaacagtgctctcctgtaattctttaagtgacttatgaaagtccttcttgatgtcctctcatcatcatgagaaatgtttttaaatctgtgtctagattttcggttgtgttggggtgcccaggactaggtggggtgggagtgctgcgttctgatgatggtgagtggtcttgatttctgttaataggattcttacatttgcctttctccatctggtaatctctgaagctagctgttttagttgtcactgttaagagcttgttcttcaggtgacactgttagcctctataagcagacctgggagggtagcactctccttagtttcagtgggcagagtattctctgcatgcaagttctcttcttgcagggaaggtacccagatatctggtgttcgaaccagactcctggcagaagttgtgttccactcactagaggtcttaggatcccgtgtggaatcctgtgtgggcccttgagggtgtcaggcgactccgctggcaaggtagcctggggctcgagtggagcagaaggggcttgtgccccagatcaggcccgggtagtctgcttccctatgtaccgcagtctcaggttccgcgcgattggattggggcaggtgctgtgtttcactcaccaggggtcttaggatcccatggggagtcctgtgtgggtccttgtgggtgttgcgcgagactccgctggcaaggtagcccggggctcgagtggagaggaagggccttcatcagcttattggcattggtctcttagcataaaatgatgataaggttttgtgataaatgcttatcagggtgttgtgaacattaaatgaaatagggtttagaatatagatgctttccagatacacttcctgctcatattcaatggtgccctttttacaacttcaagggttaatggaagtgaaatcctttcagtatgtcccatctcattttccatgtgttcctgcatggaggatcattttaccattttcctcatcttaccatttcgtcatgcataagtcatagcccttcagaaaaagtgataggcatgggccattttccacataaggaatagacatttttgtatagtcctgtgtgtctttaacaaaagggcctagaggtggaacaaagactaatagcttaagatttttattcctccttagtaatacagtttatgtacatcctatatatgcatgtatctctaatgttggtttcaatctcttaattttctcctgcttaagactattgtggctgcatgataattgaagatgaggaggctccaatttcaatcactctggatgacactaaaccagatgggtcaatgcctgccatcatggggtaagttggagctacagtttccaatttgtgttggtataggtactagcaaaggacattgctttatataggtacaagcaatgataactgtaaactgtatcatgtttccatgtactaaaatatccatagcaatgtttttgtgtgtgtcacaagaatgctggaaaactgctaaacttgagaccatttttaacttgtgctcacctatgtatttcttctataaagcttacatgctgagggatcaagcagctagaaagacagtcagatggatggatggacagtatgatagcattgtctagaggcagaatatccacagtcactctggaaagagaagcacttcatcctgtaaaaccttctaaatatagtgtctctggacttgatctactttccaaatacttcctgcataccaagtaatagtgtcaatataagatgagatagggaataagttgcctatggttattgttcaccagcaatgcttcttttatctcttcaagtgcatagatagtaccaacagcctattgggaactagtactccagagaaggaaatgggccctcacaaaggaaatgctaaggagggacacaccttcctagttgcttacttttgtccttataaaaaaatcctatacacacaaaaagccttttattgtattgcatcattacaaaagaacacatgttactagcagtcaagtgacttttagagaccagtggtttctggttttgcttcctggaaaatgcaggtgtccttcctgaagaggtaggtgagctcaataaaatatcacatcatgccatttttagaaagttacagagaaaggggccaaacccatgttccaaggaactttggaagccggctctgcctgggttgctgataaaatgttttataactacttctctggctataatgtaagcaattgcgctatattcctgaggcaggcaggagcttaaaatataatgtccatagtagcagaatatcctcttcatttttagccccactgagtaagacaagatccaggtactttagccaaattgacaaaaacagatgaaagtacgactctcagaatgtcatgacagtcagttcagttatacatgggtagatgcacatcgctattcttgccttgtgcaccactggagttgctttggctttataacaaacatgttttggcacccttccaggtattaatggaattatttgggaaatttctagaaagagatatatttattattttattttattactaaaaatgtatatctgggtggaaaatgtttcagtacgtatctactttgtggaatgatcaaaccaagtttattagcatatcatttacgtcatatggtaatttctttgtggtaagagcattgaaaatcttgtttagatactttaaaacatgcagtaaattaatattgactatgcctactctactgtacagtagatcaccagaacttattcctctagtttaactggtattttatatttatgggaggccagactatataccttttccagatgtgatgcaggagagctctctgcctgacttctgtttacctgaaagcaaggcagagatttaaaaaggcaaaaggcctctttttgtcctcccctgtatctcacttatgttaagaggtaggtctcttttactggaaatagcactgtattagcttagaaccagagccagaggaagcttcaagctgacttccaaaagtagcctcctatacatttgccttctcatggtttatcatcttcataagattaaaactgcttttctttgtttttataatatgttgttctttgttggaaaagcaaataatccagactaaccatctctgggttactttttttttaattaggtattttcctcatttacattttcaatgctatcccaaaggtcccccatacccacccccccaatcccctacccacccactccccctttttggccctggcgttcccctgtactggggcatataaagtttgcaagtccaatgggcctctctttgcagtgatggccgactaggccatcttttgatacatatgcagctaaagacaagagctcccgggtactggttagttcatattgttgttccacctatagggttgcagttccctatagctccttgggtaatttctctagctcctccattaggggccatgtgacccatccaatagctgactgtgatcatccacttctgtttgctaggccccagcatagtctcacaagagagagctataactgggtcctttcagtgaaatcttgctagtgtatgcaatggtgtcagcatttggaagctgattatgggatggatccctgcatatggcagtcactagatggtccatcctttcgtcacagcttcaaattttgtctctgtaactccttctatgggtgtttttaccctttcttagaaatgggaacaaaacacccatagaaggagttacagagacaaaatctgggttactttttaccagtgtgtctcccaaaggccaaacattgtacaggacaataaacttgctcatttttcttttgtaaatctcatttgttattattagtacaactatttgagaattgcggggttgagaagaattaatttttgctttatcactgttgttgaccagctcctcttgttatattagggcagtagcctcccttctccccttttttgtatgtataacactggtattgagcctagtgcctggtatatgctagcttttaactcctgatcctgttgctaccatcacctaaatgttaggatagcagatatttatcactacatcagactttgggctttgttcttgataatgaaaaccttgaagatatatcacctccactttgttctttgcatttgactccaagagcctcaaaaccagaggtgataattaaccagcactgtgtttataataaccattgccttttagaaactatacattagatctattaaatacttccaacataaccccagcatgtttgatttcctcagtaaatggctaaataaaattgaacaatatttgtctacagtttaagtgattattgcattcctaacttgagatttgacagaaatttgaagtcaaaaccatacaaaatcagctgactaatgatttaattttttatcagttctggataatttataaaaaatattatggaagtataaacttatagattattgcataaagctaaaccttaaccaaaacaatgaattttgaggcatcattgaaagtgataactcaaacaaaattgtgattttatcccataaggttgaggatttcaaatttcagtttttaatttattcaattttaaatattaagacataaatgatggattttattgtggaacttcatccatacttcatttttgcaaattttcttcttccattgttcagctccatcctccagcacccctcctgctgtcctataacacccctcctgttgatcccttaaataatatgcaactgcctgtgttaacatactttgcatccttgcttctcagaacattctctaatagcagtcctaaaggagtttctggtgatgattgaggaacacgttaattcatggctgaggagaaaaagaaattccccctttcagccttgatctatgtgtctatttaatctctctggaacaaaataaatataatttttttaccattttaatgaggaaatagtttcatcacattttagttcatttggattaggagtaggtactggaaaataaatctagagctttctgtataataccaatgaagtgctttactattgagttatgtccctacccatcccttgaatttttgtaagatttctgttgctattaatagtataagtaaggatcacaattaaatctcataattcaattctttaaagtgtaagtgcagttagtattattgacacaataaacagaatctatttgactacagggagctgagttactttattggaggacagtatttaattagttcccaagaaagctgaggtagagatagagacaggagtacaagaggtttattggggtgaaatttggggattactgcctttgtgggaggaaccagttggagacttgtatgtcagcactcagccagcccatggacttctggaagctggaatggtccttcacagtcaaactgagagaagggagtggacacctcaatcactgactgtcaattacctcttaggagaggcagggtattgacagagggatgtatctgctgctgagtataattgtccagagaaggttttatctgtgagatagggtaccaattactggttctaaagtgcatttgttagggagtgagagaagtaccatggtatctatgatagacatgtattaatagttgtccagcttttattgagtgtcgttgctgggatagtcatctaatacagtcataatatgaacaacgtttaattttctataatatcaaatatggtgttaatttttagaagcaaagtattgatcaagaggttggttatcttttacttagtagctcacaggctacagagttttgaacgcagagagagccaaaggtaggataacatttgtcctaggaaaaaggggaggactgggagagttcattaatgctgaataggtggtaagttacatttatttagcataactataactgaccattcaaatgtggctttcttctccagcttcatacttgcccggaaagctgaacgacttgctaaactacat

SEQ ID NO: 369 - DNA, 134 bp, mus musculus; identical to SEQ ID NO: 125

SEQ ID NO: 370 - DNA, 852 bp, mus musculus
ccgagcaagatgcccaaagggaagaaggccaaggggaagaaggtggccccggcccccgccgtcgtcaagaagcaggaggccaagaaggtggtcaaccctctgttcgagaagaggcccaagaacttcggcattggacaggacatccagcccaaaagagatttaacgcgcttcgtcaaatggccccgctacatcaggctgcagcggcaaagagctatcctctacaagcggctcaaagtccctcctgccattaaccagttcacccaggccctggacaggcagacagctactcagctgcttaagcttgcccacaagtacaggccagagacaaagcaagagaagaagcaaaggctactggcccgtgctgagaagaaagctgctggcaaaggcgacgtcccaactaagagaccacctgtcctccgagcaggagtcaatacagtcaccaccttggtggagaacaagaaggctcagctggtggtgattgcccatgacgtagaccccattgagctggtggttttcctacctgctctgtgtcgaaagatgggggtgccctactgcatcatcaagggaaaggccaggctggggcacctggtccacaggaagacatgcaccaccgttgccttcacacaggttaactcggaagacaagggtgctctggctaagctggtggaagctattaggaccaattataatgacagatatgacgagatccgtcgccactggggaggcaacgtcctgggtcctaagtctgtggctcgcattgccaagctggaaaaagcaaaggctaaagaactcgccactaaattgggttaaatgtacactgaattttctgtacataaatataattacaaaatt

SEQ ID NO: 371 - DNA, 852 bp, mus musculus; identical to SEQ ID NO: 370

SEQ ID NO: 372 - DNA, 801 bp, mus musculus
atgcccaaagggaagaaggccaaggggaagaaggtggccccggcccccgccgtcgtcaagaagcaggaggccaagaaggtggtcaaccctctgttcgagaagaggcccaagaacttcggcattggacaggacatccagcccaaaagagatttaacgcgcttcgtcaaatggccccgctacatcaggctgcagcggcaaagagctatcctctacaagcggctcaaagtccctcctgccattaaccagttcacccaggccctggacaggcagacagctactcagctgcttaagcttgcccacaagtacaggccagagacaaagcaagagaagaagcaaaggctactggcccgtgctgagaagaaagctgctggcaaaggcgacgtcccaactaagagaccacctgtcctccgagcaggagtcaatacagtcaccaccttggtggagaacaagaaggctcagctggtggtgattgcccatgacgtagaccccattgagctggtggttttcctacctgctctgtgtcgaaagatgggggtgccctactgcatcatcaagggaaaggccaggctggggcacctggtccacaggaagacatgcaccaccgttgccttcacacaggttaactcggaagacaagggtgctctggctaagctggtggaagctattaggaccaattataatgacagatatgacgagatccgtcgccactggggaggcaacgtcctgggtcctaagtctgtggctcgcattgccaagctggaaaaagcaaaggctaaagaactcgccactaaattgggttaa

SEQ ID NO: 373 - DNA, 801 bp, mus musculus; identical to SEQ ID NO: 372

SEQ ID NO: 374 - DNA, 36428 bp, mus musculus
ggccctcccctcccctagatcctgctgctgcgttttcccgcttcaccagcagcccaggccaccgcagcagcagcagcaacagccgcagcaacggtagcagtagtctgcatcgcagtccctttctccttctccagcgcgctcctcagtccccggtcaccatgcctaacatcgtgctcttcagcggcagttctcaccaggacctgtcgcagcgcgtggccgatcgcctgggcctggagctgggcaaggtggtcaccaagaagtttagcaaccaggagaccaggtgggagcctcgctggggctgaggcaggggccaaagcatgcccaggccagctccgcgggcgtcatgctctcccttccggggcgggacggcaacaacgcggctgcagagccagggcggctgcgccaggggagaaagaagttcagcaagggacccccaacccccacccccaacccgggtcaccctggagtctctacgcgtatcctctggctgttaaccttctggtggctgggcctccaatacccggacatcggcgacctgtcgacccttgggcaccccaggcccctcttttgcaccggctcgcctggtgtcttcagtccggaaggacaaaatcggggcagttacagagcgtctgggagagtgggcgcagtctgtgggcatcacttcggtgccgggaatggtgggggcggggagacatcggtggatccgcccgccccagtttccaactctctgccagacagaaacccagaatcctgcatggttgaaaaggctctgcacgggtcctgggcactgggtttatcccagggaaactttcgaatgccacttccagccgctggcgatcagagtactgccagctgctcaggtgactctccagagcagcaggctggccaagcgctgccttatccagaaaggtgggtttgtgcgggagttaggcagagcgtgggaaagcgagacgcacgtgttgagcgctcgcacccttcctttaaactttgttgcatctatcattgcgaatagcttctttgtgtttgtggagcttagctgcgcacagcaacaagaccccagtttgttcaaaattccaccggtttctcacattagcaaaaggtgccaccaggcaggcggaagctctcctcagcttagactagggattccttgtcctacttgcccaaagccaatttcttttcccgaattctatttagcacagttaaccaactatacagtgcacagtgacagataaccgttctatatttagtagcgcacgaattcattccgcaagttttacagaaaaaaaaaaagtcattctccgtatttacaaaagttaacttagaaacggattgtagacacaaacgtcaaaactaaaactgaaatttccagaaggaagcacaaaatcttgatgatggaatgaatcgagaatttggttgtgagattaagggcattttttttccttttggttgttttattttggtttggttttcgttttctgggacagacttttgctatgtatttaggctggtattgaactcacccaggtagtagtccaggtaggcttcgaactcacaggagaacccttgtttctacctcccaagcattagaatttcgggtgtgtgtgtcatcagacccagttagattaatattgatgacaaagatgatttttttctagaggttatgtgaatcccgtgtgaccttttctaggtggtaaactccatttacacagcttgggtgataatagaagaaacctgtggacaattcaggtgaaagaactgccactttgtttacttattgacattacatcctgattgaagtcccccctcctccaagccaccccctaaaataaattaattaatgggggaacaaaaggaagtaatccaaaccttccaggagtcggcaacaagaaaacaacaatgaaatgaactgtgacattgaattaagaacagtgaaaaatttattttcataagttaaaaacaacaacaacaacaaaagaatgccactctggggttggggaatgtagttcagttggtagagttgcttgcaggagtttgcatgaagcccctgtgcagcatcagatcaggatatgctggcacacactacgttctcagcccttgggtagaagaagccagagaagtgggaattcaagagcatctttggctacatgagaccatgtctattttttttttctagtacagaggatgtattccaggtctttgtgtatgctaggcaacaagaagattcaaccactgagctccatccccagcgccctttgtagacttcaataaatggagggtgctctaggactttggagaaggatggagctaggtttggacatagcaagattttgttagtccttgtccaagtttcagcggctctgggggaacaactagaataagcctctttgtttagaaggtgttatcatgtaaataaaggagctggctctggagggagtgggttttgaaagtgtaagtgaagcaacccttctttgtaatctcagtgcagcacaatgctgcaaggcctggctaatctccatgatctggctgagtaagggtttactactctaagtcctgtatcagctgataggggaaacttactcagatgttcaggcgggattgttcgtacatttatttaaatagaaagaagccttgtctttagtttgggttatcttttcaccacttttgatcctgacaacgcctaagcttgagaagacccctcagctctactttctgttgaatgggttgaggttttgttctgttctatctggtgtagtggatttgctttccctttctttgagtcaagttctcatgaggtctaggctggtctggagttcactgtgtcactaagtctgcccttgatttcatgttcctcctgccctcacctcccatgcgcggatcatagagtacatgtcccaggataccttgctactccttgctacattttatgttctatcccatagaacattttaaaaggttaatgtgccaacttttctcacaaactacacagaggtggtggttgttttttttcccccctcctcagtcctcaaattaagtgttcctgtttgactgtagagatgagaaaacaaagggcaaaagaaaaaagaaatggattcaatgtatgtaaggtactttttcttcagtgcctcttgctgagtgaggagcagaagtctgaatgttatgccctggtcctcggcacctcagatcctaattttcttaaatgctacttaatcagacaggcactcttcggcttttaccttttcatctgtgaattatttccattgtgcagggagaagtgcatttcagcttctctcccaaccccagcaaatgctccgtgatttggaggacagtgttcgtggttggaatccctggtctcttgtattttttaccctggtttaatttactgctatcagggtccttaacctgtataatgggacccaatgtacaggttactgccacttaacaaatcaccaagaactcaggggcttaaagcaatcagtgttcatttggttcccagacctgaagtttgtgcagatcagagcaagaaaggcttgtttctatctccagcgagggctgctagggtggatactgaggccacaggaccaatttttgaagatagcttacccacgtggctgataagtttggctagcttttgccagaatgttttgactaagatcactccacagggctgcttgggttcccttgtagcattggagctttgttccaagaaggagagtttcaatagacaggaagtagttaagtaccagtttgttatggcctgggcttagaagttggcatatcatcacttctataacattgttttggctaaacacagtgccctcttaggtctagggaaggcacttagattctaaggacaggacctagatcctgttctacagtagaaagaagtgttataattgttgtagtcattaggtattgagtcagtcatatacttccgccttgctgtttgagggtcttctgtctttgggctgatgcacacaacccattagagaactccactccagattggggtgtggaggtctttgtaagtagaagcagaactggctttggaagaaatgttaccatggtgtttcccgtgctcccctggactgctagtcctaggaggattgcagttccttagtgaggaaaggcaggccaaagaatgtgatcttgggggataaacagtcataagaccaagacttgggaaactttctgtaaagagccagatcgtaaatattttaggcattgtgtgccacgtgtctctgttactgctttgtcttacagatctgtaagctacaagtcctgcataggtcagcagggctgccttccttcctgaggcttcaaaggcaagtctattctcatgccttttttagttttcttttcttttctcttacagtctcatgcagccccaggctagccttgaactctcaatatggtagatgatgaccttgaacttcagattctcctgtctccacgtcccaagtactaaaatcacagatgtgtgtcaccatacttgatttagctactgatgaggctctaacttcatgtatattgggcgagcattctaccaaataagctatagccccagtcccccttttcagctttgtgggcaccctgcagccctgggaccttgggaccttcataaatagagtatctctctgattggatttagtcatcacatctgtttctactcttctagtcttcctcttccatcttgaaggctagccattatcacatgcagttaaatgtgaatagttacgtatgacctttctgttttaagatcacttgattagcatgactaattccacctggacatatacatcccttttgtcatataatctaacatattcgaaggaatgcaatataaatgtctttggagggtcttcattactgggactaccaaccgttgttagtgtgtgtgtgtggggcgatgtatgagtacaaaaacagggtgagcactgtattttgtcagcccctgagctatgtaatacttgctttccaaattaagtcagccctatgcatgatggaatcttgttaaatttcaaatgatttgtgtgcaagtattgcacatgaatgtgtgcacatatgtggacgccaaagaagaactctgaggagtcagttctcttttgcacttgaaggattgttcttgcttctgccatgctgtatactccatgctgtctgcctcccaagcttctagatctttctcctatgcaagcctcccacctctccatcagcgttctagggttacagattcatgacaccacatccaactttctctgtaggttccagcgactgaacatactttgttaggcttttatctactaagccacctcattagcccaagaatagtgttcactctttagcactcacaatcaggagatgtgtttccgtttctttttgtgtactgtagcatccatagcagagaaccttaagcaggagtgtgagcaaatagcaaaactagtttttggagccccgcatggtgactcatgcctgttatcctagcacttagtagatggaggcaggaggaaaaggagttcaaagttatcttggctttgactataagtgtgtgccaccaaaccagattctgatggtgtatttttaagtggctatattcaggtgggcacagtgaagttctctgtattctttttttttttttttttttcagtacagcggatggaaccccaagggtttcatatgtgttgatgcaaataatctaccattgagctacttggacaaccccagttttccgaattgtatttcaatataagaaattacacaggcctggagagatggttcagatggttcagactgctcttccagaggtcctgatttcaattctcagcaactgaggtggtgggtcacaaccatctgtaataggatctgatgccctcttctggtgtgtctgaagacagccacagtgtattcacatagataaaataaataagtaaatcgtttttaaaaagactatgaacaggttcaactttttaaaaaaagaaggtacacagaggtaaaattcagttcaagttttttttttttaaagaagttacacagaagcaaaattcacaggatgttcatagtgtttcattttgatttgattgtgtgtgtgtgtgtgtgtgtgtgtgtgtatgtgtgtgtgtgtgtgtgtgtgtgatatgtacatgtctgtgtggtcatgtgttcatagtgtctcagataaatcaaattgttccaactcttggatcagcattgccattttaaaaccagagttctgcgagagctgatctgactctttgtgtgatactctgtggtggatataccaagatgcatgacactttccttctctctggcagccagagaacgtggatgtgctgatttagctcattctgaataccccagaaacctttagacatgtgctttgcaaaaccttgactactatacgacctaactcttttctccaggtgctacaggatgacaaccagcaaagcaaggaagtataccacagggggaaaaaacgaaaacaaaaacaaacaaacaaacaaaaaaacccagaaagtaaaaactggtgtgcagccaagaggtagagagtatctatggcaactgggccattcctgtcatggagctgtgggttgtaggatgtggagatggacttgaagactgacactaagagtttgaaattctgaatgggctgtggggtggcatctgtagcaaataaagtttagcagagaaaaggctaaggtaaaagggtgtgtatacgcacacacaaacacacacacacatacacacacgcacacacacatcgaaacgcaggcttgagagaaaaatacgaatgttgatttagttcacctcatggctcagctctgatcttcatttccagaattcaaatggagctgtccattttttagcttgagtactgatgtgtattgacatgatggcgaggtgggaagtgttcgtctgcatgatggggaagagaggaagaggtgttaaatcctcatcttccatagtgagtagtcaatacctgatgcttcatgaaaaattaggatttgggccttgaatgttagatggagacttgaaaataaatctttattgaaaaagccatcaaagattgaaattgcttatctctgggatgtttaactgttataagccttacagcataaatgtgcatctctctctctctctctctctctctctctctctctctctctctctcagagagagaggctagttcttgttgctttgtagtctgtgcttgcctggaaagcacaggaatgctcttttctcagcctcctgcatgctgggattataggctaaactaatcatactttttcatggtttgattgtgtgtgtgatatgtacatgtctctgtggtcatgtacatgtagaggccgtcttcctctatcctcctctgctttacttcttgaggcagggactctcactgaacctggagttcattcattcggctggctggctggctggtcagcctacaagtgagctctaaggatctgctgtctccattcccccagtgctgggcttatggatatgtttgctgttgctcctggcactttttaaatgttgattttgggggagccaaactgagctcctctacatttttgctgatagtcacattaccgactgagccatttctccagctcctgcgatttgaatttttaagacactatccagtcttaactttaatagtagaaaacattgccataaggaattatcagagaagcctggaacttagaatggctccttgaaaggttagctcttggtcggcctaggggaacttagctcttgcaagggttcccacaccattctttggtaagaatggctccttgtgtgtgaactattaacagctaggaaacaatgcgactgagctcccgcctgcctggtgcgaagctagcattatggaatgcgttagccagtgggtgactccatgaccagcttccagtctgtaagtcttcactagtagacaacacttgccagttatcaccgctcacagctggacactttgggctggacttctgtgacacctgtggggaagaacgcttggaaggtcacacctggacgcccccatatacttttccctttgctgattttgtttggtgtccatagcatctcataagtcacaatcaggattatgactgcagagtcccatgactatacctactgctggattgctgaagttggaggtggtctcaggaagtctcagagactatgatattaaccaatcttgtgatgtctaattgctaattgtcaacatgacagaatctgggatcacctgagagatgagcccctggctctgcttattggggggtgtatcttaattgtgttaactgaggtggaaaggccaagtgtgtagcactgttttctgactgggccctgacctctgtcagtgggaaagagagctgggaagtagcgtgcatccatcactctgctttccgattaagagtgaagtgtgggcagctgcttcaaggcccctccatcttaagttcctagccaggatggacttcaccgtgaactgtgagccaaaataaagtcacttttcttagagtactttaaatagcaaccgacaaagaatcctaagacagatggcgttgttcttttatagtgtcgagatcggtgaaagtgtgagaggggaagatgtctacatcatccagagtggctgcggggagattaatgacaacctgatggagctactcatcatgatcaatgcgtgcaagattgcgtcctcatccagggtgacagctgtgataccctgcttcccctacgcccggcaagataaaaaggacaaggtaggcgaggtgtgtcctgccctagcaacccagtgtgctcaccactgtttcctcacctattgccttcattagactatccagaagcctcagctttcctcttcaatgtaaatatgtgccctcaccttgtctattccagatttgtcactgaacccatcacatgtatcaacacaggcaatgtatgtttcaaaggcagtcaaataccattatccttgttatcatgatagagtgttgtaaggtggtgcatagagttaaatacaaacacacacacacacacacacacacacacacacacacacacacacaccactgaatgagtacaagtgaagaggagaccatccaaattacttcactgccttggatcaaggtgaggtctccagttgaaacattgtgttctttgtttggttggttgtttttctgagacagggtttctctgtgtagccctggctatcctggaactcactttgtagaccaggctggccttgaactcagaaatctgcctgcctctgcctcccaagtgctgggattaaaggcgtgtgccaccaccgactggcgcaacattgtgctcttataagtggtttccattgtaagactgggtaaaggggccatagggtacctgcattgctgcttctaactgcatgcgaattcacagtgctcccccaaagtttaattaaaatcaatactctgtttttataaggagaacagcattaatattgcttattattttagcaaaattcccactagtgtatgtaagtttccaagagaagctgaagaacatacagttgttcttagcctcgttgacacattagagaagattggttaaggccaccatcacaaattaccatgagctgggcagatttacagagcaggaaattattctttagtttgcagaccagatgtctgaggtcaggatgtgtcagagccgtgcttgctatagaatctttcctgccactttcaactccccaggaattcgggcttctcttggtcagtggcctcaatgcttcagtctttgtcttcaagacactcctctgtacgtgtgacactgtcacaggattgaaggctatcttcattctggatgatctcatctcatgatccttcactaatcacatctgtaatgatgctacttccaagtggcattaataggttctgagggtcaggacatggacatagattcttgtatgtctccattcaaatcaccatagtttgatacagcttcctctaagacccccaactgccagcaactggggcctttaggcaatctgttaattctgattacattcctttaggctctgcctatgtcctctatgccatggtttctcctcttgttctgtgtctccccttccatcccttataaggatgcatcattggatttagggccaagcttaatcaaaatgacctcagctcagtatctttacattaacagggtctgcaaaaaactttctacagtgaggcttcattccagactcatgggcagataagaatttggggagacaaaaacattcgcctcatgtcagtgaaaacgaagctattgtttgaaaacagcactcaggatcccatggatttgaaaaataaaactaataaaattatctgcacaaacataaatttatgtcctaagatctccttgaatattaatctattatcttaaggaatgaattccagagtctgtaaggaacacagttctttgttcagtgtttcatcaaaatgtgatatgaagaactttattctttactcaagatgtgatttactttatatgatcaatttttattgcagtcatccaactgtgtgcctcaaaaccagagatcaagaacaatgtataaatgacagatgtggagaggggtagtagggtaggtgggaggtgagactgctcactatgtaaagcatgtatgtgcaaaaccacaaaacatatccaagttaaaatgtatttatagacatttgtgaatttctatttctatataccatgaaatattatttacatttccccccaacaattaaatatgcaaaagaaactttgtagctcattaacagtacccacatatatagtaggctaggttgggcccacaattctcactttgcattagttttatagttagttttgtgttaatgtaactaaaagatctgtgctgagtgacttataaaatgaaggggtttctttagtgaggctgggagatccaaacaactggactctggcatcctggctgctgttcacaatatagaagaataatgaactagccagatgtaaaagggtacgtgtgagcaaaggacaacctagtggagatagacagcttcattttgtttattataacccactcttgtgggaagttgctcactgagatggtaaattttaattttatttgtcaacttgacacaacctagaatcacctaagaagagaatcctatgagggattatcgaggtgaggtttctctgtggtcttgttttggggaatcgtcttggttatattaattcattctggaagatgcagtatgaaagtaggtgacaccattccttaggcttgggtcctgggttgaatgaaaggaaagtgtactgcatctcagtacacatgcattcattcgctctgttcttgactatggatatgactagctgcttgaagtgcctggcccctccactttcccaggatgatagactgtatcctagaattgtgagtcaattaaaccccttatactgtctttgtcagggtgttttatcacagcaacagaaattaaactgacgggcaagcggtttgatatattgccagcatgattaatttgaatcaagttcatgtcctttgtattttgtgtttggctggaggataatggtacattatggcttcttcagtaaattttgttcttacaagggtcctgtccaattgtggggcatatgttcgaactccagattcttctttaaggaatacaaatattgagacacatttggtggtgattgttgacatactgatacatggtaaccttttctaaagtcaaatttcctaacttcttctttattccaaatttatgacagagaaactagctctgcctgccacctgccacctgtcatttgcattgcaggaaatgttttggtcttttgctctgtcccctgattgcaagcattgccccaactactatgccagcaaagagagctctatgggcttctcaaacaccagtaaatttgttatataattttttattatatctagtggtgtgtgtgtgtctgtctgtctgtcgtgtgtgtgtgtgtgcatgcgtggtgtggtgtgtctgtgtgtatgcatttgaaggtcaggacaacttgtggccattgcttctcgcctccaccatgtgagtcccagggattaaacacatgtcaacaggtttcattgcaagtgcctttaccaactaaatcatcttaacctcaccctctcccacccccagtggctttaattgttttcagaactgcactgtgtgaccagctatctaccagtttccccattgtcaaacatttagatatgttttccatttggagccattttgaacctgggtcccatgcctttccaaacttagctgctaatgcacaagataagactatcatcaagcagcatttgatcgaatggcatttgagagacagtaagtgcagctcaggaaactgtcacttactggtggagagaagaaacaggcctgcaacaaatggctgtaaacagaatggcttaaaacagcagccgtgtgctcttgcacaactctggagtccaacattgccaaatcagggaccaacatttgaccgatactgatggatagtaaatgaaattgatgatggataaggtgaacatgttcaggcttggttaagctttgatgtagtgctggtttccaatcattgatcacctccaacaggatgctctagagattaaaaggaagtcaaaggctgactgtgccaggaaacaagtgtccactgctcacactgtcctcagcaagtcttgtacaggtctgtagcctaaagtagccttagagggagtcaagacccatggatttttctggagtcatggcttcctttatttttaatcttacttaagtctctgtatgtgtgtacgtgtgtatctgtacatatgctatagcacacttgtaatcagagggcaatattttggaatcagttttctccttctacttttatgtaggtctaggtcaagcttgtctaggtcaggcttgtataacaagcactctcacctgctgagctccctggctagccttttcagccatgacttctaatggatccgggtagtcagcatgattcaaactatagtaaggaaacagtttacagtttcattcttgcatccaattgaatctgtcaatctgccattcaatgtgtaacatttgcattctgtgaagttttaaaaactgacgtcttcctttcaaccatgcagcttagcctgatgctgggtgggcactgagaatttggtaggagaaagaagaaatgaccagaacctggtaaggtacttcatttcttagtccactgttcccatatctcagtgtctggggactgtgaggacaccaaccatgatttgagatggaggaaggtacttcctacttcctttttgatttttttttcaacttttttttttctgcttcacttagggaggcagaaagccaggtggtatttggatgtcatagaaagccatgtgctacatttaacctagacagaatattcttgttggctacaggaggagctctgggcagccctcccaggctgtctattgttcttttctcttcctttgggaccgtattgcccacggccactaatagcacagtgaagttctgtgtaattgcctctaccaagaagtaccagtggaaagagcccagaaaaaaatctcagggctttaaaacattttccaaacttgtttcatgtctttttaccctttgcactatgaatatagaaaggtttatctagctttgatttgtaagtaccagaacccaagcgcagcttctcacaggaaagaaatggtttcataaatgaccacttaacacaatggaatattcacacaggaaactggcagtgatgtcatagtaattgtcaaaggcatgatgtaagccctggagttgcagctttgcaatgaagtaggctcagttttgaattcaaataccataattcacctggtttgccctttttaaaacatatttaacctctgcacctttggtttccttacttgtagactaaggaccatcttagctggtacagttgaagctcctagcctatcatacacaagtgaacaagctttctgagaagcaccaaatattggtgttgtagcccattggatggttatgacacttcaacttccatcattttagtgtggagactgccatagccaatacgcaaagaaatgggtgtaactgtcccaatgatgcttcatttatgcacactgaaatatgggttttatgtcaccttcacatgctacaaaaatcttatttttgtctgttttccaatgcttttataagagacctttcctagctgcaaaccaggaatcaggcaattctaacctaccagctgacatttgctgggtcctgtagtagacactcagtaattgctagttctcttccctggagagaacagtggattgcgagccaggcagggaataattacttctgagagagtgaagaagggctgtcaccttgaatttttttttagagtcatgtataagattatgttgatattttaatgataaagtggttgacacaagtaaatttctttaatcttgtaatctctgtatgtgtttgtatgtttaggggaatgtgtgtctgtgtgtaagtcctgcacacttccatgtgcctgagaaagtgcatgaactcagacaccatttttctggtgtctggtgctgcctaccttttgtgggtttgtttttgttttgacttgatgagatttctcactggcctgaaacgtgccaggtagacagcctgagagcatcaaacctgtcccctccttcccagcacagggtcgataatgccacagcattttgatgtggactctgagcttgcactcagctgttcatgctcacaaggcaagtgctttgcctacgttaaatgccacactgattgttctctctacaggcttatggtttgaatgagagtggccctctgggtgtatatgtttgaatgcttgttctgaagttggtgggactgttaaggaaagattgggaaatgtggccttgttggatgaagtgtaaaggtttatcagtggggcgtctttgaggtttgagaagcccatgtcaggccagacctctcccccctctctttctctctctttgtatctatctcttaatcatggatgagctataagctctcagcactactctagtaccacacctgccttcctgctgccatactccttgccaagacaatcatggacttaccctctgaaagtgttagcaatcccccaaattaaatgctttctttcctaagttccattggaagccatatctgaggacctggagcagacttctgttggccccatgcttgctgcttccttctctgagttcacaagatctttgcttagttgatttagagggccttgttctcttggtgttctccagcccctcgggctcttccacacagttccctgagccttgagggaagggatttgatggagacatcccattgaaacctgaatgtttcaaggtctctcactctctgcacactgtctagtggtaggtctctgcatttgttcccatctgctgcaggaggaagcttctctgatgatggctgagcatggcactgatctatgagtacagcagaatgtcattaggcgtcattttatcactaaggtttctctttttgaccagtatttggttttacccaaggaccttgggctatctattcacacattcttggtcacctaaacagtgtcactgtagaagaaaggggttatttctggtattctaagaggtacttattattgtgatatttgaaccagactttgaaggatcaaacacatgggtgtagcaaagaatatgtgagattggggcagctaagtatgcgagacaaggtcttggtgttctctagagaaagtgaacagtctactatacaggaaagggtgctgcatcggaggcaagggagagcaatttgcagttagctacaaccagattgaccagagtacttgaatattaaagctgaaaaaatttcgattctttcccaaaggcaacatgaaataccatacaggggagttaaataaagatgggaatatagaggagatcaaaacaaaccccctcccttttaaaaataagatgaagagaggctggaaaaatggctcaatgattgggaacacaggctgttgttacagaggacctgagttctattcctaatccacacgtggtaggtcacaagcatccataactctacttccaagggatacaacgctctcttctggcctctgagggtactgcatgtacagcatatgcagctgtttatacattcaggcaaaagactcacacatctatgtgtgtgtgtgtgtgtatgtatgtgtgtgtaaaggaaaaacacttcccactaggcatgatttttcatgtctttaacctcagctctttggaagtagtaccaggtatcaaggctagccttgtctacataatgagttccagtacagctagggctacatagatagaccctgtctcaaaacagcaataacaacaacaacaaagcaaatagagaatacttccctacagttttactttttagaaaatctgctggtgatgttaggaatgtttccgctgattctgtgtgtatgtaattattgtaaaattaatatatagatgaatgttattttataatattaactatactattgatatttgttggttatatttataaacaatgtaagatatatatattcattataaggtgatatgtatttgtcttttaaacaatagtgttcgaagggaaataaagacaatattcaatattaacattttatacaatattaagattgtattttcttttgtggcttgcatataagaatgtaatggtgttaatgactaatctcctatacatgtctggactatgtctaatgatatctgtgcaatctctttggttgctttgatgtggactttttcattgtctgtgatttatgatgtggaaactaaatctataaagaagttacataactttagaaaaggcatatgacagaagggacaatgaactagtttctctgaatgttcatttctcaattacctataactgttaattctttcatttggcttgtgtgtcactgttcccgtctagagcactcttctgtcagctttggctggccttgccttaaaagtgatttcttaaatcatcttgttgaacctctttgtgttttcttgctatttgaattataggactgtgacattgcatttgcacagtttgactttatccctttaatatttgtattctgtatgtagtgtcaggtgcatggctgcacagtagtgtaaggctggagatgtagtttagtcagtagaatgcttatctgggatacagggattcctggatttcagccttagtaccacagaagttgagcatggtggcacatgcctataatcttaacattcaagaggtaaaggcaggaggatcaggagttcaaggtcagcttgaagactcagggtcagtaacaagcaaacaagccatgccaagtagtagtatatatttagttaccaaatccaatgtatcaaatatatcttttgttgttataacttataatttttcttattggttccatctgattcggttttctcatgactatcattgtgagaggaatctaacaggttccatctttttctgatattaaatccttgtttctattttttagagtcgtgctccaatttctgctaaacttgtggccaatatgctgtcagttgctggggctgatcacatcattaccatggacctgcatgcctctcagatccaggtacaaacattgtgtttctgtccacggttaggtcctaactcccttaactaattttgaaagattttgagtctgcacagctactgtcctggctggctgtctttcctgtggatgccaccattcctaacacaccttgcctccaattcatttatgaggaacagaaatgctttcttatatgttttgtggttccatctaagcttctgtaaattagttagtgtagtagtgcatattgtgtgtgtttgtgtacattgcatgtcttcctcaatcactcgtcagcttaagttttgatgactcggtctctcactgaacctggatctcatcaattcaggaaagttggctgaccgatgagctccaaggatctgcatacctctcctttcccaacactggggtcacagaatgtgcagcatatgcttgtacagcaagttttctatacattcacacaccaggccatctccctagtcctgcaatacacatttttagtttcttcataactttctcttttgtcacaaagacggaccacatttctcagtacctacttatgatatataatgaatgtgaagtatttgatgtgtgcttaagtgctaaaacaacaacaaaaatccacctgtcttccagtttgtcctgcaatgctgttctttctctcggtgcacataaatatcagagcatgcctaggaaatggactggactgaaagatgccttgtggcatcgcaattgttagatttaattctgtaacagttacccacagggatactggtgtataaaagtatcttttggatcaatagttcaaatgttattgaaagatagcaattaccttttaaaaaaatctgtatccaattaaactaagtccctttccccgtggagcgtgctgtgccgtggctgcaaacagtaggcttcttgggaggttttatataggggtttctctaagagaccttggggactgaactttctggtgaatagtcttgtcgcttatctcatcttgtcaccagtccaggcttcagagaggtatatggatcaccattgggaagccccagggcacagtgggcaaggttcacattggccagcccatcatgtgtataataccaacctgtaaaacaaggatttatgcgattgaggtcctacacagggttaagttcaagttccctagctgacagaagagccacatcttttgagagagagagagagagagagagagagagagagagagagagagagagagagagagagagcaccaagtttaatgcggatgaatctgaagagatgttatcgaagaagcaacattttctcaacaagcgtgggacaaatatgtccctaatcatggtccctcaggcatgtggtaggactctgtgttcctgaggctttctgctgtgcttaacccttgaccctgccaatcatgtactctaataaatctcacattcaatcggaaaaccaagtgacattgattttcctccttagggtttctttgatattcctgtggataatttatatgcagaacctgcagttcttcagtggattcgggagaacatcactgaatggagaaactgtattattgtttctccagatgctggaggagccaaaaggtaccatacaagtgataccatacacatctcacctactactttcctgacttctgtatttctctatgtcttaagggagaaagcatgccttgttcgctgggggaaatagttgagtagttaaagctaatgtcccacaagcttgaggactgaagttgggtctgaagagcttatatagatgctgagtacgctttacggtctgtctgtgattttagccttggaagacagggatgggggaattccccaagctatctaactagctcagcgtttaattgagaaacactgcatcaaaaaataaggtaaaagagcaatcaaagcacattcctgacattaacttggagcctccacatgtgtgtgcatacatgcataccacacaaaaacacactgacaacctttatagatagcatgcttagtgtgtgtgtccccgcgcacgtgtgtgcgtgtgtgtgtatgtgtctgtgtgtgtgtgtgtgtgtgtgtgtgtgtgtgtgtgtgtgtgtgtgtgtgtgtgtgtgtttgctggggatagtattataatgtagccctgcccccaccaggaagtttgcttttaattatgcaacattttattttgtaaatgagcaactgaataggtctcaggctttgcctccagaacagaaacccatcactgtcccagcatttcacatcattcatgaaaataaaacaaacacacacatacattctatataataagaattttaattaacacaattgactgaattagtccttctaaccacaaacacttgactggagcaggcacaatagaaaccagtttttcaaaatgtatatggaacaacaagaaagggggctaaagtctgtctacattacagatggggctggactgtactctggtgttctgggggatgtgggtgagatgagaaggggaaggcagcttggcctgtcccacctattcaagtgcctccctaaagcaggatgcgaaaagctaggtccctagccaataagcagagcctttggctgagggagaaagtagtcacccatgagaaatccaaccacaagtttgtgccacaggcaggtgaatatgaggtctccctggggtgttggactccctggactaagaaaattaatacaaaattagtctgacactgcagtacctctatggagaaagacttctacagtttgagttggtagggtatcagtcactgtaccatgtgacctgtcaatctgatcatccaaaatcagccagccctgagggactaacatgcccggattccttgtgtatagatagccaccagggcacaggcagccagtacttaggagatgtagaatgactggcaaatgaacaggtttaacgagaaactgagcgtgctgccacagtggcaacctaaggacatagccctgagtggcagtgtcaaccagctctatggagagcttcaaggggcgcacgaaccactaggggatgtggtgttgtggaggcaacaagaataagattatgctggtcctacacactgcccacactgcaaactgagccttaggaccctgagccttggagaacttgccagctgctatctgggaagacaaacctggtggagtggagtggagttgccaaggtaggggctgccataagaaagggaaagggaaaagagaactctccgcaccaactaaagtaaagaggtttattgatgggagtcaatcatttgagtccagggtaaagaatgaagatcaagcttcagaacaacccaaaagggcagtgatcttgggtgtgtctcagtggtggaaccttggcagtcaggctcatagccctggatttcttctctagcactgcatagacacatttgagtacacacatacacacacacacacacacacacacacacacacacacactcattctcatgtaccttctcctcacttgttgatatcttcatctccttgcagccctagaatcacacttaaaaagacttaagagtggccaataaagtaatcccaatgcattgcgttccctggttctcagaagagcacatgtgttgggctcttagctgctgtccaacagccactggttctcagcacagaagagaagaaaacagggcaggtaactggagagggactctctgacagctgctggaagtgcctctgcacaggaaggagactcacatgaacgacagtggcagttaggttcccaagcccccaactatgcaggtgtcttagtcagggtttctatttctgcacagacatcatgaccaagaagcaagttggggaggaaagggtgtattcggcttacacttccacattgctgttcatcaccaaggaagtcaggactggaactcacacaggtcaggaagcaggagctgatgcagagaccatggagggatgtaccttactggcttgcttcccctggctcgctcagtctgctctcttatagaacccaagactaccagcccagagatggtcccacccaaaaggggccctccccacttgatcactaattgagaaaatgccttacagttggatctcatggaggcatttcctcaactgaagctcctttctctgtggtaactccagcctgtgtcaagttgacacaaaactagccagtacagcagggttgggcttgggagctagcagtagtccattctctagcccagagcatgatgagcacatgtgaccttgggcaagccattgaagttttcccaggtcatgtctttttaaccatgtgagtgactttgcagagtcatttctcctggatttcttccatatcaactttgcagttgatttggaagcttcccaaagtcatgaggtagaacatgcattcacatcattcaaatctcttctaggctaaggggtccggggtgttagataacttgggttataacagcagtaggggattcagaatattttcagatttctgcaactgttactggtaaccacctccacacattttcatcacaccaagaggaaaaatcccatgccccttagcagttgccacccatgtcccctgatcccattggttactccagtgtccctctatgggaagacacataaaaaatgtgttcatatcaattgatcatacagcaaatgaccattttctctggcataaaagaaaaaagaaaatagaactttggcccaagcaagtctaaagaataatagattccatggagttcttttggccctttcccttttcctatcccaactgtctctatctatagccaagaatatcattcatactttcagcaaaaatattgaaacagaggctagtaagatgacccaggagttaaaggtgtctgtatcccagtctgataacctgagcttaatacctgggagcctcataagagaagacctatttcttcaatatattctgactgccacacttgtgctttggcatacatgcatacacacacacacacacacacacacacacacagtaataaaaaattaaagcaaattgaaagaaaatagaaaaggtaactcagcttcatcaagtactgttgttctttccagtgttagggtagtgttcaaacatacatcccctggttccatagacgcagactaccggtaatgtgttcccatgatttgactgtggaacctttcccccagcctcctttgcctgcacacttgcgccacagctgcgttgggggttgtagaacctgggaggcagagtgtcactagaagaaggtcattgtggggttgtagtttataacccagatcagcttctgcttgggtctctgcttcctgttcctctaagatgtggcaaatagaagccacctgctcctgccacaaagaagttgcctactaccagccattttcctatcctggtgggctttatttccttaaatcatgagccgaacgaagttaaccctctccgctttgagttgttctttgtcagggtttggtcacagcagtaaaaataacacagatgcggcacacacttctccacagaggttcttaaaaagcgaactcgctatattttaccagtaattctatagttatctaacatatattcttgatcatttctcaagggaggggggatttattttgctttgtgatttgaaggtacagcctattatggccaggaaggcgtggcatcaggagcatatagcagctagttgctttgcattcttagtcagaacaaaacacaaatgctgggtcttagtgcccctcttttctatttagtgaaagaaaccatttcaacagtgccatgtattttcagggttacctggttgttttcatagctgtgtaatagtctctctcgcgcgcgcatgtgtgtatgtgtgtgtgtgtggtccttcccatgctactcattcataaacactgttgtttgtgtgaaacactgttgtttgtgtgatacaaatttagcagaattgtctgaccttttgcatagttgtctaaataagatacattcctaaaattaaaactgccagcccaaaggcacaggacatttaagttttggtggacagagctcaaagtgggtctttcagaaaagatattccagatagtgttgtccagtatggctgccagagtcttggtacccacccttgctcacatagtgtataatcagtttcagttggcctatgaggcaagtagcctgagatatatcttcttgtgaacttggttgttaggagtgaagtcaggcatcctttctggtgtgatggtttttttctatgagtacaaacttccgtgtcttagctggagacgtttacctgcggattggcaaaggtaggctattaccttttaatgagtatctcaggtatttccccagttttttaactgcctcccacttttatattcttattccctaaagaactttgaaaaccatcttatacttacattttggcttctgggcctatgaagcacttgcctttcccttaaattttttcttcgcttatgattttgcatattttcaaaggtctctttttctcttttaatgttctgatttttcttgcatttgacatttattgggaaataaaaagtaaaataaaaatccaattcccacctatcctccaccagctatctagtcattcaagagctattgaattatccatcctttctgtattggtttaaaacaacattttttattatatactaagttcttctgtcccttgcaaactcccacttttaaaaatcacagaagagggtttgggagatactcagtggataagtgttctttctgcttaagtgtaaggacctgaatttaaattcctagcacctgtttaaaaagctaggcatgaccacataccctgtaactttagcactgtgacgcatatggacagaatgatcggtgtgacttcctggcccagcctaggcccaggttcagtgagagaccctgcttcaaagtataaggtagaaactgatagaacaagcattttgatggatacctctagcctctgggcatttgaacctgcacatacatgtctctctctatgtcacagtttgacagtgtatgtgtgtgtgtgtgtgtgtgtgtgtgtgtgtgtgtagggagggagggagagagagagagagagagagagagagagagagtgagagagagagaaagagagagagagagagattgagactagaacagagtaagtgaccaaatttaaaatgtttttctgtttaaaactcttcagaatgctctcatgtagccactcttgctccctgtgctgggaaagacgggctctttagggatctacagcacatgtaggaatttgtgtcacgtcttttctctttacctggtctgctatacttccgtgtcaccatcatatattgcaatgggctactctcccactgacactcccccttgagcagcctggcaagtcgtgcatgtcacatagagtttatgataagatattgttggcttttttgcttaatgcaaagtcatattccactagagaaaatatctgtttatctggactatcgagactgttttagagaaagctttgaggtcaaatctctccaagtaaggcttgctcttgccacaggaggtcactcttgggtagtctttgaagcttaattgagttgatgaggaacactgactaataagaaagaagtctccctatagtaaatctgtgtgtgtgtgtgtgtgtgtgtgtgtgtgtgtgtgtgtgtgtgtacatatatagtaaatagaaatgtaaagggttgtgggtcaaactaggtgcttaatataaccttttttttcttgattatatatactctgaacatgtggtatcaaaaaattggaaacttggaaagaagaatttaatactttatagcattagagacatcagtaggaatgatttagtgtacttgatgtcctgagaattcacatacagatggcggcttccaaggcttgtcctctgaccttcacaggcatagggtagcctgtacatgcctgcactcacacccatactactaacaagtaacatttgaacagtgtatatatggagagattgctcagagagtaaactgcttgctgtataagtgtgttgccctgagttttacattggtgcccagcaccaatagaaaagctcggtgtgtctcttaacactagtgagacagagacagacagattccaagggcttgctggccagccagccagtctagccataacagtgaacttggggttctgtgagaggcctggctccaaggataaggtggaaagtgatggaagaagacacccaacaccacattctggcttccacacataacaggcaccaaacatagtttttattctagctctttccacctccgatttcaatgggatttgttgtattaacctctcttatgggggacacatcgagtctccattgtgtatgtggaattaattccatgcagctttctcaggaaatgataatagtatagcgacctaggggatttggggaaggaatctttccctttcgctaatgctgcataaactagcaagtcattgacatgtctggaactccacccagatcaggtgtctatgggcctcagtgccaagagccacagagctcactttctttccctggcctctctgcctttctgcctgcctgcttgcagtgggattataaggttacacctggacttagagcttcaaccacaaactgtagtggcttccactgctgtgctgtggacaaggggcccttcctgtttcataccacacaaataaatagaagttattccgtatctacattttacataatctgcccaagcatcttttcttgaaaaaaaaaagctgtctcatgttctgagagcccaccttttcttaattggagtttaaaaggctgatcatgaaattggcatgtgcatagtatatacttgaaaatgattatggggcaaaaagttttacctgccttcaaattatagacttcttctttgaattaactgtttaagtagggaaacttggtagatggacagtgttagaaaggaaagttgtctgctgctatgactacggtttgggttcctgctgtggttttcttgaaatgaattttcaggttgtatactttgcctagtcatatcttcaatctgcctttactgtggaagtgcaattttagtagctataaattcatagcctgactccagggtggatgctgagaatttctgacattcttttctaggtaacccgtctttaccctttacctcttttaagacatcatattttccgtagttttattgtacttgcttaggggattcatttattcagtttattgctcagaggattagagtcttccagtagttctagaaaattctcaggcattgtttccttaaagtatgcgtgtgtgtgtgtgtgtgtctgtctgtctgtctgtctgtctgtctgtctgtctgtgtgagagagagagagagacgggtggggggagctccagaggtcagcctttggtgtcattcttcagcagctgtctgcctgtgttttctgagacagactttgtaactgtgacctagagttcccagttagtcagcctacctaacccactaccacaggaatcctacctctcccaaaactgggataacagacacataccgcttcaccaagcttttaggtaattggtagggctcaaactctgaacttcgtgtgtttgtgtggcaagcactttacctgctaagccacctcccatcctctttttctcttgacagaggacagctagctacttctgcctctttgcactcagttcttcatgactttaagctcattttacatgtttctgatctctccctttttggattacattctagactctaacttcatcttacctttaatccactctatctaggtttttgcattttgttggctgctatgtttataagttcaataaaatttaaatatactattttctatttcacacacaaaaaaacatttcttttctcccaactctttttttaaaattattactatttgtaagtacactgtagctgtctttagacactccagaagagggccccaaattttgttacggatggttgtgagccaccatgtggtttctgggatttgaactcaggaccttcagaagagcagtaagtgctcttaaccactgagccatctctccagcccttctcccaacttttgattgggcattccttattacccttttattcttatccaggcatccattttattgttttaacatgaaaaattccttcatcttcattttcaacttattccagtggctcattctttggtcttatgattttgttacagctgtttctggcttccagtttgagtgtcttgctatccttggatgtcttatgtcccccccaccccccagcccttttgtagaatcctgagatgttgtataatcctgaaaggatttgcacatatttcttttgagttccttgaagaactaccccaaattatcacttttagattcaactctctgcttgtgggttttcatcccatacataatgggaactgaaataagcagccatcaggtgagctgagatgtggtttagcatgttctaaaaacatctgaccttcacccagaatcagaaatgaggcaaggtcaatgcccttcctgttcccataggggcaggacactatatacgcttatctgacagctgcacatttggtcatattgggtaaaaggtattgaggctgtgagaattatgaccgaataagttgtatgaagttccatatgttctagcaatttatctcctagattaatgctcagaagatttgaagaaaggggttcatctatgcatatgccaaaatgcatagccacacaattaatagatatggggtttccttttgcttttgtgatatgttttggaactagacagagtttagtagctgtatatcattgtgaatacacttaatgctgtaaaaaatacatatgctatatatattttactataattttcaaaactactagtcatgttgaaagtgttcagactttggacatggtacactgagtgaagtactaacattgtgtgtgtcatgttgctccctcagtcacaaaaagtgagttttctcagacagttgtctacttcctttgtcttgatggaatcacatactccttttgtagttgtcatctgtagacaacatgatgaataggcctctatgaaatgaatatcttccatgcactgcttctaaatttcgatatatttgtgttagtccctccattttttttaaacctgaattatactgtgattgatacttgttttaaaaattaaaacagggaaacccttaatgccacattgtactggtgcactattttgaaagaggtttcataatcagagtgtatttttctcagacaaacccaaaatgtcatgggctcactccctaccctgacttcccattctctcacatgcacactcgggttctcctgggtcggaaacaatgaacagtcacactggatggcagaggaactagattcaggcaggcaacttctgacaatgtaatactctactgttatgtggaaagttttcagttgagaaccatgcaattgaggtttatttttaaatctcactttttatattgtttgataatgtcatacatgtgtataatatgtcttcctcaaatcctcactcccctctctcacctccagttttgctcctacccccctccacacacacttttccttcctaacttcatttgttattttaaaacttgacttgagctgggcagtggtggggcatgcctttaatcccagcactcaggaggcagaggcaggtggatctctgagttcaaggccagcctggtctacagaatgagttccaggaaagccagggctacacagagaaaccctgtctcgaaaaaacaaaaaccaaaccaaaacaaaacaaaacttgacttgagagatgacttagaagttgagaacactggttccttttccaaaggaccaaggtttgattcccagcccttacatggtaactcacacccatctgtgacagttccaggagatccaacactctcttctggattccatgggcacagtacacacatggtacaccagtcaatacatctatgcatataaaacaaaaataaaatttaaaagaccttcatgttctgagtaagtttacaattttgtgttgggcagtattcatagttgtccttggctacatgcagcctatagattttcaggttgagtagtacatctccacagaaactcattaagcctaaatgatgccccttttcacaaggctgcagattgcctgggtgtactaacaaagacgtttatccctaacttggttccggaaaccaagaaaatgtctaagttttaagcaccttgtcttaagttgttcctgtgagttttaaatgaactcccaaatcctaacaaatgcagtatcagtttcttaaccaacagtcttatctagctgctagggtgccctgacatatgtggtaagatgcaatagatgcaaagttcatcattagcctgtttttccatgtagattgtgtggtatagggtctcaactatgcctggtatgacaagtgtggcccaatccttttcattaccttcactgtggttgcttgctgaatatttaaaatatgtttttcaaaaatagattttatttttgttttcagtgctaggggtggaattcagggactcatatatgctcatgaaaattctgtgacagagtttctcagtgagggcctgcctggagttcactaaatgggctagcatggcttgccaacaagacccagggatctgccagtttctgattccccagtgctaggattatagacatctgctatcattcctgactttttaaacatgagctctggggattgaacggggtccttattcttccaaggcaagcatttcccattgagtcatttcttcagcctagtgcccagcaatatattcttagacattcccttgcttctttccacagggttacatcaattgcagacagactgaatgtggaatttgctttgattcacaaagagagaaagaaagcaaatgaagtggaccggatggttctcgtgggtgatgtgaaggaccgtgtggccatcctggtagacgacatggccgatacatgtggtaccatctgccatgctgcagataagtacgtagggttgctcagaatgacaagagaacatctccttaggaaagaaaaacatcattttaaaattttatttgttgttcatatatgtgtatgtgcatgcgtgcgtgcgtgcgtgcatgtatgtgtatgcatacatatgcattgggaaggcatatgtgctatggtgcaatgctgggagtcagaggatgactttaatgagctaattctcctcttccactatgaatcacaaagattgagctaagattgtcaaccaacttacccaccaagcatccattatttgaaatttagcctgcttttcttttcttttttttttcttttcttttttttcttttttttctttttttttttttttcttattacgtattttcttcaattatatttccaatgctagcctgcttttcttaattgttgctgatgaattgacagtggtgttttaggccaaaggaaacaaacaccaccacccccaaaagcccatgggcttttttttattttccaggttgggctttcaggtcatttttgaaagtcaagaaagtttccctagaaatcagtcccagaaagacaaagataagatgtttgtttgttccatccttgcttccttcagctcaacttttgggctagcttcatagctcatgtggctataaagctatacttggaaggcaaggagcctctccccactcccttggctacacttggctgtggaatccttgttgagatgctctcgctgtctcactggtaattttctgacttgattacttatcatatgttttggcactattggttgaaatcagtggttctcaacatggaatagttggttccctgaatagtatttgacaatctctaaagttgacattggttgtcacatttaaagacatgggagtgttgctagtgtgtggactaaggatgctgctaaattttccttacaatggacaatctagccccctgagacaaaaaaaaataattatgtagatataagtgtcagggttgatattctttaatttaattgaatacaaacattgtgctaacatatacatttaaaagattgtagtttgggataataaatgcagatgaattttgtcccatcctttcttttatagtgcacacttttcacttgtaatgttgagacaaggtagactatttcaagaatatttaaatatttgtggacacgtaattcttttgagatgagaccttgctcagtagctctggcttgttttgtcttcctgtcttggcccccctagtgctagggttacaagtgtacactacatctagtaactttttgcctttttaaaaatggttttagagctttattgtagaaaggcaggggggaagagagaaggtagaaagagagagggagaggccagccatggccacatggagagaagagggaagagagagagagaaggaaggctatagagtaagagagggaaaaacttagagagcaatgttttgtcttttattgtgcaggttactctcagctggtgccaccaaagtttatgctattcttacccatggaatcttctctgggccagctatttccagaataaatagtgctgcctttgaagctgttgttgtcaccaacacaattccacaagaggacaaaatgaaacactgctccaaaattcaggtactatctataccccaggcagatccatgcatcaaggcacctgcttcagactcttcaatattatccagccttctgtttgctaaggcagatgctagcagagaccaaagtttctcatcccaatggaatatcagtcagcttagatctctcagaaatgccaaaattgagaggtgaatggccactatttggaaatagccaatgggaaaaaaatgaaggaaggcaggcaggcaggatggaaggaaatggagaggacaggaggctgggatggaatgctgttggtagagcacttgcatagcatgcatgagtttgggtgttccagtctcagcaccaaataaagtagttgtggtgatggtgcacacctataatccctgcactcaaggagatggatatagtaagatcaagcactcagagtcatcctcaaattcaaagtcatcctaggagggatgaggcattatctctttaaaaaaaaaatgtcaaaaggaaagaggaaatgatctatgtagggtggtacgtggaaggtgcaggagtatcatgagaccaacctgagctacacagaatcttgtctcacaaacaaaatgaaatagccactgggaccaatggtagactgagagaaagaaaagaaatggcaaatgaataaaatcacaaaataaaaacaataagagtagaaaaatagcttgatgtagcacttgcctagcatggccaacagtgaaaaacaaagttgaacatagacttactctataggccaacaactctatccctaggtaaatagtctcctgaaaatggagtgtgggcaggtcaactggctgtactaagcatatatagtgagctacttcttcatgcccctcctgactatatgccacttaaatgtggaaggagaaaactgactctgcaaaattgtcttctggcctccatatgcatgctgtggtacatgtgtgcccagccacacatatcacacacacacacacacacacacacacacacacaaaactaatgatgatgatgatgatgacagtaaataaaagaatttttaaaatctcattcattagtattccaaattgagatgtagccaagtaaaaaggtagcttgtataagatttgctttatattctatgaaaaacattgccgtgttttataaatggatgctaggattatagtaaaaacttaagaaataaaaaatgaaagttataacatagaaaaagcagatttgctatattttctagagtaaaacctctgcaaatgaataagaaaactaagttttaaacaaccagtatcccgagaagggaccatctgttgtgggtagcagcacccctgagtgttcacactgaaaatcttcccaagagcgatagttggctcagctggctgtgctgtctttgaagctaaaacccacagttgtttgttgttccccaaagaaatgactgaaggaggtttgacaaaaaacataccatatacattctggcttttcagcttttaaagaaatagaactgactccctgtcttttgtgttttccctgtgttattcaggtgattgacatttcgatgatcctggctgaagccattcgaagaacccacaatggggaatccgtgtcctatctgttcagccatgtcccactgtagtctggattggaatattgaagatggagcaagcctcctccaacttctcactgtctttgtctgcctgctgttttagaattaggactccgcaattctaggatgatcactggcaaaagcatctgatctgtgtccactctaagagccctctgtctctccttctaaagctcaagactactactttccagtcctgggggagggcagagaaaggtggtggttatttggtcgttaattgaactggtgtcaatgagaactcatcttttccctcgttcttttttagtactttgaggtaacaacttttaagcctaaaatcccattgtggaaatttgtcatacatacattttgaggatgccaaaggtgatttcaaatgaaagccttctgtgtaaatatataataatgcctgtggatatttggggggaaatcctaaataacctttatgtcagagagaaccttggaaaatttatactatcatgaattttgaaattttgttgtttttttcttaatgataactgggtttattttattgccctttatcaggactgaattttattgggcctaagatagccactgacatactgacttttcttagtagatattagacatattaaagacaatataaggctgtatcattttttaattgccactttgaagatatatcataaatgacaacttaccggaaactcccaaattatgatcagtgatcactgatttggctaccatttcaggctgtagtcaatgagtttgtgaccacgttgatgcacaactttgtctatcccaggggaatttctctttagaatgtagctcatgtcctatcaccttattctcagacgttaacaatagcctttactttccacattccccaatagtttcttgttgtagatgtccaccaaaagaaaggctccttgaaaccccctcacatattttaggttgattattattttattttttcacatacataaaatggggaggatttaagagtgccaccaaatacacttattcaaacagagcttactgagcttgagttaaatgtcctttggccctttgtcatcagaagaactccatctctaatgactagttagcatctctaaagctgctaaaatgtagacaggagagggttgcaaaacagtggaggcaaaagtaaatagctgttccattaaaataaacttcaaagaaatgcttcagaaagcattgtgaagaagaatctcattgtgggtggcattcttgataaaatgatcttttagtgaagtgtggaggtctgtgcccgtaatcccagcactttaaaactaatgcaggaagagtaccacaagtttaaggccagcctaggctacacagtgagttccagctcagcttggcctggagagctgagactgtgtgtcataaaacacaaacaaacaaaaggcatcagtaagtgcacaacctatcattttccttctcacaaagaagaggatttgcctgtgtacctaaagcttaggaatgcttaaaaaaaaatccccccccccttgctgagtattgtagataaattcccagccctaaattttgcaggtaagaaattcctatccatctgagtagcacactcaaccagcactctggaacagcagaggagcagaagtcaaatcaatgttacaaagtataatttatgttcctatagagactggcattttgataataccttatttgtaactgttctgaagaaagtggttcctataacctgggatgctcagctctgtggtacagtctgtctcaggcttggttagacatgtgtcaaaacttgtttgagatgatgcagctgttacttgtgataaatgtgcgatgtcttaatttcttgggttttatggctgtgctgaagacattcttgtgcatacccacatggagatagctcagtgtgtgtgtgtgtgtgtgtgtgtgtgtgtgtgtgtgtgtgtgtacatgtcccaaagcattggcatgacaaaagccagttggtaatcattttatctaagatatttaaagcttaatgtgtaccatggatcttaaaataagaatcttcagttttaaaaccctgtcataaaaatctgcctggctgtcctctgaatttgagaaccaattgtttctgtccttacttggcctgagttagtattttaaagtacctctgaatacatttgtgaactaattagactggactgggccttatacagtggaaatatggttttaaatattggtttcagtttggctaaaatgacgaaggctgcctcatgagcagccttatttcagaactttcttgttccttgctgcttgtggtaaagaaacataatggaaattaccaaatagatcagctctgtccaactctatgtaaggagagcatgttagtcatatctacccaaaaaggggagccaggaaatagtgaatataccaaagttgtttatcctccacataattttattagtttacttatagatgttcatatgctaactttcctttgttagatacaatgtcgactaaattcaggacatttcttgcagcgcttgccctggttttagagactagagaattttgagatctggtgccatttactaagacatttcaataaaatcatgctgactactttctttca

SEQ ID NO: 375 - DNA, 1296 bp, mus musculus
tctgcctcacctgttgctaagggaagagtcaaccacaccaaaatgagtctgcatggtgctcgtgggggccatgagagatcaagaaatagacgaaggtcaagtgacagatcacaagattcatctcatgagagagcagagtctcagctcactccttgtattagaaatgtgacaacaaggcagcatcatattgaacgagaaaaagatcatagttcttctcgtccaagcagtcctcgtcctcaaagagcatccccaaatggctccatgagcagtgctgggaacagtagcaggaacagcagtcagtcaagctcagatggtagctgtaaaacatctggggagatggtgtttgtgtatgggaatgcagaagaagggcctgggaatgggaagacatctgagcgagtgaccctgatagtggataacaccagatctgttgtggacctgtccatttttactgcacagccaaatacaatgttgggcaggatggttggatctggccagaaacataatttcacatgtcccaacgagaaaggagaatatgaggtggcagagggaattggttctactgtgtttcgagctattttggattactataagagaggaatcatcccctgtcctaatggcatatctattcctgaactgagagacacatgtgattacctttgtatctcttttgaatacagtagaattaaatgtcgagatctctgtgcccttaagcatgagttatcaaatgatgggactcatagacaatttgaattttatctggaagaaatgattctccctctcgtggtagcaagcatccagagtggggaatgagagtgccatattgtagtgcttccagatgatgatgtagttgattgggatgaggagtatccaccacagatgggagaggaatattcacagattatttatagcacacaattacgtagatttttcaagtatattgaaaacagagatgtggtcaaatcagttttgaaggagaggggtcttaagaagattaggatgggaatagaaggctatcctacctacaaagaaaaggccaggggggccttccagaagtcatttacaattatgtccaaagaccctttattcatatgtcctgggagaaggaggaagggaagaatctgcatgtgcaaagagaaaatccattatcaacctggcagcagctgctgcagacattcccctagaccagctagtagtcatgcaccctactccacaggtggacgggctggataccttcccagccaccacgcctcgggcaacagtgatctccatcctgaggcgcagaatccaatgctgtga

SEQ ID NO: 376 - DNA, 1296 bp, mus musculus; identical to SEQ ID NO: 375

SEQ ID NO: 377 - DNA, 1730 bp, mus musculus
cactgcctcccaagtttcctgtagtggatacaccgcccggctgctccactccgctccacccaacattgagggagacccgaagaggccggagccgaggactttgggctgggttttctggacagaaccagcaggcgcctactctgctctgggtggggagagtgaggattcggtgaactatgaagggccggcggcggcggcgccgagagtattgcaagttcacgctgctcttggcgctgtacacgcttttgctacttcttgtcccctctgtactggacagccacagcgagcaggacaagggcaggaactgccccggcctgcagcgcagcttgggtgtgtggagcctggaggcggcggcggccggggaacgtgagcagggcgctgaggtgcggtccctggccgaaggaaacccggatcgatcccccgggtcccccggcaacctcagcgccgtcggtgaggcggtgacccaggaaaagcaacacatctatgtgcatgccacctggcgcaccggctcgtccttcttgggcgaactcttcaaccagcacccggacgttttctacttgtacgagcccatgtggcatctgtggcaggcactgtatccgggcgacgcggagagcctgcagggcgcactaagagacatgctgcgctccctcttccgctgtgatttctctgtgctgcgcctgtacgcgcagcctggggaccctggggagcgagcaccggactcggccaacctcaccacggccatgcttttccgctggcggaccaacaaggtcatctgctcgccgcctctgtgccccgccgcgccccgggcacgcgcggacgtgggactcgtcgaggacaaagcctgcgaaagtacctgcccgcccgtttcgctccgcgccctggaggccgagtgccgcaagtacccggtggtggtcatcaaagacgtgcggctactggacctgggagtgctggtccctctgctgcgtgacccaggcctcaacctaaaggtggtgcaactcttccgagaccctcgggccgtgcacaactcgcgcctcaagtcgaggcagggactgctgcgcgaaagcatccaggtgctgcgcacgcgccagaggggcgaccacttccaccgggtgctgctggcgcatggagtggatgcccgtccgggaggccaggcccgggctctgccctcggcgccacgcgctgatttcttcttaaccagcgcgcttgaggtgatctgtgaagcgtggcttcgcgacctgctattcacccgcggcgcgcccgcctggctgaggcgtcgctacctgcggctgcgttatgaggacctggtgtggcagccccaagcccagctgcgccgcctgctgcgcttctctgggttgcggacactcgccgcgcttgatgccttcgcattcaatatgacgcggggctcggcctacggcgccgatcgtcccttccacttgtctgcgcgggacgcccgagaggctgtgcacgcctggcgcgaacgtctgagccaagagcaggtgcgccaagtggaaaccgcctgcgcccctgccatgcgtctgcttgcctaccctcgaagtggggacgaacgcgacaggaagaccgtcagggaaggggagacaccactggagaccaaggccaattgggctgtgtaataccctgatccctgaaccctgccccggggcgtattcaggtaaagtgacacagtataaggaacagtatttggggagggggaatcctgaaacaaccagcgg

SEQ ID NO: 378 - DNA, 1730 bp, mus musculus; identical to SEQ ID NO: 377

SEQ ID NO: 379 - DNA, 37982 bp, mus musculus
cactgcctcccaagtttcctgtagtggatacaccgcccggctgctccactccgctccacccaacattgagggagacccgaagaggccggagccgaggactttgggctgggttttctggacagaaccagcaggcgcctactctgctctgggtggggagagtgaggattcggtgaactatgaagggccggcggcggcggcgccgagagtattgcaagttcacgctgctcttggcgctgtacacgcttttgctacttcttgtcccctctgtactggacagccacagcgagcaggacaagggcaggaactgccccggcctgcagcgcagcttgggtgtgtggagcctggaggcggcggcggccggggaacgtgagcagggcgctgaggtgcggtccctggccgaaggaaacccggatcgatcccccgggtcccccggcaacctcagcgccgtcggtgaggcggtgacccaggaaaagcaacacatctatgtgcatgccacctggcgcaccggctcgtccttcttgggcgaactcttcaaccagcacccggacgttttctacttgtacgagcccatgtggcatctgtggcaggcactgtatccgggcgacgcggagagcctgcagggcgcactaagagacatgctgcgctccctcttccgctgtgatttctctgtgctgcgcctgtacgcgcagcctggggaccctggggagcgagcaccggactcggccaacctcaccacggccatgcttttccgctggcggaccaacaaggtcatctgctcgccgcctctgtgccccgccgcgccccgggcacgcgcggacgtgggactcgtcgaggacaaagcctgcgaaagtacctgcccgcccgtttcgctccgcgccctggaggccgagtgccgcaagtacccggtggtggtcatcaaagacgtgcggctactggacctgggagtgctggtccctctgctgcgtgacccaggcctcaacctaaaggtggtgcaactcttccgagaccctcgggccgtgcacaactcgcgcctcaagtcgaggcagggactgctgcgcgaaagcatccaggtgctgcgcacgcgccagaggggcgaccacttccaccgggtgctgctggcgcatggagtggatgcccgtccgggaggccaggcccgggctctgccctcggcgccacgcgctgatttcttcttaaccagcgcgcttgaggtgatctgtgaagcgtggcttcgcgacctgctattcacccgcggcgcgcccgcctggctgaggcgtcgctacctgcggctgcgttatgaggacctggtgtggcagccccaagcccagctgcgccgcctgctgcgcttctctgggttgcggacactcgccgcgcttgatgccttcgcattcaatatgacgcggggctcggcctacggcgccgatcgtcccttccacttgtctgcgcgggacgcccgagaggctgtgcacgcctggcgcgaacgtctgagccaagagcaggtgcgccaagtggaaaccgcctgcgcccctgccatgcgtctgcttgcctaccctcgaagtggggacgaacgcgacaggaagaccgtcagggaaggggagacaccactggagaccaaggccaattgggctgtgtaataccctgatccctgaaccctgccccggggcgtattcaggtaaagtgacacagtataaggaacagtatttggggagggggaatcctgaaacaaccagcggggttcggggaggggagttgaagggtggttagaggggtcaatgctgtcctgaatcacaagctatcagatcacatccaagatcatgtcttgtttgatagatttgaggtgcttcagtgagttcgttccttaccttctcagaggaggtcttggaagtgagagaagttgtgtaaaggtagctgaagcagcctccaggtctgctctcccagccccctttataaggcatctaaagtccaaagccagtagagaaagtctaaagcaccccaatgcaacttgagaaaggtaactaacatggagtggagtatagggtttaggaagtccttccaggcatatgcctgtttatcctgtgggacaacattttgccatggttgtctgctgtcaaaagaaaagcaaaaacaaggtgttgtgaaaaagtttgaatttttgctcctatttatccttaatttttctgtctgatatttctttgtctttctcttctacagctccagggctctcctcctgggtactaagcacacaggcacagtaaggcagctcttgcaacacatttgtgtgtttccaaccctattacaaacaagtagaactgacattcctttcccctggcttcgtgggcccttttccctcttctcttcccctctctcagaggctgactgctgtttgcaggatatctgaccacaggtcacaaaagctgcttgatcagcttcctctggtgctctaagaaggctgggctgggttttccccaacttcatcatggcatttttttttttttgatagatggggctttagactggcagttaacaatttgtcaagtaaacccctctttttttgccattttctataaagtggttgctaaaatggcctcaaaaaggctctctctatatgtgtccagtattgagttaacagatggcgtgtaacactgggccaagggaagactgttctgtatgatgctcaccataggaatctagtcagtggcatgggaatgcatttccccaaaccctgtgaattggaagagtgcctgctgccttctgtacagtgcagaccagaggaggaagaaaagcattgcaggaaggccggaagtgacttaagtttccattcattattttatagtgtaattcagtattccctggggatggactggagggacaaaggttgaagatgttaatgaagatggatttttttttcttttttctttttggttagtagagtggtttggggaagctggctaattgaatttgcttctcccagtaatcaaatcagtttttgtaattgctaggaagtctgtcttctttcctgattttcatagagaaggaaagtaagacacagggtgactcctcatcttaacaaaaccatcctattatcgtagccatatttacgtaggaaacataatggttcctaactcaccatcacagacttcaagacactcatctcctggtcaaaagctgtagcattttatggttttaagacatgagaatctcctagaaattttgttccacagccttctcccaatttgttccaacacactatatgatgcctgaggcagggtgatagagaggagtgtagaggactttgtaccctaggaagtgcaaatgggtgtgggtgacagtgactgtgggcaaagatggtggtactgctgtttgaaaggcttgtgcagcttctctgtagggctgcaggcacatctaagtagaagctttaggctctagtaaactttagtggctgagctcttccttctgcattggacacttaggatcaatatatggacatattaaaatgtttgtattcttggctcctaggcagataatcttgttatttttctcagaacccaccacctattagctgacttccttctcactggctaaaactagctcacatggcttgccctatgccaataattgcataagggaatggatgcattttgagtgtctcataatagcagttctcagtgctgggtgaaagttacagttgacttcccctaatctttagtgggtatatttctaagactctcagataatatataccttatatggaccatgatattctctattgataaatatctatgagaaaatgtaatttataaattaagcatattgaaatgttaacagcaataatacaatagaataatataatacaaaataataatgcattgtaataaaaatttcatcagtgtattgttactgggctgccataagacaggaagtgtatatggtgtggatcaatgtgaatatgctggataagggatggtttccatttcagacagaaaacagcagaactgcatgtcagttcatcctgctacccagagcaacattgcaaagcttataaatgatttctgcaattttctattcatatttctggactatggctggcagtaggtaattggagcccaagaaaagaaaactatatggaaaccttctaccactactatacatccagctctgaggagcttttagaaaaatgcccatacctaagttctcccctgctccagagatgttttgggagtagattggtgttggagatagaacccatggtcctatacagtctataagcaggtgctctaccattgaacttcaccccaagcctaggagatctgattcattcactctaccatgtggtccccagacccaagcataagggttttcaaaactctcaaggtaactctactgtacagcccaaactgcaaaccacttggcttggaccaaagattcattccctgggtcaggccacttgcatgggagcaaggtcagaatggggagtcaagggctattgataagcagcaaaatgtgccatgttttatgtgaaagaacttaaatctatgaagttctttgcagataaaaggtattgttatggaaaaggaaattacacacatgactgtttatcacctgcatgtgccttcagatgttttgttgtctgtagctccacatctaagagtctgtcgctgcacaagcactacctactcctgttcggaacagcctgatatgctgttctgtccttcgcagcatgtctccctttgccttctaccacggggaagattcatgatgtcttagttagggtttctattgctctgatgaaacaccacgactaaaagtaagatgggaaggaaagggcttatttggcttacacttccacatcactattcatcactgaaggaaaccacaaggaatcaaacaggacagggatctggaggtaggagctgatgtagcctccatagagaggtgctgcttattgatttgttctgcatggcttgctcaccttgcttccttataggacccagaaccacaagcccagcggtggcaccacccacatcaatctctatttaagaaaatgccttagcagccagaatgggggaattttctcaattgaagttaacttccattcagataactctagcttgtgtcaagttgtcatacatacatacatacatacctacatacatacatagccagaatacaagatttcgtccaagctgtcgtgtgtgtgtgtgtgtgtgtgtgtgtgtgtgtgtgtgtgacccagctttaagcatgctgaccatgtattctaccactgaattgttcccacaatgccctaagatgtttaagtcacttcagtctttgttcttgataggatttatgctgctgttggaagaaactagagccagagtcctaacaataaggaaactttcccagaaatcattctaaaacaaagaaatgacaagccaccaccattttggaacttatttgatttaaatcagtgggctgtatcccaaagttttatgtgatattatgtatatttatcattgaactatccgcctttggcttaaatgcagactactgaataacacccattttagaaacactgcttctatatagaacttttgtttgctctgactctcaatagcaaattaagctaagtactgtgtttgaatcagaggacagaaaattaatacgatgggttgaggtggtggtggcagtgtgtatatttgtgtgcatttgaaaacacatagatagtgattgtgtatgcacacaaataggtagaaatgagcatcaggttttcacttatacatggacaattttctaaaatgtacccatgtccaaaatcattattaccctatatgggtaagatctgtgcttagttttgattcagacattctgagttctttccaggctgtcttcttagcaagacccctcagttaatggtgggtttggtgtttgtttagtagtactcctcaagtctggtgagtgagacatgggaggaaactggttctgcaaagtgatgtgtaagccaaaaatactagcagccagtctttgatttctatgaagtcagttgttacaccggggcatagggacccagactttggggtctgggtctcttggttaacagttgattaatttaaagagattatttgctaaggatgtggctctgtcatcaagcaatgaaaagcaaaaagaaaaaactctagaacgacttaaatgtcctgcctacactatggcatcaggaactaggtaaatatgtcataatacattctgacaatgaaatacaacataaccacagaaaaggagatagcatgaaaagattaccaaagcacgaaacgtgaataaatacagtttagtcttacttaagagtaagaagccaatatatttgttggcatttgcatgaaataagtctcaacacatatggcacaaaaactacagtggtgctttggaatggtgctccgttctaggaatggagactggtatcttttgtgctgacaaattctttttcttacctcatgtttctatgatttttatacatttgacagacatttgttttaaaactaaggccacattattttaaacctatggatgtgtgagcttgtttgatcacccaaaatatcaagccaagaagaggaaggagataacatgtgttcagcaaggaacacaatgcacagaatcggcatttactgagtatcacttcactttagaatccttttgaaatcctcattccactaattgtgctggggatggaactcaaggccttgcccaagctaggcaagcattttaccactgtaccacacactcccaacgccttgaatattttaaggcagggttcagagcattttctaaaagtttgtttttagtttgggcagaagtttcttctttttctcataaatacaaatgcagtataaataactagaagtggtgcctttaagagaaaaaaatcatttaaaagcagctggtttagaattctttaaatattcctcttcttagcctgctcccagcatgagaagcccagaaagaatgaaactaaagacactcactggccttgttatgttgcatctaacattctggtccaacagggtggctcccaagcaaagctcggtttctttctgtcaggtcttctggctccccatccttaatcttccaaatgtaactgaaggaactgagcctgctgaaagcagagtctcagggtgagtgcagtatagcataagaacagtagagactaagaaactgttctggcccaaattcaagaacactgggaagtggtgaattgtttggaagctgaacaggaagctgtttcaattggagaaaagttgcagagctcagtgatggctccaggagaattagagtccctcagttctgctcccttccccttccatggccaggcatcaagccaacagccagcctgatatttctgcagctggtcttgttcatattaaagagcattctgctagaagctaagaataaattagagtattagccagtggtgaatgttaagagcagagggtaagaggctatgaaagagaaccatcacatttgatttaagtactgactgtagtctgagtcaatagatctcctctcatgaactgaacaggacagtaaagactgccttgtagaatcacaccctaaagtaggcatggagatagacatatgtttgcttatagatttgaaccttttctgtaaagatggccttacagctagaatgccaagctgctggaaagacaatctaaggaaggcagtttgccaactgaggttcctcttcacagataattatagcttgtgtcaagtaaacagaaaaaccaaacaagacattaggatgtaatggtgtttcccaaaaatggcaggtcttagatataggaaaactaatgggagtgtgtttggctaagaaatccaaacatgtttattcagttttgaccactagtgctatttgttcatttaatcaccactataaaaatccataggcatggaacaacattatgaactaaccagtaccccggagctcttgactctagctgcatatgtatcaaaagatggcgtagtcggccatcactggaaagagaggcccattggacacgcaaactttatataccccaggacaggggaatgccagggccaaaaaaatgggaatgggtgggtagggaagtgggggggggagggtatgagggacctttgggatagcattggaaatgtaattgaggaaaatatgtaataaaaaagaaaaaactgtaaaaaaaaaaaacataggcatgatggaaaatatattgcaggccaaaaagtatacataaatttaaatattatccgttacaattggttccacaattgctatgtaatgtatcaggaatgtcacagataggtgtaactttttaatggaatttttttccactgttaagtctggttatttataaagaaaaacattaagccaataaaaaagcctacaaaaaaaaaagcctacaaacttagcatttggataaaatctaatcccattcgatgccaaactctgtcaatgcaaaaactcacctcaaagggaacaaggggtagtttatgttggagcaaaccatatgtgatcctggcaccaaacatgcttatctcaagtatcctatcccagtgacagcagttttgtgaagttgtcagtgtcagaacaacagaacatacaaatcaaatcaatttcgagacacattggtgggaatattgaaggaggaggttacagcaaagaaggaaataatgctataggcctcaaatgctctctgataatgttcttagcagttgagttggtggaagttaatggtctgtttgtacactctaaaacactgttacctcatagcctcagtctgaatgttccttcaacaccaaacagggtgtaaaggcacagggagtaaaggcaactctatgtaacttgcctcctgctgggtagcattctggctctccataatcactgaagttctgatcaattacctcagccttaaagtgcctttagcacacaggtgctgctttttttcccttagaactttagttcgcacccatgtgggaaccaaatggctacctgagtaggtctaaagtctagtcgcttccccaaccgacgccctcttaagccttttcaacctcaagtggaagctagccaacatctgcagggggcccatctgaatagatattataaaacacgggcccattcctttacctcagttgagagcagctttactcaaaacagcaaccacatttgccaatggaaatgatatctcagaactgttcaacaaaaggaaaaatgtcaaacaggcaaactcagctgtttcccacttttattgttttgttttggtttgttttgtttttcagttttatttttaaaactgaggcatagtgcctggggatttggctgagtggcagagcatttgcttagcgtatgtgagattctgggttaagtcccagctaataaaaatacataaaatcacaaggattggggaactgaggagatagctacacatttaaaagctattgaagaggacccagattcagtttcaaacacccacaccagcttaatccactgtaactccagttccaggcattctgatggcacgtgggcacttatgtgctgctaataaaatcatgcaggcatgcacacatacattttctttataattttttaaaaccataattgtatgcaacaatcagttctattaataccattttggtgtgcattaatttgttctccagcaaggttagaaatttgaggaattttgaattgtgggagttaataataaaatgtcatgggctggtgagatggttcagcagttaagaacactggctgctcttccaggagtcctaagttcaattcccagcaaccacatggtggctcaaaaccacttataggaggaactgatgttctcttcagtcaggcagatgtatatgcagcagtgcgctcatacattaaataaattaaattgtttttaaaaaaagatttcattccactttagtagaggacatatagcagccatttaatcttggccttggccttggccaaacccaggactaaagtgatcaagtggactgaaatgtcactctgaattcctgccatgatggctagatggtagggagagcaaaaccaagatcttctcagtcattctctctggagctacctgggtccctagctctcccctaacgtccacataaacttcccaggcaagagttttctggttttgttttgtttggtttggttttgactcaaaccatttttttttttttgcctgaaagttgttacaaataaataaggttgagactggcgtgaactagtacaaatattaaccagcaatcctttgtcacttccacttaatctctccgattgaaagtctggaaattgttttgacatttaacttgcttcaagtctgttttcgggagctgtgtgtgtgtgtgtgtgtgtgtgtgtgtttgtgtgtgtgtgcgcatgcatatgcacgtgtgccagcatgtactagcatgcacaagcctgcatttatcagcaaactaaccacttctaattatactttgtttcagagaggcaatagacaccagtgctctcacatgttggcattttgaaaattatcttaccattgcatctaagaaaatcctttacaacaaaacaacttaatggttctattgtcaacattatcagtcatttcctttttccttggcccagtatttcactgattggaagcacaagcaggaaggttaagaactgttaacctgggctgacagataagcctcagatgttagagtcattcactgtgtggtttccagttgggaagctaggagactccccagagctcatgggcatagaaaaggagactaccacacttgccagcccatttgctctggaggtggtctgggaggaaggttgtgacaataagctgggaagtagtagcgtagccctgatgatggaacatgctgaatacccggaaatctcagctctcagcccaagtgttaagggccagctagcactttgagcatctgttaaatagttttgggttgtcagtctccagggttcctcacctggtaggagtaagtggggagcaacaggaaaacgaagtgtcaatctccagcacataatcgccagtctccaggaaagatttgaaaggaagaaaggcaggtcaaacgttctaagtgaggtatctgggggaggctcagctccacttgggaggactgtggctcactccctacctgaactaaaagggacagaaagcaacagagaatgatgaagcagcaacttcaattggttgggccttctgttctcacactttaaaaccagcaggaagtttattcttgcccctccccctcctagcttcaaaggttggaaatggtatgattaaaacactaagtctgtcttcctgagttattctactacagccaggggagcctcagcagggccaaaagcctcaattgaggcaacacaaactacagcatacccagaaggaaatttctctttgatggcgctcaggccagttcattggaatatgactgaatctttaaagaagcaaatccattaaatctttagagaagtaaaagccaatttgtgatttcattgaatgttaaaaaatgacctcacaattccgtttattaagaccaattcttaaaatcgaaacaaagacgtatagaaacctttttaacttttgtttaaaactttaggtgttctgtcttttattaataatttgttttctgttatacaagcaagatttctttttttattaggtattttcttattttacatttccaatgctatcccaaaagtcccccataccctccccccgaactcccctacccacccactcccacttcttggccctggtgtccccctgtactgagacaagctagatttctaatactttcaacctgttcacgaacagatggatctatacttgcttcaggcagggtgacacatgttttcattctccccacactcttcatcattgtttcccatctgctgcctggaaaacaggacaaagtaaactactggggtctgtgtagcttgttgctaagtggattgtttcattttaaaaatatacactaaatttcatatttcattactccatatgaacatagccccataatattcttcaactggagtctggaggctggagggatgacgtggtggttaaaagcactggctgctctttcataggacccaggtttgattcccagaacccatatggcagctcacagccttctataactatagttccagaggatctgacactttttctggcgtacacaatatgtgtcatacattttaatacaggttacacatgcgacgatatacagtatatatgcagccaagatacccatatacataaataacattaaaagaaaagaatttgagtctggtgctaactaaaatcttttatttatttatttatttatttatttatttatttattatatgtaagtacactgtagctgtcttcagacacaccaaaagagggcgtcagatctcgttacggatggttgtgagccaccatgtggttgctgggatttgaattccgaacctttggaagagcagtcgggtgctcttacccactgagccatctcaccagcccctaaattcttaatatccatatttagggtgtatggcttaacagatttgggggagaacatcacaccaaaaaattcctggacatcattgttttcaaaacaaccactagtaagaaattagctgatagttgattaggatctacttgggaactgtcaaacccatgcaggtgtaagtcagcagtagaagctatctacgcatgctcattgtagttcagggaaattgagaacctgaggcacacacaggaggataggagcccattcctagcattcagaaagaaagaacctttgagagattgacacctgtataatgctctgaaggctgcaacagtttttccagcatgccttctctcccctcctcttgccttgttccactagtgatttaatcaaaagtttgaacttgagaatctggctatgcagctcaggggcagaatacatgcttagcatgcataagggcctgggattaacttatagcaatgccacaaagaaaaattgaagttgaatgaaaatgttaaaggttactttatatactaactaaaactattctttttaaaaccagtaagttgcgtgtggtggtacatgcctataataccagcatcaggaaggaaggagactcaggaattccaggttatccttggctacatagctaatttgaggccagcttggtatatatttgagaacctgtctcgaaaataactaagcataaagtaataaaatatttggacataaaaatctttactaaaagaatacaaagaatgtatggtccaggggttggctgagagtattctctataaatggttgttaggaaatgagatctgacttggcaacatttagcacgtgtttagtcattgacaaaacttccctgtattcctgccaggcttatttctgtgtctttaaagcaacccaagtaacacgctagacatactacacaaagaaacagtgataagaattttttttcttgactttccagtttgaataattataggttcacaggaaattgcaagaacaacatactcaggtccagtgtaaccttcagctaattttccccaaggggatatcttataaatagatgaatatcaataccagggaattgatgttggtgtaatctacagacttgttattctactttcaaggttttacatgcacttattttatgtgtatgcataagtagagatgtatatgattgtatcacatacaaatttctgcaaacaccactgtaaccaataatagaatcactgtatcaacacaaaaaaaaaatatggtgccaactgtttgtagttatataccctgccccatcctaccgttttcccattgataacactaatttgttctccatctctataatgcttttattttcaagaatgatataaatagaatattatttatatagccttttgatattggctttttcactaaatacagttctttgcaaataaacactcagatcatcttgtatggtgatagtttgttccttattgctgaatagtattctacgttatcagtatagtacttcatcatttaccaattgaaggacatttaaattattttgatcatttagaaataaagctgctatgtatattaatgtacaagttttaaaatttttattggagtatgttcattgcacatagtaatgtgttttatagatattatcatacaagtatagtattcacctgacttattgcacttaatattattatcttcagttgtatatattttctgataaatggcataatttcattcttctttatggctggatcaaactccattttatatgcacaacacattttccttatccattgattccatatgttggctattgtgaatagtgctgcagtaaaatagatgtgcaagcatctctgtggtgtggtcatttagtccttcagttatgtatccaggggtagtatagctgggccaaaggaagagagacagactcgtgtgtaacccaggatggcctcaaacttccagtcagttatgacgttaaactcctgattctcctgcctctgttccctgagtgctgggattatgggtgtgtaccagctgtgctgggactggaacccagggtttcctgcatggtaggcaaacactctaccagctgagcttaatgcatcttcagtcccttcttttagcttttatgagatatctccatactaactgttaggtctcaaataaacggctgaagtgcccatcaatgtatcaaagctgaaactagcagacaagttctcccagaacccctcagtctctacctgttacagggccctcctggctggcatactgtgccccctaccctgaactgtccagcctaggtattgggctgggattccctcttcccagcttctctgtcatctatataactcagccactttgggtatgccagtctcttggcccaggacactcctcttggtcagcagctcctctccccctcccattctccatttcctcacatggcccagctccctctggtcatgttcactctggactctcctagatgtccctgtctctgcatatgctcttccttttatccacaacaaaccttcccctgcactgtacctaggagcagtcataccctttctccctctccctctccctctccctctccctccccctctccctctccctctccttttccctctccctctccctctccctctccctctccctctccttttccctctccctctccctctccctctccctttttcattcacttactttcatagtggttgcacaagtttatattgccaccagcaaccagcatccttcaacctcttcatccttgccactgtttattattacttatttccttaatgactgagtggtgatgaaatttcaatagtttgcagctctagtgtgcaaacctctagtttgcagctctctgatgtataagaagactgggaactttagtatatacttatttgtcagttgtacatcttcttttggggactgtctcttcacatcattggcctatttattcattagattgcctggtttctttttcgtagttttctgagtgtttaatatgttatagatattattctatgacctgagatatatatagctggagaaggttttctcacaatctgtgaatgtgtcagagggtagctatgagcacagcccaacacatcataaacttacttaaactattctgagattttattttgtagttcttattgtaactcaattatgcggttcctgaacatggtgtttgtaaatgagaatatagatgttgcaatgcaggaaggttgaacatgcccactagactctcttttgattgaattctttctttcttatgcagaagctttttaatttcatgcaagcccatttgtcagtttttggctatatttcctaagctgttggactccttcttcagaaattccttgcatataactatatgttaccatgtttactctctttttttctggcatcagttccagaattccaggtctgtaaatcagaccttcaatgcattttaaaaaattgtgtgcaagacaaaagatatggatcaaattttatccttctaggtgcccaatttcccatcaccatttggttaaaaggctttctttgctacaaacaaatgtgtttttttactccctttatcaaaactcaggcgactatagcagcatgggcttatttctggattctatattgtattctgttattctacatgtttttgttttgggggcttggtgtgtgtgtgtgtgtgtgtgtgtgtgtgtgtgtgtgtgtgaaattaattctggtcatacttccagaattgttatgtttgcataagagtgctttgactattgaagtatgtgcaaggctttatagaggtgctcagttcttaaaaccgaatgacaggaaagcaattgttgacttatgggcaagtgtacttgtaattttctgaaaacacaccaaactgttttctaggacaactatacatttacattccctccagcaatatatgggaccatgttacttcatttcctcaacggtactttgtattgtgaccatgctgcagctgttttaaagagtacatagagacatctcattttagtttccatttgcattttcctgatggctggtgatgtgtaacatgttttcaagtgctcatttgctatctgtgccactcctttttggtgaaattctggtccagatgttttgcccatttctaattagacttttaaactatgtcaagggttatttatatattttagatacaagtctttcatcagatatttggttttaagtcttttctcccactgtctattttgtctttttatcctaagatgtttcgaaaagtaattggtatttatttattgcaatgctgaatactaaactcagggtcttacacacaaactaagaaaggtatctactgttgaacagcacgtccagccccagaatgctttttgagtccctcaaatgtatgactccttcctcttaccttcagacttcttccaacatatctgtaacctggcttggtcttattccttcttttttccttgttttcaaactctttgtttgtttgttaagacagtgtttcacactgtaactctgttgtcttgagcctatgtatcctgcattgtccttatcaaggcagcaaacctcctgccttggcttcttgattgttgggattataggtgtgagccaccatgccaggcttacagagccttttaaaagtcgtgtgatttcttctgatactgcaagataggctgagaacccagtgatgagatttttttgtattattcattctgctgataaaagtttaaagtgtctctctgtatgccaagaacttctagatattgggtttgcaatggtgaacaagggcttaagagaaaaccatgaaaactgtaagatttaaattggtctgggaagacctctctaaggagctgaaattgaagttgaagtttaaaaaggccatggcagctgtatgtagaccagaaactgttagacctagtaacgacctccaccaccagaagattttcaacatagaatatttgatgagtttaggaggataaaatccatgcccaaaggttgtgtcatctgttgatttcaaactaaaattatctggtgttttccattctctgcaactcaggtgggcaggataggaagaacacagccgggcagaattcagccaactggaagattgggcaaaggactgagctccaggggagaggtaacaacagtggagcgagggcttgtgagagcatgcctgcagctggctgcagggtgatggggctggcttacaggttcagtgcttcagtacattatcatcaaagtaggaacatgatagcatccaggcaggcctggttcaggaggaacttgagagttctacttcttcatctgaaggctgctagcagaatactgacttccaggcagctagaatgagagtcacacccacagtgacacacctactccaacagggccacaccttctaatagtgctactccctgggtcgaccatatacaaaccatcatatatatggatatctaattgctctgaaatggaaacttaagggttttttggaaagttagttgtgttggatggtgttttgctggggcaaacgtgaaggagtgttttcctgaagtggacacaggtgaaaggctaaggcagactcattttgctgaagcagacacaggagaaaggatgttctgctaagcaaacacatgaaaggatacgtgatggaagattctttgctaacagaaatgtattggtcggccttacactgtgtatttgagctccatttgtcaggactccatagagagaaacacaccaaaaaaccttctgatggtgtgacactgcctttttgtcatttcctaggactcactcaggctgattgtcagaatgatgtcagctgaggcagacacatgtgctgaggcaagacacgtggtgaggcaaggcacgtgggaggcaaggcacataaaagacacatgatgtttggagagtataaataggactcaatagacagtgacagaggctgagcttggctttctgatagagctagctaggcagtgcttgttggccttcagtcttccctgatcttcgcttctgtgaaagagacacagccaagaacttctcctgacgttcctcctggtccttcctgctgattcatcccaaggtggaagcctggctatctctgctaggtagtgccaccgctgctgcttagtgtttgctatcctgactctgctgaactgaactgctggtgcatctgtgaagtgaactgctgatttaaagacaacacagaaggaagttcctccaaagaacctttccaaacaggtctagtcctcccctcctcctcaccgacctcctgcaccgtcttctttcttttccactacctctggtgggtggtgggctaaaagggaggttaaagtgtttaagaaccaccattaaaaattagttttgaaaaaaagtaaagttacagtatagttgcaaaagctttattcactcagatatccttttcagcagtcatgtttatttttcttaagattagtgttacctgcttttgttttgcttttttttagccttgaaactttctttggctggctatgtgaaatacattcttggatgtctgccctttaatttgttcttggccattgtcagaccttggggaattgattttggttttggtatcgttgttgttgttgttgttgttattgttgttgttgttttaagtgcctgtgcaagtgtgtgtgaaggccagaggaaaacttaaggcgccatctttaaaatgccatttatctcctctgaaaggtgctttctcattggcctggagctcaccaattaggctagactggctgctgataaaggtccagtctatctctgcctcctcagcactgagattataaactttctctcaccacacccaacattactacatgagttttagggatcaaactcaggtccttatgtttataaggcaagcactttactgattcaactagctccccaatccttagtttttgtccttttccatgtattttaaaataaacttctaaatatctttgatggaatttgataggaacttattatcttagacgtctgtttagatgaataaacaccttctcatttgttttgatatagaatatctctgtataccacaggctggccttgagttcccaagactatctgtactaccatagtggctgggattacaggcaagcaccaccacaacccactgagactgtctttgaatccactgacagagtgcccctctctattgttttatttcttattgagcttcttttgatggtatttatagctttcaagacaatttgagttatagttatctaattgaagttactaaatgtagtaagaattttaaatttgacattaggataatcatttttaatttagagaaacaagatttatttttttaaaaaaattattgatcttatggctggggagatagcttaatggataaaagatttgctactaatatactttgttccttagcacaaagtaaaagttgggtacaaggcatatgtctgtaaacccagcacagcagagacaggaagatcctagaggctcattgcccagtcaacctagttgaaaaggtgagctttaggttcactaagatggctttggttaaaacataaggtggaagactggaaggatgactcaaaagttaagagcactggctgtccttccagaatatcagggtccagtatcagagttctcagaacccacatgccagctcacaaccatgtataactccagtccaaggggatctgacaccatcttctggcttctgcagaccctaggcactcgtatggtacactgacatacatacaagcatataaatcatagataaataaataaatgtggagagtaatagaaacagacatctggtgtcaacttatgacctccacatgtgtgtttacaactgagaacttatgttatatatacacatatacgcacactgatcttttattttgaagacttgctacattctgttattttactgtttaaaatctatagtattgctacatatagaatcatgtcacctgcaaacaggaacatgttttcctttcaagaatggttttccacgcatgaaactcaagaagaacgaagaccaaagtgtggacactttgccccttcttagaattgggaacgaaacacccatggaaggagttacagagacaaagtttggagctgtgacgaaaggatggaccaactagagattgacatatccggggatccatcccataatcagcttccaaacgctgacaccattgcatacactagcaagattttgctgaaaggacccagatatagctgtctcttatgagactatgccggggcctagcaaacacagaagtggatgctcacagtcagctattggatgggtcacatggcccccaatggaggagctagagaaagtacccaaggagctaaagggatatgcaaccctataggtggaacaacattatgaactaaccaattccctggagctcgtgtctctagctgcatatgtatcaaaagatggcctagtcggccatcactgcaaagagaggcccattggacttgcaaactttatatgccccagtacaggggaacgtcagggccaaaaagtgggagtgggtgggtaggggagtgggtggggagggtatgggggacttttgggatagcattggaaatgtaaatgaggaaaatacctaataaaaatattttttaaaaaagaatggttttcctctttctatccttattgcagtggttaggactgtgtactgtcctgaataagaatctggcttgtccagtagtactgggttatcatccacgagtgaaaagtgcaaacatcactttcttattcttgatcatttttaaagatttatgtatgtatgtatgtgtgtaaatgagtcctctgttttccttcacctctgcatgacagaagagggcatcagctctcattatagatggttgtgagccaccatgtgattgctgggacttgaactcaggacctctggaagagcagacagtgctcttaaccactgagccatctctccacacccttattcttgatcttaagagaaaaatgtttggtttttaaccaaaaagaatgagtctgcctgtaggtttatgcaaatgttctttaaagttgaggaagttttctttatacctaaggggtttgttttggtgtttttttttttttaatcatgaaagggttctaaatgttgtcaatctttttcttgatacagaaaaagatatatttttattctttagtctattaatattacacgaactgatgattgtatattaaaccaatttggtcacaatatgcaaatccatttatattttgttgaacttgatttggtgatcttttgatagaaaaaaataaatctaagctggagagcagcctggtctacagagtgaattacaggaaaggcaggagctccataaggagaccctgtttaaaaaaagaaacaaaagaaatatctaaactggatgtgtttgtgcacaactgttttctgagcgtgtagtaatctgagcctatagaaggccaagtcaggtgggttgccacattttccatggtagtctaggctacatagcaggttccaggacaacctgaactcctgaactacagaatatgttgccttgtcagcctcaatatgagggcttttgccttatcttattgttatcttgtttgccatgtttggttgttgtcccttggaggtgcactcttttctgcaggaaatgtggtggtggggacagtgttttggggacagggggtgggcactgtagatctggaagaaaggggaggtgtacaggagctgggggagttgagggaggggaaactgtggtattgtataagaaaagaatttcttttcaattaaaaaagaaaccatttcaaataataaaaaatgtacaataaattacatctaagttcacaagtaagttcattacaaatgggcagttattaccatgtctggatagctttagtatctttgtaaaactggcctaaaagtttatggaaaacatggaatcatattgatgtcagtccactttaaatacttggtaaaattatccattcaaactacatggaccagaagatttcctttgaagaagtcttaaatattaactccagttgtaagtattctggaatttttcaaattatccatctcatactggcagagttacagtagttctgtgcttttgtttatttgtttgtttttttttggtttttgtggttttttgtttttgtttttcgagacagggtttctctgtatagccctggctgtcctggaactcactttgtagaccaggctggcctcgaactcagaaatccgtctgtctctgcctcctgagtgctgggattaaaggccgtgtgccaccaccgcctggctagttctgtactttttgtaattagtgcattttatccagggcatcaagtatagagggtttttgtttgtttgtttgttttgtttaaaattaataagaattgttttatatttttatcagtaaatattttttaaacatctcaaaacaggaaaaccctttgaagttaaacactaagaaaatgctaatttaaagtacagtgagaaaaattatcaatatagtatttccatgatgtttgtagaacatgattttaatattttcaactgttaatattcaacaaacagaataattattttaagatatatttcattgttatgtctcccttttcatttctgattttattaatttggatactgtctctgtgccttctggttagtctggctaagggtttatctatcttgttgatttttctcaaaaaccagctcctggttttgttgtttctctgtatagttctttttgtttctatttgaataatttcgaccctgagttaaattatttcctgctctctactcctcttgggtgtatttgcttctttttgttctagagattacagatgtgccatcatgctgctaatgtaagctctctcctgtttctttttggaggcacttagagctatgggttttcttcttaccactgctttcattgtgtcccagaagttttgatatgatgcatcttattttcattaaattctaaaaagccattaatttcttccttgatcaagttatcattgagagttgttcatcttccatgtgtatatgggctctctgttgtttttgttagtatttaagaccagccttagtctgtggtgatctgatagggtgaatcagattatttcaatctccttgtatctgttgaggtctgatgcgtgaccaattatatggtcaattttggaaaaggtaccataaggtgctgagaaggtatattctttgctttaggatgaaatgttctataaatatctgttagatccatttggttcataacttctgttagtttcactatgtctctgtttaatgttttcatgatctgtgcattggtgagagtgacgtggagaagtctccccactattatgtgtgaggtgcaatgtgtgctttgagctttagtaaagggttttttgtttttttgttttttgttttttttttaatgtgcgtgtccttgcatctggagcatacatgttcagaattgagagttgttcttggtagatttttcctttgatgaataagaagtgtccttccttatctttttttgataacttttggttgaaagtcgattttatttgatattacaatggctactccagcttgtttcttgggaccatttgcttggaaaattgttttctaaccctttactctgaggtagtgcttgtctttgtcactgaggtgagtttcctgtatgcagcaaaatgctgggtcctgtttatgtatccagtctgttagtctatgtctttttattggggaattgaatctatggatgttaaaagatggtaaggaacagtaattgttgcttcctgttatttttgttgttagaggtagaattatgtttgtgtggctatcttcttttgggtttgttgaaagaaggttactttcttaatttttctagggtgtagtttccctctttgttttccatctattatcctttgtagagctggatttgtggaaatattgtgtgtaaatttgtttttgacatggaatatcttggtttctccatctatggtaattgagagttttgctgggtatagtagcctgggctggcatttgtgtcttttagggtctgtataacatctgcccaggatcttctagcattcatagtctctggtgagaagtctgttataattctgataggtctgccttgatatgttacttgacctgttttcccttactgcttttaatagtctttctttgttttgtgcatttagtgttttgactattattgtgatgggaggaatttcttttctggtccagtctatttggagttctataggcttcttttatgttcatgtgcatctcttttttaggttagggaagttttcttctataattttgttgaagatatttaatgaccctttaagttgggaatcttcactctcttctataccaattatccttaggtttgatattctcaacatttcctggatgttttggcttgggagctttttgcattttgtattttctttgactgttgggtcaatgttttttatggtatcttctgcacctgagatttttctcttctgtctcttgttttctgttggtgatgcttgcatctatgactcctgatttctttcctaggatttctatctccagggctgtctccttttgtgatttctttttttttaatttccatttttagatgttggatggttttgtttagttcctttacctatttggttgtgttttcctgtaattctttaagggatttttgtgtatcttctttaaagtcttctacctgtttatttgtgttctcttgtatttctttaagggagttatttatgcctttctaaagtcctctatcatcatcatgaaatgtaattttaaattagtgtcttgcatttctggtgtggtgggagtactaggttctgatgattccaagtagccttggtttgtttcctatgttcttgcactttcctcttgtcatatggttatctgtgatatcagctggtcttgctgtctctgtggcttgtccctcttgcaagactgtgtcaaaactcctggaagaccacctctcttccagcgatatttcagtatagagagctgtggaaaagggtctttactgtcagttttgatagctttttaaaaaaattttttttcactgtagcagattttttccatattttttattgggtatttatttcaattacattttcaatgctatcccaaaagtcccccacccactcccctacccaaccactaccacttcttggccctggcattcccctgtactgaggcatataaagtttgcaacaccaatgggcctctctttccactgatggccaactaggccatcttctgattgattcatatgcagctagagacacgagctctgggggtactggttagttcataatgttgttccacctatagggttgcagatctctttagctccttgggtattttttctagctcctccactgggggccctgtgatccatccaatagctgactgtgagcatccacttctgtgtttgccaggccccagcatagtctcacaagagacagacatatctgggtcctttcagcaaaatcttgctagtgtatgcaatggtgtcagcgtttggaagctgattatgggatggatccctggatatggcagtctctagatggtccatcctttcgtcacagctccaaactttgtctctgtaactccttccatgggtgttttgttcccaattctaagaaggggcaaagtgtccacactttggtcttcgttcttcttgagtttcatgcgtttagcaaattgtatcttatatcttgggtattctaaatttctgggctaatatccacttatcagtgagtacatattgtgtgagttctcaattcttacatattgttttgatttgtatttccctgatgattaaggatgtagcagatttttgattcattgaattttgtgtttttaatttttctgttttctgcacttactcctttcacttagtttttcttaaaattgttttttaatttcttgaggtaggttgttgattttaggctttctttttctaattttaatatatatgctgctgaggcaagcatgaggctttctttttctaatgtaagtaccaagtattataaatactacatgcctcatgaattttcatctgctgtactttcttcttctttcctcctcttccttattctcccttctgtccttctctccctccttccttcatggcacccaggcctttgggcatactaggcaagtactctacctctctttcatctccagtcctgtaatttcatttttatttaatttagtgctttagtgtaccatttatgtgggttctttagttttaatcttggaaacttttcctgttatctttgttaatgatttctcttttttctttaaaggcatttcttcatttacatttcaaatgttagccccaaagccccctatactctccccctgccctgcttcccaacccacccactcctgcttcctggccctggcattcccctgtaccagggcatatgatcttcgcaagaccaagggcctctcctcccattgatggctgactagaccatcctctgctacatatgcaactagagacacagcactggggggtactggttaattcatattgttgttcctcctatagggttgcaaacccctttagctccttgggtactttctctagctccttcattaggggccctgtgttccatccaatagatgactgtgagcatccacttctgtgtttgccaggcattgccatagcctcacaagagagagctatgtcagggttgctggcatgttctggtttgactccattattgctaaagaatgtgttaatattatttcacttattttcaatttgcttagctttgctttgtgaactgggataccatttatatggggatgttgcatgtacacttaaatgagcatgtgtctaccttcattaggtggcattgatagacatcagggctaaaggtactgaattcttttatatctagtgtttctggttttcaactacaaatgtggacttgtctttttcctctttctatttttcaggattttgctttgggatatttgaatctttcatttgttgattataactttaagactgctatgtcttctatcctcctaccatgctcttctttgatcctggtatcttgtttgctctgaactctctattataagtgacattaatagagccactattcttttctttcaattaatgtttgtgtggtttactcttttcatccttttactttcaacctacctatgtcactacatctgaaaataatttcttataaacatgaagtctggtgtatttgttagggttttactgctgtgaacagacaccatgaccaaggcaagtcttataaaaaacaacatttaattggggttggcttacaggttcagaggttcagtccattatcatcaaggtgggagcatggcagtatccaggcaggcatggcacaggcagagctgagagttctatgtcttcatccaaaggctgctggtggaagactgacttccaggcaactagggtgaggatcttatgcccacacccacagtgacacacctactccaaccaggtcacacatattccaacaaggccacacctccaaatggtgccactctttggtccaagaatatacaaaccatcacgtctggttttcttttaattattttctgaagctggggatatagcttagtggtagagcacttagctgacatgtactagaccctgagcttcattcccagcaacacaaacagaagtcttttttgtgagtctcttttactgtatgaattgaaaacatttaaaaaatgattattgatatttttagagcttacgtttgctgtttttcaaactgggtttgtttcttcattatttttttctggtttcccctttctgccatttcttacttacacatttctttcaaaacttcatttttacttcactgcagtagttgtcagcagacctctatatatatttcagtggttcctttggcttgtacatatggaacttctcacagcctaattggatcaactatttgctgcttctaaagaaatatataaaacaagtctgcattggggtctctttataatgttccccttttatgattcttttacatattttctctgaatatattgaaaacaaatcatataatataaatttgccttaaaatcaaatataatttgggatccggggatgatggctcattagataaggacacttgctacccaagaataaggacttgactgcagacactcagagcccatataaaagtcaaggcctgggcttgtgcttctagaacccaagttctgtagagacaggacagctggtatctgctgtctgccaacatcactcccagttcaggatcctgtcataaaggaataaggtgaagggtcctaaagcaggatacccaacattcccttttggttgttgtccttgttgttgtttttggggtttttttgcatgcatgaacatgcataaccctcccacagggtgtgtgcagacacatacacataccaaacatacctttcaaaacataaaaaagagcccattttgtttacttgtatttattttcttactctgttctgtcttcatttatagaatgtgaatcctcttcctttaccatttgctatcagttggaaatttttcctatagcatttctcatatagcaaccaacttgactttctgttgagaaagtcattttcaacatcagtcccgaagcatattattatgaaatacagaaatatagattgacacttattttcttttcatcattgaaaacatgtgcaacttccttcaatcccccatgctttcaggtataaaatccaacgcattattctataaataatgtcattcctctctagttgctttcaagaattttcttggacttttcttcatttacttaatcgattaacctaattaaattattgaaaagagagtctcatgatttagtctaaggtagctttaaattcatgatcttcctgcttacactattcaagtgctggtattattggtgtatagcaccatgcctgtctagagtctacttttctgaaatttgattgtgctgtgtttgggggtaggtttctttggaattttcttgctgaacattctcaattcttactgaatctgcagatatatgtcttttgccaaactttgggaaatttcgaccatatttcaagaattagtccaacatcaggctcttattagaactctgatggtatgaaggtagatcagttactgtagtacatcagtctttgcagctctattcatctttttttgttgtagtttggttttgagatagggtctctctatgtaaccctgtgtggcctggtgctcactctgtagaccattggctgagatctgcctgtctctgcctccaagtattaggattaaggcagtcactgccacacctggtcctctatttatttgttttcactgttttcttttgtttgcattgagtaattctcttgttttattttcagattcagtaattattttaaaagtatttttaatttatgtgtatgtgtgagtacctgcatgtatgtaggggaaccacttggtgcccatgtaggccagaagaggttatcagttaactctggaattgaattacaaaagtttttttttttttccaaccaagtgctcttaacaatgcagggtctgataattatttaataactcagcatgttttgcagtttaacccatctagagatctttttatattttggcttatattttacaagtttaaaatttcccatttggttttcaggtatggttgaacataaccataatcgcagtcctcccaagtctaaggcaggagaatcacaaggtaaaggctatcctgaatcacatagcataaaactttgtttcaaaaaaaattgttttccgtttgattctttaaaattttttggtgaaagtttgtattattttcttccaattgtgtttgtaagtgttgaagtactttaatgatagctgcttgtattgctcggggatctctagaggaatataacttatagaaatatattaaaaatttactagattgtcttattctacatggtctgagtcatctaactagagctctttcacgctgacgaagttgagaacacagtagtttcctcatccatgaggcagaatacctcaacagtcccaatctggtactaaaggtagggaaattttctggagagccctggtcttcactccatgttgcgagcctgaagaagctgtgctctggtattagtgcatagaagcaacaacagtagtatggtgtagatgaagctgctggaaagagtggaatgaaggcaaaaagctcttttcctcagtcttcctttttgtctgggctgccaccggaaggtgccacccacttagggtggaatgtccacttcaagtaacccaattaggggaattcttcacaggtgtacccagcagcttgccttttagttgaatcctggtccaggtcaagctgacaaccaagattagacacagcactgctttaagcttgtttctggttattttcataacagtgtggtgtcaggactgcagtctttcaagtgcttttctcattcaaaatgaaattttcttggttctttgtttgaaaagtgttcttttcattatattttgcacatttaaggtattatgttctttatatatgaatcttgtttcaatcattttagcaagcctctcctggcagtacactggcaccccacttggttacagccaggatgggggttgctgactatactggttagtttaagttgacacaagctagagttatctgaaaggaagtttcttaattgctgtgatgtgaaacaccatgcctgaagcaatttgggaagacagggtttatttgggttatacttccaaattctagtccatcattgaaggaagctagggcaggaactcaaatagggctggaacctggaggcatgagctgatgcagaagtcatagaggaacaatgcttattgacttgctcctatggcttgctcagactgctttcttatagaacccaggacccagcccaggggtggcaccacccacaatgggcttggtcctcctcatcaatcactatgcaaatgtcctacagaattgcctacaacctaatattatggagtcattttctttctttttttcccccttcatctgtttgattgtattttcctgtatttctttttttattggatattttctttagttacacttcaaatgttatccccgttcctggtttccctccctcctggaaaccccctatcccatccttcctcccccagcttctatgagggtgttcctccacccacccactcccacctccctgcccttgattcccctacactggggcatctatggagccttcataggaccaaagacctctcctcccattatcctcttctacatatgcagctggagccatgtgtacttctttgttgatggcttagtccctgggagttctggggggtctggttggttgatgttgtcgttcttcttatagggttgcaaacctttcaactccttcggttccttgtctaactcctctattgggaaccccgtgctcaatccaatggttggctgtgaggcactttttaaattgaggtccctggaaatataaattgaaataaatcctttcctggctaaacccaagttgctttggttatggactttcatcacaacaatagtaaccctaattaggacactgtccaaaaatcctttcttctcaaattaggccttcgttagcagggttagggtgcttgctttctgcttttacaggatagataattgttttctttgtcctttggctagagataatgtttgtttgtttgtttgttttgtctatgactattaataggtgctcactattaataggtggcttctttagtacccattccacaatatagaggaggcacaagaaaacagagaatgcattgctttgttgttccttcattttcaaggtggctaataagtgtgcatcttctggatttgacttacacgttatgaaagaaaagtgcatctgttccatcatgtctagaaatagaagctagccaacctaaaagatttttcaattttttgagaaaggaccatgccctgtagcccattcaggcttcaaatttgtgattctctggccctaacctcccaaatgggtttatatgtatatattagtcaggattctctagagggacagaattactatctagtaattattcacagtagttattgtccagtccatgcagttggatgtctcagttggtcttcaggatagactagattcaaaaagaatgggaatccagtgagggggaaggtaagcaaacatagataaaaagcttccttcttccatgcccttacaggtgtacccagatgcttgggttttagttaattccagatgtattttatgtgtatgggtgttttgcctgaatatctgtgtgttttgtgagctgtcagatggatgcttggaactgaaccctggtcctctacaagaacaagtgcccagttttaattttttaactacattttgattgtatgttatgaacattgtagatggggcatgtgcatgtatctacatcagcatatgtgtggaggaagtttctgagaacaaattaagattatcttggcagtgggtcatctagccagctctttttttttaaagatgtatgtatgtatgtatgtatgtatgtatgtatgtatgtatacagtgttctgcctgcatgtatgcatgcctgcaagtctaaagagagcactagacctcattatagatggtcatgagccacaatgtgtttgttgggaattgaactcaggacttctagaagagcagttagtgcccttgacttctgagccatctctccagcccctggccagctcttaatatgagattttattgtatatttctaatcattttgactgggcttcttcctcaaattctgcagcagtagttttggggtttttttgtttgtttgttttgttttgttttgtttttgagagtaggtttccctgtcgtgtagtcctggaatacaatatatagaacaagttgaccttgatctcagagattcacctgccacctcctctggaattctgggattaaaggcatgtacccatgcccatcaccagtcattctattaaaccggtagataactttatcagattagataaatgtcaaatttcatacagttgtaatatcagagcaaaggcctccaaatcaaaaagttgattgcaagatcaggcacgttcaaggtggtagacacatgataaatatggcctcatgaaactaaacactccttacagcaaatacatcatcatctaagtgaaagggggaactacagaatggaagaacatctctagcagctgtacatctgatagaagattactatctaggatgtacagacaaatgacaataaatgctggcaatgatgtaggaaaggcagaatacattgtgtctgttttgtgccaatgccatgtgttttttattataatatgataataaacatagctccaaagtacaacttgaaataaggaatgttgatacctctcacaggtcttgtattgttcaggattattttagctattctgattttcttgtgttttcatatgaagataaaaattgtcctttcaggatctgtgaaggattatattggaattttgatggggattatgttgattctgtatgttgcttttggtagaatgggcattttttttactatattaatactattgatccatgagcatgagagacctttccatcttctgatatcatcttcaatttctttcttcagtgacttgaagttgattatacaattctctgatttactttattaaatattttgtattatttgtggctattatgaagggtgtatttttcctgatttctttctcagcatgttgatcatttctcagcctgtttatcacttgcatataggagggctatatcattgtacataggagggctacttattttgtgagttaatgttttttatgtagctactttgctgaaagtgtaggaggatcagttatagaaacatcctggtggaatttttagaatcatttatgcatatacaaatagagatactttgacttctccctttccagtgtgtatcccctaatctctttcagttatcttgttgctccagctaagaattcaggtattgtattgatagccatgaagagtggacagccttgtcttacccctgattgtagtggaattgctttgatttttctttccagtgaagttgatgttgacaatgagctttctgtacactgcctttattatggttacgtaggtcccttgtatccctaatttctccaagacttttatcatgaaagggcactggattttgtcaaaagccttttctgcatctaatgagatgatcatgtggggttttattttctttcaatttgtttataaagtgaattacatttattaatttatatatgttaaatcattcctgaatcactgggatgaattctccttgatcttggtagatgatcttttttgatgtgttcttggattcagtttgtgaatgtgttattaagcatttttacatcaatgttcctaaggaaaattggtctgtaattctctttgttgggtctttatgtgtttgggtatcaaggttttatgtgttgggtatcaatggcctcatgaatttggcaatgttccctctgtttttattttgtggaatagtttgaggactgttggtattagctcttctctgaaagtctggtagaattctgcaataaaactatctggccctggggtggttttttggttttgtttttgttttttgtttgtttgtttgtttgtttgtttttggtggtggtggtattttattttgctttgttgttttgttctgttttttgactgggaaactttaattgagtatttcttttggggttatagatctgtttaaattgcttatctgatctgatttaactttaataagagatattaactgagaaaatagtccatttcttttaaattttttcaatttagtgcagtacaagttttccaattatgatctaatgattctttggatttccttagtgtctgttttgccccccttttcatttctgattttgttcatttggatattctatctccaccttttagttaatttggataaggttttgtcagtcttactgattttttcaaagaaacaactctttgtttcattgatactttgtatcaatctttttttgtttctatttttcctgattgtagctctgaatttgattattccttgccatctactcttcttgggtgtgcttacttcttttttctagatctttcaggtaaactgttaagttgctaatgtctcaattttttatgtaagcacttagtgctatgaggtttcctcttagcagcattttcattgtgtcctttaagtgtgtgcctgttgcacattcattttctttgaattatagaaagtctttgtttgtttgtttgttttatttatgtcttgacccattttccattcaggagagagttgcttagtttctgtgagtttgtaggctctctgtgttgttgaaatccagcttgcatccgtggtgttctgataagatgcttagtgttatttcaattttcttgcatctgtcaaggcttagtttgtgacttatgtgctcaattttggagaaagttccatgaggtgctgagaaggtgtattcttttgggggttgggtaaaatgttctataaatatctgttaggtccatttggtttataatgcctgttagctctagcatttctgtttaggtttgggtgtttgtttgttttgttttttgaatggtttgttgacttgtctgttgatgagagcgcagtattaaagtctcccactatcagtgtgtaagggtcaatatgtgacttatgctgtagtagtgtttctttatgaatggcagtgtgcttgtgtttggagcatagacgatggtgaatttttccctttaatgagtacatattatcctttcctatctcttcttattaatttaaaagtctattttgtcagatattaaaatggctacagccctacttcttaggttcattttgtgttctatatgttttttgtaccttgatagacatctccttaagttaaaaattttctcctatgattctattgaaaatatttcctgtgtctttggcccgtgtttcttctttttctgttcctattattcttagattaggtcttttcatagtttcccagtattcttggatgttttgtggcagaagttttagatttaacactttctttgatcaatgtgtccatttcttttattgtattctgttggtgaaacttgcttgagttcctaaattttccatttccagatttccctcagtgtgggcttcctttatttattctattttcacttttacatcttgaactgttttattcatttccatccacaaggagaacatagcagaattgtgctatagagctggggatgaaactggtatttgtagaaactgagagagaagtaaagatctgcagcttaccctcttccctggcaggagtggcctgtgtgtcctcagggaatacttgctgaagttgagtgctaggataaagcaatgggctggggaaggagtttatggagtgggagagatttgtggcatccactggaggtgggagcagtcaaggaagggaggctgaagcaggtgttctactgaagagctgtagattaatgtggacatgaagagggagaggtgaagatttgcagatagcctgcctgctttccagaattccagaaagctcttctcaaccgtcatcccaccttggtagctgttaaaagcacagcagtatttgcagaagggtctgtattaccttctcttcaccttcactaaacacctcaagtcacgttttcttactgatttggtatgcattctcaatatgcaatactataacttagataaagaaaactatagcttaaatcaccaaggttcaacagactatgaatttctacgaaggtcaaacatcctttgttttttcccttccaggtcagtggccataaaaaggtgaactcagcatgctgcccccgcactggagaggctgcacggtggaggcgatctatcacactgtgagacactgggactgatttggtatcaactgctgtgccattctcctggtcaggagcatcacaagctgttaagtaatgacagacaccttggctgagatgaagtttccagaaaggaagtaacagtgcaatgtggatatttgtgaccacaacataggaaaagctgtacttcccaggctgaacttggctcagcttgagccatttcaacaaggcatcctcacaataatgaagagatgtgatctggtttcctttcacatcagcagatgtctggacaaaaccatcaatgtgaataagggccaagtgcagttgtgtctctcttgattaaattacttcatattaaataaaaggtctggctggtattgtttcctaaaggcctcacccagctctccttcaattagcagtcttcctgtagaaccattttctaaacaattttctctggtgggtaagagaggtgtaataaactaaaactttgttttcaaa

SEQ ID NO: 380 - DNA, 37982 bp, mus musculus; identical to SEQ ID NO: 379

SEQ ID NO: 381 - DNA, 248 bp, mus musculus
gattagggggcaggtgcgagggagggaagagaagaaagcaggcggctagggggcggttaccaccctagccagactcgcccggcacgttgagggggccctcagtgtgcggcgaggaaggagcggagcgagacgctgcgccggaggtaggcgctctcgagggtggcctcggcaccagcgaggttgtgggcgtagtgcgggtttagtggcgggagtggcggcctcgaggagtgggacgcgagcggcgtgga

SEQ ID NO: 382 - DNA, 30635 bp, mus musculus; identical to SEQ ID NO: 25

SEQ ID NO: 383 - DNA, 30635 bp, mus musculus; identical to SEQ ID NO: 25

SEQ ID NO: 384 - DNA, 13913 bp, mus musculus; identical to SEQ ID NO: 33

SEQ ID NO: 385 - DNA, 24624 bp, mus musculus
gagtgaatccttggaggtagcaggatcctatggatctagatgggcctggcacgccgcggtctgccagcaggcggatcgtcgcgagctggcgggagactggtttgggtgacgttcaatgagatttggcgggttctgagggagggtggacttacaggaaggtagggagagggagttaagtgtttataattagtaatttgaagtgtgtgtgtgtgtgcgcgcgcgcgttggtactgaacttataggcagttgtgagctaccatgatgtgggtgctgataatggagtttacattctctgcaagttttatgtgtttttaactgatgagccatttctgtattcccccctccttactcttacatttgttttcctattttatgtgttttgtctgcatgtttatggactacatgcgtgcattgcccacaaaggccagaagaagttgtgggattccctggaactggagcaaccaacagtttgtgtgcaccatgtgggtaatgggaatcgaacctgggtcctctataagactggccagtgctcttaactactgaggtatctatatagtccctatttttttcttttagaaacatttctattctttgagagtttcatagatgtatgcaatatattttcatcatctccactcccttttccctccaactcctcctagactcctcctaccacattttcctccaatttcatattctctttaaaacaaacaaaccaaatcaaaaccaaaagaactcactgagaccacttaagcatttaataattttaaaagcacaagagtgcctatagaccagcaaggattatggtactaatctataaggaaggcagtatatcctgtggggatctgtttgaaaaaaatatatgttgcacacattgtttggttttcaccctccataaagggaatgaataagagcacataaaaatgtttaaatggagacaaattttaagaaatttatcttgaatgaatttctgcttggtggcatgcagtccatgatgagggctacagagaaaccttgtcccccaaaccaaaaccaaaatttgatgttacatgtatttaaaagtaaatttgatgtgcttaaagcagatattaggaagctatataatattagttaatctttatttgctaaggagaacagtttagatagactagagttgggtctgttaagtttattaacatatttcatgtaatttttctttaatttaaaagatacttttaggttatccaaatggctcactggttaaacggtgctaaccagtctgacagcctgagttcactctgcacggcggcttgtaggttactgctgttcctgacatagagatagcaaacttcttttttacaatgggaggtagttactaaagaagattcataactggttcaactgcaaggaatgtgtctgttgctgtggtagagctgctcaaggtggtagaaagtaataatcacctatattattctaagtcttagagaatagaaggcaaagtgggaagaatgtgaaagctgcaggaagggagcattgtctcacgatttacactgttgggcatgaccattgctattttgaataagagcagatgtgatcactattcatcaaacatttaccccttccatacatagttctgagcattttacatatatcaactcattgtgttcctctgaggtgtctgactgtgtagcacagttacacatagtctggactgctttccccatgtccagactagaaagaaatataaccagggtttcattttcacacttcaatcttggtccatctagagtatggatatatgtaataaggtatgggcccaatttaatatttatctacagctttatttttcagttagagtcttgtcatatagccaggctggcattgaattcactgtctagtccatgctggccttgaacttaaaatcttttaccctagcctttcaacttctggcattgcagatgtaaggcaccaagtcaaacttaatctgtttgcaaacgtctgtgtttaacgggtagaatgatgtctagatatatagccacagaatatgtttgaaaaaattttacatatataattaaggatcttgaggtggggggtcattctgagttaaacaaatggccccaaaccaatgagaatttttttttttttttggtttttcgagacagggtttctctgtgtagtcctggctgtcctggaactcactttgtagaccaggctggccttgaacttagaaatccgcctgcctctgcctcccaagggctgggattaaaggcatgtgccaccactgcccagcgagaaatattcttataaaacaaagagaaagacataggagatggtgtgaaaactgaaaactggcagacattagggtcattgttattatttatatacgagatgtcttctctaaaggctcatatgcgttatggttgatccatcgcaggtgacaatattgagaagtgattgatcatgatgacttcttcaatggattaattcattgataagtttatagctgaattgctcataagaaatggagcctacttggatgaagtaacaccccaagggcatgtgtgtgtgtgtgtgtttataaacaaacacacacacacacacacacacacacacacacacatatattcctatatccatttttttctgttttttggctgccatgagataagtggcttttctccatgatgtccttctgccattactttctgccctgctaagaggcctaaaaggggggaaaaaaaaagaccccaaccaagctgatcttggaaatgcgatatctgaaatttttttttttttttttggttttctgagacaggatttctctgtatagccctggctgtcctggaactcaactttgtagaccaggctggcctcgaactcacaaatctgtctgcctcagtctcccgagtctaggattaaaggtgtacgccaccacacccggctaggatgtctaaaactttgtgatcataaaaaagtccttcctcatttgttcttttgttaagtctagtcacagcgatgaaaatgatactagcatggtaatatgtttataaattaaagggttgaggccataacttagtggtagaatgtttacctagcttgcatgatgccctggacttgatttttggaacttcaaaaatacaaactgaggcatatcaatgattgctgctgtccttagagaaggtaggaaagaggcatagaatagattttgagtagaaagggaatagaatacattttcttcaaaaaggcttggctctatgatctcatgagtttggacttacagtctccagaactataacagaatagaatttattggtttaaaccagccagtctgtggtaactttttactgctctcttaggaaatgagcatatttatttgaaaattcacctttgtccatcatgatttgagatggcattttagttagacacagacttctttactgacattttacacggtttcaatggcttatatattcatgggtcatgagtgcatggtcttactgttttggttggttttgtttttgaaatatagtattgctatttagtatatataggctatttttgaacttaatatgtagttgaggttttgaactagctaccctcctttgcctttttaaaaaaaaaattttgttttgttttgttttccttttttattagatattcattcacatttcaaatgctatcccctttaattgtttagtcccctgtacccttccccctccccctgctccccaacccactcactcccagcttcctggccctggcattcccttaactgtggcatataatatttgcaagaccaagggcctctcctcccattgatagccgactaggtcatcctctgctacatatgcagctagagacacgagctctgggggtactggttagttcacattgttgttccttctatgggttgcagacccctttagctccttaggtactttctctaactccttcattggggaccctgtgttccatccaatagatgactgtgagcatccacttctgtgtttgccaggcactggcatagtctcacaagcgacagctatatcagggtcctgtcagcaaaatcttgctggcatctgcaatagtgtctgggtttggtggttgttcatgggatggattcccatgggggcagtctctggatggtccttccttccatctcagctccaaactttgtctctgtaactccttctatggatattttgttgccccttctaagaaggaatgaaatatccacactttggtcttccttcttgagtttcttgtgttttgcaaattgtatcttgggtattctaagtttctgggctaatatccacttatcagtgagtgcatatcatgtgtgttcttttgtgattgggttacctcacttaggatgatatcctccagatacatccatttgcctaagaatttcataaattcattctttttaatagctgagtagtactccattgtgtaaatgtaccagattttctgtatccactcctctgttgaggggcatctgggttctttctagcttctggctattataaattagactgctatgaacatagtgagcatgttactacaagttggaatatcttctgggtatatgcccaggagtgatattgctggatcttccagtagtactatgttcaattttctgaggaactgccaaactgatttccagagtggttgtacaagcctgcaatcccaccagcaatgggggagtgtccctctttctccacatcctcaccagcatctgctgtcacctaagtttttgatcttagccattctgactggtgtgagatggaatctcagggttgttttgatttgcatttctctggtgattaaggatgttgaacatttttttcaggtgcttctcttctcagccattcagtattcttcagttgagaattctttgcttagctctgtaccccaattttttttttttgtttttttgagacagggtttctctgtgtagccctggctgtcctggaactcaactttgtagacctggctggcctcaaactcagaaatccgcctgcctctgcctccccagtgctgggattaaaggcgtgcaccaccacacccggctttgtaacccaatttttaataggttatttggttttcttgaatccaccttcttgagttttttatatatattggatattagtcccctatcggatttaggattggtaaagatcttttcctaatctgttggtagccttcttttcttactgacagtgtcctttgccttacagaagatttgcaattttatgaggtcccatttgtcgcttcttgatcttacagcacaagccattgctgttctattcaggaattttccccctgtgcccatatcttcaaagctttccccactttctcctctataagtttcactgtctctggttttatgtggcgttccttgatccacttagacttgagctttgtggcccatgcctaaacatattaaggtcctttgccttttgaatggtgaaatttcaagtatatgtcaccatacccagcttccaaactacttaaattatagaagctttatagaatgttcatatatttcatgaagttaatctctgccattgatcttcatcttttttaggggttcatagttattctcttgtgtttatttttcttttgcattttaggtgcatttctttcggaattgattcacataactattatgctatactgtttgaagtatttattagaaaaacatcagaaagaggtgagtaaccatctgttgggctgtgggagattgctctcaatttttcacttttctctgtagccataccttttgcccttaatgttttgattttggggtgatttgctttattaatagcaaagttattaaaaaaggagtagaggagatacggtatttttgagtctactccttggatttgttgtctggcttgccctcaatctctttgcatcattagaagaagacatgtgtcactgatatgtaccaccatgccttgcttgaagcatattctcttgaattaaagagtatgtctgtggggtcaatgcaggcagtaatccacaaagagatgagaatgaaagcttcgttctgattgacttcatcaacctggattagatttggggaatctaatggcaggtggctcattgtaagcatatttcaaacactgcaatttggaaaaaggtttccaggcaacaatcagcccaatccagatgcacagtaaagcttaaggtgtgactatatggaaactcatttgcaaagtatttgtgatcatgagagtgagttctatagctaaaaggcctagaatctattgtggtctctgaccaagatagcatagaggtcagcagggtataaaattcatgtggcatcctccttaaggataggttctagtatctgggaactagagaagaagtctgggataaacattctgggggttagggtgaggtcagcctccatagatagcaaaagctcactacatcattaacagtatccactcccaggcttctgggcaggaaaacaggtgttttatcttctcagttgagaagagcccgtatgtgtttaacattcctagtctccctagtgatctgtgggcataaagacatttgtacccctaacatcttgtcccttttttttttttttttttcgagacagggtttctctgtatagccctggctgtcctggaactcactttgtagaccaggctggccttgaactcagaaatccacctgcctctgcctcccgagtgctgggattaaaggcgtgtgccaccatgctcggctcccttctaatttttaaatagaaaaatagccaagatagaggccatgatagaatccattgcctccatggctggtctaaacagtataggtaaacctaagagaattataagaagacctaactgagcatgtgcccttcttaccagttggggcatcttctggatatatgcccaggacgctgacaccattgcatacactagcaagattttatcgaaaggacccagatgtagctgtctcttgtgagactatgccgggtcctagcaaacacagaagtggatgctcacagtcagctaatggatggatcacagggctcccagtggaggagctagagaaagtacccaaggagctaaagggatctgcaaccctataggcggaacaacataatgaactaaccagtatcccggagctcttgactctagctgcatatgtatcaaaagatggcctagtcgaccatcactggaaagagaggcccattggacatgcaaactttatatgccccagtacaggggaacgccagggccaaaaagggggagtgggtgggtcggggagtgggggtgggtgggtatgggggacttttggtatagcattggaaatgtaaatgagataaatacctaataaaaaatggaaaaaaaaaagacctaactgagaatcaagaaaagaggaaagacatcctcacttcacccatctcttaattcatttctgctaataattttgttgtgaacaaatgagtaaatatggtctattccacataaacttttatgaacaacccttagcatgaggagacagtatcataaacacaggtgtgttttttatctcccctgacaaaaggcatttggattatgtattgacaagagttaacatgcaatacagttaattaaatataacagcatcagtgtttcctcatcctgttgactcaaagtcctgatgtcctcccaggttatcagtatactctccctcttgggacatggcctcttgatgggtttgtcatctgcctttagatgttttattatctggtggccccttgctgtcttagtgtcttagttagatgcatcagatcaggagccatctgggacttcattcattttgtgaaaagacacaagcataatcttgcttgatgttaacattgggtctcttcattgattcgtttctagattgtttaatgtataatttaggttgtctcctttagggcaaaatgctttggggcagtaaacaaagcattatcctttagtatgtgatgatttaagtgggtgcatagaatatcctctgtttattagaatttgccagtttagtatttaatggtgtcattccacaagagcttgaccctgtggatactaagggttttcatgattaatattaaaaaattttcaaataatttgctagcataagtaggacaattactataatttagttgcaatggattttagaaaggatatgcctaaagggctatttgttaaagttaaggtccagatgtgatagagtggtgtttttggagctttcaaggccttatgccatacctagggctgtgttctgcagccagtttgttagggagaggcattgtgcatgcatgtactgtactttgaggacatacctgatagcagagaatgtccaagacacagacagacacccatattctcagatgtcaagctgatatccattcactactaattatgcgttagaagtttggaatactatataaaatttgtctttaagctgtacaaaataatgcttttaatagaggataggctcctgtgagcctcttttagctatttttctaggcaaattctgatcttttatcagacaaacaaacaaacaaacttcacttaattaacagtggtcattaacttttttgttgttgttgttgtttttcgagacagggtttctctatatatcccttgctgtcctggaactcactctgtagaccaggctggccttgaactcagaaatccgcctgcctctgcctcccaagtgctgggatcaaaggcgtgcgccaccacgcccagcggtcattaacttttaaagatttaaagttaaggctttttatttaagattttggatctttaaaatttaggacaattttaattatgagcttcttttaagaagtctattttattaggtaacttaaaagtacctgagaaataatagaaaatcctgaagtagaaaacaattggattttcccatataagcatgaaaatttatattgagtagatattgtatatgaagcaaaattgtgaacaataccaaaaaataacagtttcatggatggagaagttgctggaaggctctagtttttactatatttcatatgcagtttgatataacagattctcaggctataaccaagaataattttaggtgaaaaacttcaaaattatttagttcttactgagtgcattttttggttttatttctctttggcctccaaggaaattagagaaacatgtaattatgtttgcagtttttggtcactaaattacctagaagaaatatttttgaaccatttcttgattccaatttacttgtattttgttattttgtaaatctatcccaatcctgtttacattgttattttttaaatttggttttgtttatgttgtataaaatataaaaaaatggattcttagtaatcacaaatataaaggaatcagggtggtttgggtttttagtgaccaaaacacctaaattgaggaaaaaaaattcatttttgtcttgttttatgtttgagacaaggactctttatgtagtcctgactgttgtggaacttgctctgtagatagtttatttatatttcaaatgttttctcctttccaggtttccccttcacaaactctccatcccatcccccctccccctgtctctatgagggtgctctcctacccacccacccactcctgtcttcctgccttggcattccccacactggggcatcaaacacactcaggcctgagggcctctcctcccactgatgtctgacaaggccatcctctgccacatatgcatccagagccatgggtccttccatgtgtattctttggtttgtggtccagtcccaggagctctaggaggtctggcctgttgatactgttgcttcctccttggggctgcaaaccccctcagctccttcagtccttctccaacttctccatctgagaccctccgtgttaagtctgttggttggctttgagcatcgcctctttatttgtcagactctggcagcctctcaggagacagccatatcaggcttccatcagtaagctcttcccagcatccacaatagcttccaggtttggtagctgtatatgggatggatctgcaggtggggcagtccctggatggcctttccttcagtctctgctccatactttgtctccatatttcctcctgtgaatattttgttcccccttctaagaagcactgaagcattcacactttggtcttccttcttcttaggcttcatatggtctgtgaattgaatcttgggtattccgaacttttgggctaatatccacttatcagtgagtacgtatcatgtgtgttcttttgtgactgagtttcctcactcaggatgatattttcaagttccatccatttgcctgccaatttcataaagtcattatttttaatagctgagtagtactccattgtgtaaatgtaccacattttctgtatccattcctttgttgagggacatctgggttctttccagcttctggctattataaatatggctgctatgaccatagtggagcatgtgcccttattacatgttggatcatcttttgggtataggcccagagtggtatagctgggtcctcaggttgtactgtgttcagttttctgaggaaccaccagattgatttccagagtggttgtaccagcttgcaaatgccaccaacaatggaggagtgttcctctttctccacatcctcaccagcatctgctgtcacctgagtttttgatcttagccattctgactggtatgaggtggaatctcagggttgttttgatttgcatttccctgatgactaaagatgttgaatatttctttaggtgcatcttggatattcgatatccatcagttgaaaattctctgtttgcttcatcctttcctctcagctccaaatattgtgtctaactccatccatgggtattttgttcccaattctaagaaggagcaaggtatccacactttggtcttccttttgagtttcatgtgttttgcaaattgtatcttgggtatcctaagtttctgggctaatatccacttatcagtgagtacatatcatgtgtgttcttttgtgattgggttacctcacttaggatgatatcctccagatccatccatttgcctaggaattccataaattcattgtttttaatagctccataaattcattgtttttaaccagcatctgctatcacctgaatttttgatcttagccattctgactggtgtgaggtagaatctcagggttgttttgacttgcatttccctgatgattaaggatgttgaacattatttcagttgcttctcagccatttgatatttatcagtcaagaattctttgtttagcaccgtgccccatttttaaatggggttatttgattttctggagtccatcttcttgagttctttatatattttggatattagtcccctgtctgatttaggattggtaaagatcctttcctaatctgttggtggcctttttgtcttattgacagtgtcttttgccaccaaacgcagacactattgcacacgcaagcaagattttgctgaaaggaccctgatatagctgtctctcatgaggctatgccagtgcctggcaaacacagaagtggatgctcacagtcagctattggatggaacacagggtccccaatggaggagctagagaaagtacccaaggagctgaaggggtctgcaactgtataggtggaactacaatacgaactaaccagttaccccagagctcatgtctctagctgcatatgtagtagaagatgacttagtcgaccatcattggcagagaggccctttggtctcgcaaactttatatgtcccagtacaggggaacaccagagccaagaagtgggagtgggtgggtaggggagcagggtggggggagggtataggggaatttcaggatagcatttgaaatgtaaatgaagaaaatacctaataaaaaattggaaaaaaagagaatattctctgtttagctctgttctccattttaaaatagggttatttggttctctggaatctaacttcttgagttttttaaatatatattggatattagccctctatcggatgtaggattggtaaagatctttccccaatctgttggttgctgttttgtcctattgacagtgtcctttgccttacagaagctttgcaattttatgaggtcccgtttgtcaattcttgatcttagagcataagctattgatgttctctgttcaggaagtcttcccttgtgcacatgtgcgggaggttcttccctactttctcttctgttagattcagtgtctctggttttatgtggaggttcttgatccacttgaacttgagctttgtacaaggagataagaatagatcattttgcatttttctacatgttaaacgccagttgaaccagcaccatttgttgaaaatgctgtcttttttccactggatggttttagctcctttgtcaaagatcaagtgaccatcggtgtgtgggttcatttctgggtcttcaattttattccattgatctacctgcctgtcactgtaccagtaccatacagtttttatcgaaattactctgtagtacagcttgaggtcagggatggtgattcccttagaagttcgtttattgttgagaatagttttcactatcctgggttttttgttattccaaatgaatttgagaaatgctctttctaactctataaagaattgagttggaattttgatggggattccattgaatctgtagattgctttcaacaggatagccatttttactatattaatcctgccaatccttgagcatgggagatctctccatcttttgaggtcttcttcaatttctttcttcagagacttgaagttcctgtcatacagatctttcatatgtttggttagagtgacaccaaaatagttcatattatttgtgactattgtaaagggtgttgtttccctaatttctttctcagttcgtttatcatttgtgtagagaaaggccattgatttattcgagttcattttatatccagccagtgcactgaagctgtttatcaggtttaggagttctctggtggaatttttggggtcacttaagtatattatcatatcatctgcaaatagtgatagtttgacttcttcctttccaatttgtatccctttgacctccttttgttatctaattgctctggctagaacttcattttctatattgaatagatagggagagggggcagccttgtctagtccctgattttagtgggattgcttcaagtttctctccatttagtttgatgttggctactggtttgctgtagattgcttttactgtgtttaggtatgggccttgaattcctgatctttccaacacttttatcatgaatgggtgttggatcttgtcaaatgctttttctgcatctaacgagatgatcatgtggtttttgtctttgagtttgtatatataatggattacgttgatggatatccgtatattgaaccatccctacatcccttggatgaaacctacttgatcgtgatgaacgatcgttttgatttgtttttgaattgggtttgtgagaattttgttgagtagttttgcattgatattcataagggaaattggtctgaagttctttttttggtgggtctttttgtggtttagatgtcagaattactgtggcttcatagaatgaattgggtagtgttcattctgtttctactttgtggaatagtttgaagagttttggtattaggtctactttgaaggtctgataatattccacactaaacccatctggtcctaggctttttaggttaggagacttttaatgactgcttttatttctttaggggctatgagacagtttagatggttaatcttatccttatttaactttggtatttcatatctttctagaaaattgtccatttcatctagattttccagttttgttgagtaggtttaaagtaggatctgatgatttttttgaatttcctaagtttctgttgttatatctcccttttcatttctgattttgttaatttggatactgtctctgtgccctctggttagtgtttatctatctcaaagaaccagctcctggttttgttaattcttttttttttttttgttttttttttgttaattctttgtacagttctttttgtttctacttggttggtttcagccctgagtttgattatttcctgtcatctacgcctcttgggtgtatttgcttctttttgttctagagctttcaggtgtgctgtcaagctgctagtgtaagctctctccagtttcttttggaggcacttagagccatgcgttttcctcttagcactgcttttattttgtcaaataaatttgggtatgttttaccttcattttcattaaattctaaaaagtctttaatttctttgtttatttcttccttgaccaagttatcattgagtagagtgttgttcagcttccatgtgtgtgtgtgctttctgttgcttttgttgctttgaagaccagccttaatccttagtggtctgataggatgcatgggatcatttcaattttcttatatctaattaggtctgtttagtgactgattatatggtcaattttcgagaaggtgccatgaggtgctgagaagaagatgtattcttttgatttagtatgaagtgttctataggtatttgttaaatccatttgggccataacttctattagtttcactgtgtctctgttagtttctatttccatgatctgccattgatgagagtggggtgttgaagtcttccactattattatgtgcagttcaatgtgtgctttgagctttagtaaagtttcttttattaacgtggatgccattgcatttagagcatagatgttcaaaattgaaagttcttggtaggttttttcctttgaggagtatgaaatgtccttccttatcctttttgataacttttggttgaaagtcaattttatccgattttagaatggctactccagcttgtttcttgggaccatttgcttggaacattgttttccagccctttactctaaggtagtgtttgtctctgacactgaggtgcatttcctgtattcagcaaaatactgggtcctgtttacatattcagtctgttagcctacatctttttattggggaattgagtccattgatgttaagagatgttaaggaatagtgattcttgtttcctgttatttttgatatgatttttatgtttgtatggctatcttcttttgggtttgttgaaaggatattactttcttgctttttctaggatgtagtttccctccttgtattggcattttccatctattattttttatagggctggatttttggaaagatggtgtgtaaatttggttttgttatggaatatcttgctttctccggctatgataattgagagttttgctgggtatagtagtctgggttggtatgtttgttcttttagagtctgtataacatctgtccaggatcatctagttttcatagtctctggtgagaagtctggtgtaattcttataggtctgcctttatatgttattggacctttttcctctaactgcttttaagatactttttttgttttatgtatttggtgttttgactactatgtgatgggaggaatttcttttctggtccaatctatttggggttctataggcttcttctatattcatggtcatctctttctttaggttaggggacttttcttctataattttgttgaagatatttactggtcctttaagttgggaatcttcactgacttctatacctattatccttaagtttggtcttctcattgtgtcctggatttcctggatgttttgggtttaggagctttttgcattttgcattttctttaactgttgtgtcagtgtcttctatggtaccatctatgcctgagattctctcttctatctcttgtattctgttggtgatacttggacctatgtttcctgatctctttcctagggtttctaactccagggttgtctccctttgtgattttttttggttattgtttctatttccatttttagatcctagatggttttgttcagttccttcacctgtttgggtatgttttcatgcaattcttaagggatttttgtgtttcctctttacgagcttcttcctgtttacctgtgttttcctcctgtatttctttaagggagttatttatgtccttcctaaagtcttctatcatcatcatgagatgtgattttaaatcagattcttgctttggctcgctgtggtgggtgaactgggttttgatgatgcccagtgttgtgattatagaaagatatagaaatatatggatatgttctgtggggttgtggttaggtattggggaagagggtgcctctgggggcccatgctgagacatcccttccctttgagggaccagctacacaacagtataatatagaatagagtttattcagggcctggggaggggagttaagagggtagtagaggcagagaaaggcagagagagggagagagtagagaagtagaggccagctatgatcatcgcatggagagaagggggaagggaaggaggtagggaagagcccaagaatgcaagagagaagcaagtgggaagcaggagtaagagagagaggaggggcaagcagcccctttttatagtgggccagacctacctggctgttgtctgataaccctggggagagcatacttgcctgttgcgaggtaactgtggggtggagtttagacagaaagctaacatcaaatagccttgatttcttttgcttattttcttgtccttgcctctcaccttctggttatctctggtgttagctggccttgctgtcactgactgcagcttgtccctcctgcaaggctgtgtgtccgtactcctgggaggccagttctctccaggaggaatttgagcatggagagctgtggcacagggtcagctctggggtgcagacagaaaccagaaggatcctgtctctggctgttccttggttcctgtgtcctgatggcagacgctgggtgacagcagtttctggttcactgccagcgggcctcatggtgccttggtggtgtctgtggtggctgtagatgcacagctcggccagaggacttgtggcccctggggccggtgtgtctgggcagaaccgtgtatgtgggccagcctcaggcatgcgtgtctacgctactgtagggcgggacttcctaccagtagcggagtcgtggcccagagtacacggtgggcaggaaaagtaagggcccaatgtagcctgtggcactggcagagcatgagtgggctgagggagctcagcgagaaggggaggagggcagcagaatccaggcctggcctggaattctcagccaccagaaataaactgtctctgggaccatgcaggtggtcactctgaccagtgggaacggggacttgccagatctgggctagcgagcgtggttgtggctgagatgggatgcaaacctgtagagtttttggatccaagtcacaccaatgttgtgatcataaaatgataaagagggccgggcgtggtggcgaacacctttaatcccagctctcgggaggcagaggcaggcagatttctgagttcgaggccagcctggtctacaaagtgagttccaggacagcaagggctatacagaaaaaccacacacacacacacacacacacacacacacacacacacacacacacacacaaagataaagaggtattaatgtatgttctaaggtggtatgatgaggcgtgggggaaggggatgcctctgcgggcccatgccaaggcatcccttccccctgagggaccagccacaggacggtatagcatagaatagagtttatttagggcatggggaggggagttaagagagtagtagagacagagaaagaggcaagagagaaggagagtgtagagaagtagaggccggccatgaccatgtggagagagggggggagggaatagggagagaggcaggagcaagggggcaagaggtaagaatatgagagtaaacatccattttactactgtataattttttattctttaataacattaaaatcacttgcatgctgtcttagttttccctctattattgtgataaacactttaagcaaaaagggaggaaagggtttattttagcttataggtaagcttgtctttcaaaggaaggagcgatttacttgtgttttacccagatttctgggaaaggatgtagtttatgacctggtgatcttttactctctgtagggccaggcttcacccagctcccccagactgttatgtttgtttattcccgatgcacccccatattaagccatagatcccatccttatgagagatgccaggtttactttacaacagcctgagggatttctgtgtttttagggccatggcagtcttgaatcccacaggcatctttacctcattctctttcgaccctttgtgttttcctcattctccctagacccttttcttgagcattgtttctaagtaaacaaagcctatttttatggaagaagccatatgtactttttaaagaatttcaatgtaaacatgtcttcagctttgttgtatacactggaaggactgacttcatcatcatcggggacctttttccaaaattgtgctatgcttaaatatggataaaataaaccaattggagtaagactccataaatttgaaccactgactgctaactaaagttgtactgaaccaatgaccaagccagctcagtcagtcaacagagtctcaagggagggagtgaggattgaaaataaaaagataattagagctaaagtgggtttattttttcccagtcagcttttataccattctaggtacatccaaagaatacagtcagttttcagatcaaagacaaagtgatcaagcaaggcagtgaacaaagagatcacaccaggtagtagtcaaataaggcaataaacaaagccccccagaatccctggctctgggggcttatcaggattatcaagacaaaagggaagtcacacatatcttggctgggtttaccttgatccttgcattagcccaaatgcagtactcttgtctggtcctacttcctcctttgagcccagtgacaagtactcgtcaaatttctattagtggccccccagagctctgcacaaaccaagtttcattcttgccagtccttggattgtttcacagctggctgtgatgctttcagggacccccacaagatttgaagtcttgaagaggtaacagcccacatggaagatgatatttcagtggctcctgtactgtttatatgaaaactgtagatgtaaaacagattattatttcatgaatttaaaaccaccagtttcagcctaaaaacttctgaactggcagccattggaggtcagagtttagcatctcaccacctacagcataggttgaagtgctcaagattttcaggttattatgaagatgacaatgttcagttgattaggcataaagatatgtaagaatcattaactgtttctaatgaattccaaactgccatagagtagattacgttcatatagtacataaaatatcagacagtagctagtgaaaacttaacaatgttagataccacatccaaggccttacactgacagtttgtagttatcttcaccaaaattaactggaacaagatactcaacccaagattggcagagaaatacaaaatgcttaaaggctgactataggcatcttaaatgcacaagaaaaagggattcagtatgctgtggtcatatgataaataagtgatttataaacataagcaaaagagatattttgctagttaacaaagttaacagatttctagcttataatattgttttgatttttgggggggactgcattctctgccttgtaattttttgttatttctatttgtaaatctttaaaaacttctgttatatttaatatcagagagatctatcttaaagtcattttactgtttagaaaatgttcccagtactgaaatctaatttctaaaaaaaactttattctatgtgtatgagttttgcctacatgcaccacatgtatgccttgtgcccactgaggccagaaggtgtcacatcaccttgaacttgagttgcttgtgttgtgagcctccatgtaggtgttggaaactgaacccaggtcctcgacaagatcagtaagtgctctttctgctgaggcatttcttttgccccaacctgtttaatatatgcagataactcttaagttcctttttcctaccaccctacatatgtttcaaaacacttcaatagtttttactgcttcaccaactgttgtgacactctagctaagtagaagtcgcgtttcttttccttttcattgttttgatcatttctagcatctcataactagtttccaaagttttagtttaggatttggttccattttgggagacaaagttttctggaaattccatgatagcagaattcctggggaacttattttttttaaaagatttatttatttattttatgtatatgagaacaccattgctctctttagacacaccagaggagggcatcagaccacattacagatggctgtgagccaccatgtggttgctcggaattgaactcaggacctctggaagaacagtcagtgctcttaactgctgagccatatctctccagccctagggagcttatttttaaatacaaagtcttgagccacaatccctccgtgccaatgaatattttcatcttttttgttttttctcattgtgtcttccctgtctagtaccattgtagttatagatacctgcatttttggaagaggttttccatattatgtttctgttctttttaagatttatttacttatttcatgtatgtgagtacactgtagcagttttcagacacaccagaagagggcattggatcccattacagatggttgtgagccaccaggtggttgctgggaattgaactcaggacctctggaagaacagtcagtgctcttaactgctgagccatatctctccagccctagggagcttatttttaaatacaaagtcttgagccacaatccctccgtgccaatgaatattttcatcttttttgtttttttctcattgtgtcttccctgtctagtaccattgtagttatagatacctgcatttttggaagaggttttccaaattatgtttctgttctttttaagatttatttacttatttcatgtatgtgagtacactgtagcagttttcagacacaccagaagagggcattggatcccattacagatggttgtgagccaccaggtggttgctgggaattgaactcaggatctctggaaggacagttggtgtttttaacctctgagccatccctccagccctatgtttctgtttaatattgaagaagtggtgatgtactatggatatggtataaaatttgaaaatgcaaatgttgaaaaagtagtaggaatctggctttattaataaaatgataataatctttaatctttttcactgcaaattatgaatagagggaaaatttatctatttaacaaatatcacctattagaaaggcaaaataaaaaaatctttacagctaatagagtaataattgtgagaagctcaatgttttctctctaagactggaataatgcaaaactgtctgttgcttatggttattattatacacattataggttaaggagccttcacctgaaaaacctaaaatccacagtgatctgaaatcagaagcaacttgagtagcaacatagtactttcaacaaatatcggaacgtttaccagctgtcttagtcagggtttctattcctgcacaaacatcatgaccaagaagcacttggggaggaaagggtttattcagcttacacttccacattgtcattcatcatcaaaggaagtcaggactggaactcaagcaggtcaggaagcaggagctgatgcagaggccatggagggatgttctttactggcttgcttccctggcttgctcagcctgctctcttatagaaccaagactaccagcccagggatggcaccacccacaagggaacctccccgattgatcactaattgagaaaatgccttgcatctggatctcgtggaggcattttcccaactgaagctcctttctctgtgataactccagcctgtgtcaagttgacacaaaaccagccagtacaccagcataataaatcaagaaaaggaaaaaagtgtagagattagagaataaataaaactatcttttataggacataaatataccaaaaccccacggaatctaccaaaatatatgtaaaaattgactagatttagcaaggcaagaacagaaactgctaaaggagtatcaagttgaaaggtcttgttccccaaatatagtaatacataaaataataaaatggctcagcagataatagcactaactgtccttccagaggtcctgagttcaattcatagcaacaacgtgttggctcaggatcatctataaagtgatctaatgccgtcttcttgcaggcaggtgtacatgtagacagtttactcatttctttttttactgtttttgttttctttgtatgtttttgttgacgattctgtgtacatttctccagtatcttcagatcatatttggaaatgaaaaagaatattcatagaagtcacaaatgttacttcttatgttgtttctaaattatttaccatttctgtctaccttttagaagctgtttgttcttgctgtgttatgtcactccctaccctaccttggtgtctttttgaactcagttatttctgttttctattctctcttttttttgagatttatttttaatttatgtgtgaacccacactatcatgtaaatgctgggaactaaacctgggtcctctggaagtgtttttactgtctccgtccctttgtcttttttcttctctctttcttttttatcttctaccacctttttctttgtgttttgatttttcaagacagggtttctctgtatatacagcactggctgtcctggaacttgctatgtagatcaggctagcctccagagatatgcctgcctctgcctcctgagttctggaattaaaggcatgcaccaccacacccagctgtgaacatgaactttgaagtcagatagactgggtctaacttgtaatcactaatattctgtttcttcatatataaaatgaaaacacaaaaattattaatatgtaggtgaaaggttttgtgcacattatacaatatatttatgtgctttttgtataatattatacaggacaattatttcttatctggagtacttgtgatcagaaatgatttgaattttgtgtttctttttcagatttggaccactttcatttacatgaagaaatatcttaggggtgagatccgtatctataattgtgcttcttacacatttcaccctacattaaattttaacttgaggataatttatatagtatttttggcaaccttattttgatgatgattcttaacagtcacatgtagaattttgaatctctgtgtcatggcagtgttcaaaaagttttcaattttagtgactttgggactttgagatttgagtacctgctgctatgtgatctattttcattgtgccagtcttaggctaaatcctgtataaacataatctcattttcattttcacaaccacttgagatatctttgactcatttaaaagtgaaactcaagaaacgtttttgttcaatcacacctaaattttggcagagctaaaattttaatttgtattaatcttaattcaaatctcacatactttctcatatttctcttgtctactgtacagtatccagtaggttgaactgtactttgacactaccataaaatgtttagttgcaaatgttgtatgattctgacagtttcttttcaggtatctttgagtatcttctgacactagaagatcctgtaaactctacagacttcaacagaattgaagaacctggacagagcagagttaccaacaagagagcccagggatagcattaacatggtggttactcaagacctaactcagccagggagacataccaaggcctatgaggtgaagggaaaagaagggtgacccaaagggcaggaattttttatcctgaacttttgagccttatagaaaaacataatttgttgggcatgttttctgaccctcatacagtttttacaaccatttgaagatatagttctagctctagtaggctctacaggaaggtatatcaaactttttaacagaacactttattattttaaatatatgagtatttcacctgcataggcgcacagtacccacagagactagaagagggtggcagatctcctgagactggagttaatgcttgtgagctgccatgtggatgctggaaatcaaacccaggtcctttggaaggcaggcaggtgctcttaatcatggaagcatctcttcagctcctaccctagttctttaattttgttttaaatttttgaggtagggttttgctaagttacttgggctggccttggactagtaaccattctgtgtcagccttctgggattagaggtatgtgctagcatgtctagcatctttctatttctttggttttccttctaattaattaaaaaatacattatcttctaaatcttttattgt

SEQ ID NO: 386 - DNA, 3758 bp, mus musculus
ggtcgtgctttggagttcctaagtcgtgccgtgctgtgagcgagcgcaaaggtagtgacgcgttttacggggagtatggcggatacgggcttgcgccgcgtggtacccagcgacctttatccccttgtgctcggctttctgcgagacaaccaactctcggaggtggccagtaaatttgcaaaagcgacaggcgctacgcagcaagacgccaatgcctcttccctcttggacatctatagcttctggctcaagtccaccaaagccccaacggtgaaattacagtcaaatagaccagtgaccaagaaggttaagaaagagacttcttccagtgacagcagtgaggatagcagtgaggaagaggacaaagcccaaggactttccacacagaaggctgctgcacctgccaagcgagccggtgtgcctcagcgtgctgggaaggcagcagccaaagcttcagagagcagcagtagtgaagagtccagtgatgacgaggaggaagaggacaaaacgaaaaagcctgtccagcagaaagcagttaagccccaagccaaggcagccagacctcctccgaagaaagcagagagctgtgagtccgagtctgactcaagctcagaggatgaagcaccacagactcagaagccaaagacagctgtggcagctaaagctccgactaaagccgcagccaaacaagctacaccagcgaaagcacagcctaaagtagccaatgacaaagcagccagaagccacagccgccgccgctgccacagcagcagcagcagcagcaacagcagtgatggctcgcaggaagagaaggcagccgcacctcccaagaaaactgcacctaaaaagcaagtcgtggccaaggcaccagtgaaagtagctgccgcccctacccagaagagttctagcagtgaagattcgtccagtgaagagggagaggaacggaaaaaacccatgaagaaaaaagcaggtccctacagttcacttccaccgccttctgttcctttaccaaagaagtcctcctcgggaacccaggctccaaagaaagctgctgcacagacaaggcctgcagacagcagtgatgagtcagattcaagttctgaggaagagaaaaaacctccagctaagacggtggtctccaagacacctgccaaaccagctccggtgaagaagaaagcagagagctcttcggacagctcagattctgacagttctgaggatgaagctcctgccaagccagccagtaccaccaagagtcccttaagcaagccagctgtcactcccaagccatctgcagcaaaggccgtggcaactcctaagcagcctgcaggaggtggccagaaagctcagagcaggaaggccaacagcagctccagtgaggaggaggccaccaagaaaagtgtgacagcccccaaggccaaggtgaccgcgaaagctgcaccggccaaacaggctcctcaggctgctggggacagcagctctgactcagacagttccagcagtgaagaggaagaagagacacctaagcctccagctaagaagaagacagccgttcccaaaccagcccctggaaagagagcggagagcagctgcagcagctcctcagaagactccagcgaagaagagaaaaagaagcccaagggcaaggctactcctaaatcacaggcaagcaaggccggtgtcactccagcttctcagaatagaaaagcaggcaaggaaagtgaggaggaggaggaggaggaggaggaagaagaagaagaagaaacagaagagaagaaaaaggcagcctggaccaagccaggttcaggcaagaaacggaagcagaatgagacagcggttgaagcagcaactcctcaagcgaagaaagttaagctccagatacccaatgcgtttccaaaaaggaagaagggagaaaaaagggcatcttcccctttcccaagggtcagggagaaggagattgaggtgggctctcgagtagcagacaattcctttgatgccaagcgaggtgcagctggagactggggcgagcgcgccaatcaggttctgaagttcaccaaaggcaagtccttccggcttgaaaaaatgaagaagaagcagcagcagcgaggcagaggctccatctccgtccaggtcaattccgtcaagtttgacagtgagtgacctgtggtcatctttggcagaggaagggtggtgttgggaggttggcactcacctccaatggatccagaaactcagtgttattaggagagaattgtggcaaggacagtgtggagcaggtcctgaggcattccagtctgcagtcatctcatgtccctacttctggacaggtttgtttttgagcattgattgtcaaggataatcaaggattttatttatttatttttaaagaaatttatttgcttgtcaattgccttcctgttctgtgggtcttcatactgagaaatctgtatattttatattaaatcatgtcatacagatttttgttgtgattttccgagatgagttccacagattacaaccttagctattgcctaaagcaaagcaaaatgtcaggtggtagtaagtttccctactggagaattctatttatgtgagtgcacagacccacatttgatccctcctcccttcaagtggtaccgatgtcagtcagtcttgtgatatttgtctgctaagcatgccctgtgctcatcttcctcaattgggcctgacacagaagcttccagaagcctcgtggatctaccaacttcaggggatacaattgcagttcttggtacagtatcctactaagtgacaggcaggattctccagtgtgtgagtgccatgcaactgtcttcgttttgttctcagtagctattactgctacatgtttacagtactttttagttttaatttcaaagtaagcttttctgacattgagaggcatttgcaacaacttgactgttacttgactgttggatattaagttcctgaatgtatttgattctttttaaacatcaagagcagaatggtaaattcctgcatggttgtgtcatggtcaaggaagtggaactgactaacctctgagtcttggtgtgaaataggtatagtggatacatcctgtgaacccgtggtggtggtggtggtggtggtggtagtggtggtggtggtaaggaggaggaggaggaggaggaggaggaggaggaggaggagaggagggagaaggggagggggaaggggaggggcaggagacagaacagtgaggttgggaggggtctgagcaggactgttttgtcttgaagttggtacatggaagtaattatgtcctgtttaaattggtccactgaaatgattattagtatcttaactatgatgatactggtatagacgagccagggggctgggaggcatagctgggtgacagtgtgctcccttggcattcatagaccaagtgtgatctccatcacggcaggaagtgaatgagcagagaaattcctgggcaaagggagtagatgataaagccataggatgtgaccactggcagagctcagatagagtgagggaaggggtaggggagagcaccctagttggccggtgagaacagacaccaggtttcatgtatgaaatatgaaggcaccacatgtcgcctcccttgtttggtttccatggtcacctggtaacctgctaaaagctgtctgtctgtggcaggtccttgaggaagtctgcatggtcaaatctctgtgtcttaatacaaaaaaataaaataaaataaatggttcatg

SEQ ID NO: 387 - DNA, 2083 bp, mus musculus
atggcggatacgggcttgcgccgcgtggtacccagcgacctttatccccttgtgctcggctttctgcgagacaaccaactctcggaggtggccagtaaatttgcaaaagcgacaggcgctacgcagcaagacgccaatgcctcttccctcttggacatctatagcttctggctcaagtccaccaaagccccaacggtgaaattacagtcaaatagaccagtgaccaagaaggttaagaaagagacttcttccagtgacagcagtgaggatagcagtgaggaagaggacaaagcccaaggactttccacacagaaggctgctgcacctgccaagcgagccggtgtgcctcagcgtgctgggaaggcagcagccaaagcttcagagagcagcagtagtgaagagtccagtgatgacgaggaggaagaggacaaaacgaaaaagcctgtccagcagaaagcagttaagccccaagccaaggcagccagacctcctccgaagaaagcagagagctgtgagtccgagtctgactcaagctcagaggatgaagcaccacagactcagaagccaaagacagctgtggcagctaaagctccgactaaagccgcagccaaacaagctacaccagcgaaagcacagcctaaagtagccaatgacaaagcagccagaagccacagccgccgccgctgccacagcagcagcagcagcagcaacagcagtgatggctcgcaggaagagaaggcagccgcacctcccaagaaaactgcacctaaaaagcaagtcgtggccaaggcaccagtgaaagtagctgccgcccctacccagaagagttctagcagtgaagattcgtccagtgaagagggagaggaacggaaaaaacccatgaagaaaaaagcaggtccctacagttcacttccaccgccttctgttcctttaccaaagaagtcctcctcgggaacccaggctccaaagaaagctgctgcacagacaaggcctgcagacagcagtgatgagtcagattcaagttctgaggaagagaaaaaacctccagctaagacggtggtctccaagacacctgccaaaccagctccggtgaagaagaaagcagagagctcttcggacagctcagattctgacagttctgaggatgaagctcctgccaagccagccagtaccaccaagagtcccttaagcaagccagctgtcactcccaagccatctgcagcaaaggccgtggcaactcctaagcagcctgcaggaggtggccagaaagctcagagcaggaaggccaacagcagctccagtgaggaggaggccaccaagaaaagtgtgacagcccccaaggccaaggtgaccgcgaaagctgcaccggccaaacaggctcctcaggctgctggggacagcagctctgactcagacagttccagcagtgaagaggaagaagagacacctaagcctccagctaagaagaagacagccgttcccaaaccagcccctggaaagagagcggagagcagctgcagcagctcctcagaagactccagcgaagaagagaaaaagaagcccaagggcaaggctactcctaaatcacaggcaagcaaggccggtgtcactccagcttctcagaatagaaaagcaggcaaggaaagtgaggaggaggaggaggaggaggaggaagaagaagaagaagaaacagaagagaagaaaaaggcagcctggaccaagccaggttcaggcaagaaacggaagcagaatgagacagcggttgaagcagcaactcctcaagcgaagaaagttaagctccagatacccaatgcgtttccaaaaaggaagaagggagaaaaaagggcatcttcccctttcccaagggtcagggagaaggagattgaggtgggctctcgagtagcagacaattcctttgatgccaagcgaggtgcagctggagactggggcgagcgcgccaatcaggttctgaagttcaccaaaggcaagtccttccggcttgaaaaaatgaagaagaagcagcagcagcgaggcagaggctccatctccgtccaggtcaattccgtcaagtttgacagtgagt

SEQ ID NO: 388 - DNA, 2083 bp, mus musculus; identical to SEQ ID NO: 387

SEQ ID NO: 389 - DNA, 187913 bp, mus musculus
agacacaccctccttcttaggccactcaggtcggggcccttggtgagagggagcagccgccgccgcccggcaggacccagagcctgcaaaagctagagcaaaaaggagggaaagagggaggagcggcgcgcgggaggaggagccgcgggagctgggcgcggggcggcgagctgagatgtggccggcccgtcggcgtgtaaacacaggcagcagcagcagcagcggccgcccgggcccggggcactgagcgctcccgccgagacctgcccgccacctctgccatggccgaagtgcgcaaattcaccaagcggctgagcaagccaggcacggcagccgagctccgccagagcgtgtcggaggccgtgcggggctccgtggtgctggtgagtggtcgagcgacggggagtcccgggggggggggggttcgctcacaccgggagcagcgcggtggcttcccgcgcgcgcgctggagaccacgggcaggatgggcgcagctgcggtcgagcgctaggagctctctttttcctctgttctacttaagttttcgctctggcaaccggctgcctgggggtgggagtctcaggcgccacgggacagcgctctggctaccccaccagcttgcgctgggctggaagctgaatggcacagcgggtttcacagagctgcggccggagagtgggtctccaccccagcgggggcggctgaaagcttcagatcgcacctcccgctcccccggacccccgcacaaagagctggagattagggcacgaggagatccggatccctttaagagggcacctggggcagcctaggcggaaggatgcgatgagcacagatatacttgagtgcggatacacatcgggtacacgcgcgcacacacacacactcacttacacacacaaaaaaccccacccaaaagcccagggcgcccaagctctggcgggcgatgtggacagaggaagcatagcgacttcctcctgctactggggagagggagggtggtgatgggtgttgaggggtactgccaactaagacagagggagaggattggaaacaacgggggtgggtctgcgcctgagtgggttttgagtctgtatcctctgggagaggatggttcttaagacttgtgagcgattggaggcaagaggatgtgggaaggactggatgttgctgtgtaaggatgaagaccctagaaccagacgcctacgtagactattggggatgtcttggcggcgggtagagctgggggatggggattggagagtgttctgacacccccctcggggaaccacccctcccccgcacgccagcgcaccctcatcagtcctgttcagatggtctaaatctggagggaagccttggatggtaaggggcacttgctcctttgcttttaaaggctcccattgccaattttttggactagggaccaaaccttaaataagcagtgggactaaatcattagcgtgcttttttgttactttgttttgcaggagatttgctggcttttgtctctttccactcctatattatttcatgtcattcgctgtgtttaaatctccgcacttaagagagagctttttgttagcacaacttatcctgggaagggaacctcgcagcttttccctgtaatttttatgttgatcttgtagaatcggcaataaaaccaacattaaagcaaggcaaggggcctgatcctaacagtggggaaagttgacattagtgggaattctggaagaggatcaaaggtaaaatatgtacctttgagataaaaatcggatttctaatagctgcaactgtgcagagccaagggactttaaagaaatgtctttatcatggctggacccttgaagtttaatcctgctgcttggtgaggctaaacccagacctttaatgttgtcttaatggatttggcttattgtatatttcacccagatttggagccagaacctgttgaggtcagatcagaacctcacttgtcatcagggccatttgagagaggaccacaagctgtgtgcaaggcattttataccaggttgtcatcttcagtggttattagcaagtgatccagacagcctagcacaaggatggcttttctaaaatcataaagcaaaccttctctgaggagtggctggccacctaccatagcatgtgaagagagagggaagatggacagatggtatcaagaaaatatatgaggcacagacaacctctgctgggatttgaccagcatttgacctgcctccctcaacagtaaaaagttattattctttctgaagttttaggctttgaaaagatcagttttgagacatggtctcactctgtagcccaggctagaactttggttttgtacttggtgttagtcctcctgcttcagcttactggatgctaggactacagacatgtgccacctataatttttgtgcagcacaggtgcagtggcttctttctacctcttcattcttggcagtgctggaaaaaaaaaatctattaatagagaaagactcttggagctacagcccgtggccggggtttcctggttagctgaccttacttaggttctttttttttttttttttttttttttttttttagcttttatgcaagggaatgtagaggagtgaaatctactcatttctgtggtatgtgatgtgtattaagacttgaggggagggcgagttgaatgagaagtttcttgtgctctaaatcaatccattgagcccttacactgtgtaagacatgatgttaggtgctttaggaccttttattcatttatttagttccaatctaaggggtgtgtgtgtgtgtgtgtgtgtgtgtgtgagagagagagagagagagagagagagaaactaatcgatatcagggtcttcaataatgctatttgtcaattaagagataaataactctaaacagtatattcactctcatatattactttccctcctgtttgttgttgttgttgtttggttggttggttgttgttgtttacttcataggcctgttaaccagaggtaggaaagcagggggtgactggagagcaaaacaaccacgctgcagctgctgtcagcttctggttcagttctgatgtaagccccaagtgtttattgagggacagctgaggtgggatttacacttgctgccataaacccaagatagtattagagtttcagcataagttggagtcattagcacagcagggcacacttttcttcccatgtaattcttgacagaacttggaaaccctaccaagctgaacaaatatacactatttccggtttagttttttttttcttttttacagttacacccttattggcatgcccataacgtcattcagttttgctcactgttcaaaaaaatgcacaaggcttgggccctggctatatatagcatgtcattattagtatttccatgaatctattaactatgtaatgaaacgagcagagaaagagaggctgcttcacggctgcatgttctagtgagttcagcatttttatgaagatcagttttaaaccagggaaaggaataattatcaaatcgccattgactaggataccttaagagagccttgggaagtggcaagataagccaccagtgagcacagaggctaatggaaaatgttcacatacatgcatttttaaagtgcagagttatgtggtttttgttatacttcaggttatagttcttggtgcctggtgcggatcaaaaacatgtgagaaacctgctgtatctcctagtaggggtttaagtagtgcttgctacgtatgatcaccaaaaagttgttagatattattacttgaggcaaggtaatttggatacgtcctttggctggtgtcaagggatttcaaattagagtagctagctctctagaattgagaaaggctgacaagggtcagcagctgttcacttcctccatccgccattcacaactcctttgagcagagtggctgtcttgcttgcctttaggcgagagctggaaaactcagcagctagcttctgttccttcttcccaggggggttgtggaaagtacttaatgtaggacaaaatctacagcttcatttggaaggacgtgacatttccactgtggaataaagtgagattcaacttggactttcccctctctgatgttggggacagaactcatggctctgaagtgtgctagatgttaatctactacttagccacactcttagcaacttggctgtgcttgtttacttacttgactcataatgttcctaactcagcctcctgaatgctaggggcttacaggtatgtacctccatacctggcttcaattttggcttcttgagcatgcctttccagttcaaagatttagttgggttcttattgagctgagagtgagatagttagccacagccttggcacctgaacataagaatcccttattattccttttggtagcttctcttgttagaaggctttggggtgacacactcctctaaagtttgtccaaaggaccaactcagttttttaggaaaccaaagaccatttcactgagccttcactgaagcagcaaatagaatctttatactctctttttggtgcaagtgtgtgtgtgtgtgtgtgtgtgtacacatgcagaaatcagagaacactggtgtcctgttctgtcacttgacaactaattcccttgaatcaaggcctctcagtcaccagaactagccattctttggctagactgatctatcttcttgtctctggacccatttccactatgcccacagccacacctagcttttaaacgaggtgttggggacataaatttaaatactcatactggaacagcaagtattcttatacacttttctttcttcccagtcctagaatttgttttctaagtttagcatgttaaggccatcctccagattgagactttccatattctgattaccagtgatctttctttaaacatttattgctttgccacttaaaaatacttattcattaaagaaatcttagaagagaaaaaatgaaagtgtcactatgtcagaaggaactcaatattctaatgtatgtattttgacttttatatataaatatttaaatgtttttatattgtggtcatgcaaaacctctagccagcccttaagtaacttttctcttatctatatctcatttatatttgctcatagtagccaacctactcttgcataagcatatttaatagaattgtcaacaatcttattaggagtttttatagataaagcatccttcattggtttattctttatagtttttagatatattttgtgtgtgtgtgtgtgtgtgtgtgtgtgtgtgtgtgtgtgtgtgtgcatgcatgtattgtttgtgtgtatacgtgcccatgtgtgcatctaggcattttcatcacagtgcctatgtggaggtcagaggacacttttcaggagttgcttctctgctgctttgttaaggcggggcctctcttggttttggtgagctgtatactccaggctagttggcccagaagctcctaggcaattctcttgtctcaacctcacatctctcagcgggagggggcctggaaggacaggcccctacacctgaaggacaggcccctacacctggctttttatgtgtgttccagggactaaactcaggtcatcaggcttgctttgctagcccttttacctgagctgtctccctggcccagtagtttctagtttcatgctgctgtaaacaggagttgtgtagtgtcatggatacgtagattttcactttattttgtatattgacatagtgtctttctctgtagccaaagctgactttgaatttgtaatccttgtgcctcagcctcctggaatctcaggcattcctattgtgcctgacactttaaaggaattaaaatcacttcctaaattgcccttgccttacttcagcttcttagtagccatatgtggttggtgactagcttattagatgctgctgaaatactccattccaccattgcagttctgttaacactgagtcaaacagctttgagagggtgttttcagatttgctagagtttgcccgtagaataaatttttggctatggaattccctgttcaaagcccatatgcatttttaggattgaaaatgtctcttaggggtagagatgtaactcattatgccaggccttgagctccatcttcagcaccacaaacaattccctattaaaaatccaagccaaaccaaaccaaaccaattctgttaaattgttctgcagaaagttgttccaatgtactccaccaatagagcacgagagcatacatttctcctctcctgtcctgacactggttaagagtcttcatctttgtaatctggtaaattataaagagtacaacgatgttgtaatgcatatttctttgattattgttgaaattgaataatgtttcctttgttgatggcccatacatataacttaaggactgggatccttgactcagacttgtttccttgttttggattcttggaatactcatctcaacccttcacaattctgtttggctaagtcaagggtggggccacacatccatgttctttaaagtcacccccaggctgatctgggccactcatactccaggcgaaaatatcccctagatacatctgaaaaaggattcgtttagattctccttaaagccctcttcaggttaggaggctctgttgggaaacttgggttgaaatttactatgctaagttctgtgctgatctgcaacaaaccctcctgactggaaccacatggaatgcttgcttcctctttcatctgacaacccttgaaacatgtggagatcaccaccaggccatttaaattttcattcttcaccaggtcagagagcctttgtttcattccttcattttacacatgacttggttttaagagtctccacaccatgatcattgtgtttgacttgtgttcagtttcctacggaacagaagaggcagagcctgggcctggagtgagccctggtgtgaagtccaacttctgctgctacttgcactgtgaacaaaggcaggtaaccttgtctgtggaatggggacagacataagtagcaccctcgtgaggagtaaagtatgaagactggtggacaggtagttcgtatagtattaaaatgaaggtccagagagagacagttttcctggtactacattgaccatgctgcagtgcaagaccacagattcaagaacatttgggcaacacgaagtggtcttaattggtttaaaatgcaaaagacacaaagttgagtgtgctgggaagattgtggtggacatgatcagaacaccaaaatacgttgtgagagagagagagagagagagagagagagagagagagagagagagaaaatttgaaaaaaatcagtagagtgttaaacaacagcaatgaaacaaaacacctcagtattattccctagtccttggaggtatgagcacatcatagggtgcctggaatgcagtaggtgcacagtttgcattttgtacatagctgtgggatagtcttacgtcttgggagaagagcctaaaggcaggaatctagtgaaaatatatagtccaggagaatgataacagaggccttaactgaaaaagtgagaatggagataagagccagttccgtgattaaatctaaagcacgtggtgaatgttgaaggggtagtgggaacatggggaagagaaacaacagggaggaagagggaggtggagtcaagctaattttgagtttttacagcttaggtgaatcggaggaaggtgatagagaaaggaggagaaaatgagcatgctctatttgaaagaattgtgagggtcaggccaggtttcaatgagaaccttctaaaaggaggccgggcatgtagggttgtattttggcagatgcctgaggttcttgagggcagagaggaaagtgttccaagtggaatcaggaaagggaggaaggaccaggagaagagcagggctgagctgaactgacaaagataagattgtagggggtgattagctgatggaggaggcttgcaccttttgggggaagattaggaaggaggagtcagggtagggaagaataatctagaggctagccctagactacccattagaatgatagtagaagttatcacacaatagacacacacactcacatactcatatacatactcatgggtgcgggtggggagctcttgctctggcagttggctttagtagatcttgggaatgagaagctagtgagattcctttgggtgcccagaaagaataatataatagtttctacccttaagggactcctgattcagacatgaagatgggatgcacagtaataactgatgtagagaagatggaaaatagatatgagggtataattttgtcttctgtcttcagttggttaatcctgttacccttgtcccagatccctgacactttctgaggtttttttattttattttatatttgtttagactttaatctcttctggccttaacaagactgaataggccttcactaaggaacactgggaatctgtgtgacttttcctatggagttcccctcccccatgttttataggaatggtgagagctagcagtgacatggaatggtgagaaatttgtagtatatgtgtgttgctcacgttgtcattccctttcttgacctctgtggactctaatcagtggttgttaccttccaaaattccacacacacacacacacacacacacacacacacacaagtatggcacaatgtgcttgtgaaggtctcctttcaccatgtaggtgtctgggattgaactcaggtcaggaagctttggtgatttatcttaacctggtgagccatcttactagtcccacccttgctttaaaaaaatctgtggtttttaaatgttttgagaacttcatacttgagcagtgcattaccataactcttacctcctctcactttcgaagtcctccctcccatctcctccaaaattcttgacctcttctttaattattacacacacacacacacacacacacacacacacacacacacacacttgcacaggcatgcacacacggagatgctcaacctactgactccatttagtgttacaactcagttcagaagattaattcacccaactgacgtttttctatttttctcctaagatacagtcattgagaagatgtgttgaaaactgtattttttttttttttttttttttaccactgaaccggaagccgcgggagggagtgggagctcaagcagttcctcctttcttatggtttttgtttgcttctgttttgttttacaatgtacaaaccaaacgaggacttttagaatacatttcttcttgggattgtgatttcctgatttcctatagatttttgccagcaaggcgcaagaattcctggctaacattggtctgccatttgtatcagtctggagccagatgcctttttgattctttgcacagccccaccctagaggcttcctgagcagaaactggagtggggcaagggggcagtctcaccaagctgctgttgcccctaagctcatgcttgctagagcaatgggtaagaaaagccaactgctttcgagcaggatgacaccaggccagtacatcaagaaacacattagaacatatgatccacatgagtgttgtgctaggggagacagattggttggtaaaacgcttcgatgaagacaagtgtggtcttgagctccagaacacatgggagatatgccaggtgtggtggtacacccttgtaatcccagttcagaggaggtggagcccagtggagccctgggctcaatgctcagccagtctagcgtactctgtgagagatagttggttggggtgaggagagagagagagagagagagagagagagagagagagagagagagagagactatgaaactgaaaatgaacctgagaaagcacacagcacacacttgttctctggcctccatttgcatgcgcacgcataccttcctgagtatacctgtgctctcaagtgcatggtaacacacactcactcacacacacacacacacacacacacacacaaatacaaacaatgccttgttgcttctcagtatcattccaaggctttatgtcctttctttgtgttattgggataaaaccccagggcctcacagatgctaaccatgcatgctactactgagctacacccatagtcccagtgtccttttgtattctgccattcaggttttgtaataacaagctagattctgttaagggtggcgtatccagctccccagtcaagtctgtcgggaaacactgctacacgtggtttctctattgttcatgcaaaaccttgcacaatcacacctaaattttgctcttaatgatttcctgtgattctttgccactttatttttattgcctacagagtttatcatccacaggaaggctcttcctgctttcttgacagcttgtgttggactgcctatatttcaagttgctgggaagcattagaaggtgttcagagttttttagttcccccaccccacccccaccccatggtgctttctctaatgacagaggtattttaccaagtgagatacaactggagatactttgccagtgtgctttgatgtccttgagacacaatatctttatttgaagctttttggtgcattgtgatggaaggccagctagtttatttgtgtggaatatttttcagatgatgccaagtccttatatttccataaccccaatttttgtttttgggattttctttatgttactatatgcatatagatatttcatttgcattcatatacatatctcctagaattggagttacagacaattgtgagctgctaggttggtgctggggaatagaacccaggtcctctaaaggagtagccagttcttttaactgcggaaccatctctccactcctgttatagccaggatttgaaggagagttaaaagggctgctaggtctctgatgtcatatggctgtgggtcagtgttaaacatatattacattgctatcactcctatgctataaatggagaaacagaggtgtgggttctagtgaggcaggccataggtcatccatcactttcaaatgataggaccggtaatgaactccagctgtctcttctccttcagagtagacatgtgaaaaaacaacactggtgtgcctcccaggatccacaagtaatcaggggaaggaacttcctgtgtagcttggtgatgtatataggaagccatgtctacttctaaacaagcttggtttctatagtgggaaagtagaagttacggacaagattattattttatgatttgagaactggttactgtcagctggtcttcctttctttactatttgaataaatatacagaaaaagaacatttcagaactttagctctgcagaggtacctaggatcattttcctggaacttcttttaggatttttattttttctttttcaagttggttagttctctccaaaaacaacatttatatttctttccatgccttttatattagtagttaagttttctcaattgaaatttggctgactttctgacttatagggcctcttgtcacagtgctcatgagtacatggaacagtgctgttggcgcagccagtttattttcacaggctaacaagttctgagtgcttcagtgcaccatatggcttcagagagacctgaaggaaggaatatcaccatccacggtgtctacttaccaccaagaaatgactgatgtccaaagagacttggcatcaactcttgcataaactaaacagaatcattatttagtgtgtgtgtgtgggggggctgtggctctcatttgtgtccgtcggagtgtttatggcatgctctattgctccggaagcaaagaatgctctcctttcaaacatgttccacagtgacttgttccttcacttctagtgacttctagtgaacctgactgctcacagagaaaattggtgtctatctgtccctaccaaatagtctgtcagaattcaagacgccactgtaaattacataattggttctggagaaattagggtctggatgtatattagatgacaatattgtaaaattgtaacaatcatgatgtgtttgtatagaatgttcctgtccttcgggacacacactgaagtaaaatgtagtgatgtctatggccaatttttaaatggttcaattgaaaaaaaaatcagtatatgtatatatgtacacgaatagaatgcatgtgtgtgtatttctgtatctatatacagagagcataccactgatgagtctagatgaaatgtaaatggacatttattttcctatttgtgaacattttatatagatttgagttttcatattaaaacattaataaaacaaaaaacaaaaacaaaaacaaaaagagcgccaaagtgatgccaaaaagaattcgataaggctccttgcttcaattttctaataactcactagctttctccttgcctcccaccctctttactttctctacttagagtgcagtcctgctccagtttaggaagcatcaagagcttcttacattcagtgtataaactgttggttgtaccctgtatgcttatatttatttacttgcttatatttattcattcattcattcacttacatcgagatgcagtcttatacagccaggctgtcttcaaacttaacatatataaagattttatattgtatatgatatatttatactttaatataaattctatatattatgtcataaatcacatatcatttcatgttatatgctatatgttatattaaatatttatgatgtatattgttgcctgatgtggtggcacgtgcgtttattcccagtactcatgaggctgagatagatagatctctataagttcaaggccagccttgtctatatagtgagttccaggtcaggtaggactgcacaatgtgaccttgtctgaaaaacaatacaaaaatatgtgtttgtgtctgtgtgtgtgtgtgtgtgtgtgttagatggaaccaatagactcccatacactgagcaggtaatataccatgtattacatttccagctcctatgtccctaatctgatctcttgcctatccatatctgagcccctacttggtttcctggcaggataccagctcctctgcaagtgacttcttgtcatactgttagttctcctgagcagggatgctgtgcctttaccatgactctacagctgctcagcttagcctctattcagctgaacagtatactgagagagggaggggctgcttagcaaactcataggagactgagtgcccaggtaagaaggtctagcaggtagacagcatggaaagttggactagcgagacatatggtgcatcagtttcccactccttacttaacacaaacttagtgtcttcaaaggacacagacttttatttatttacttattttattgaaaatgatttttttcatgcaatatattctgattatggttccctcccccaaatcctttctttttctcttgctcattagaaaacaaataggcataaagtaataataataataataataataatccctaaaataaaagtaaacaaaccagaataataagacaatataactagtaagaaaaaattgccacagaaaaagcacccatgaaacataaagatgcagagacacgttcattcacatacatagaaattctataaaaacaaacaacccaaaatccagtaagcaaaggacctgtaaggttaaaccaacaaacaacacccagacaaattattaggagacaaaaaatcctccaaaaatactcttgagttcattttgtattgggcatctactgtttagtatggtacctacctgtatactccctgtttggaaaaaacggatttttttcctttgcaagtgattgtcaattagagataacttctgggttggggatgctggcttgtatccactccctgtctcagtgctgacttcccatctggcttacacctgtgcaggtcctgtgcatgctgccactgtctctgtgagttcacatgtttgtcagtcatgtgtttagaagtagaaagccttgatttcttggtgtcttccatctcctctggctgagcctgaggggagggatttgttggagagatccaagttaggattgagtgtcccagatctttcactctccgtacattgtctggctctaggtctctaattttgttcgaatctactgtagggggaagtgtcctgatggttgctgagcagggcactgatctatgagtatagcagaatgtcattaggaatcattttattgctgcatccctttagcatagtggttctcaaccttcctaatggtgtgaccctttaatacagttcctcatgttgtgttgacctcaaaccataaaattattttcattgctatttcataattgtaattttgttactgttatgaattataatgtaaatatctactttgtaggatatctgaaatgtgacccccatgggggtcaccaaccacaagttaagaactgctgctttaacaggacaatagtatctgcttttcccctggatggatagcctagccagtcccagaaaggacaaagaaagttttggttctagaggttataagtctgacacaggtttcactgggatgaaaccaaggtttggcaaacctatactcccttcaggagctctagaggagaatcctctgtgttgccatcttctccagtttccagagggttcctacattctttggtacctctatctccatcttcaacccagcagtggctggccatgttccacatcatagcatactgcctctgcttctggcctcaatactcaatactcaatactcaatactcaatactcaatactcaatactgcctctgattagcctgcctccttccatctctcaattataagatcccttgttttgttttgttttgttttgttttgtttttgtggtatttgtgattgaaatcatggccctgcacatgttggacaactgctccatcactatgctatgctcccagccacatataagaacttttgtgatgactttggtcccacctgcataatgcagtgtggtcttcccatctcaaaaacaaaacaaaacaaaacaaaacaaaacaaaacaaaagaaccaaaaacctttttaaaaaaaagccttaatttaatcacatttgtgatttcctgtaatgagtaaagtaaattcttagggactgagctgaagccatgtttgggaaaccttttttgtacgtaaaatccatgaagagtggctaaaggtccatgagttggtgggcaggtcccgaggttagatgggttcctgactttataatgaaatagaagaggaacgggatctcccagcattgtagtaaagaagcatggccccttttgaggacttcagcttcaagaaagcaacgcaggcttgtcatctgtgatgttcattcgcttgttttctgaaatgctttataattaattattttccccaacagaggactccgttggtctggatttcttatagagagggtgctgctttcagacttaaggtgtttgaggatacaagttggccagacacatgcaggcacctagccagtccaggcctatggaattttccactctcagctaaggaaaaggggaaaacagtaagtgtatgcaggtgtatgttgtggggcactgtagatagatgtagataaagggaaagggatgatttcacattgccgaagaactctggctcacaagtcccaagatgcctctcacatgtcctttgtaatagatacttcacctaggctgaaggtcaagttagatggggcagcgcccttcagaactttcaaggaaattgcaggaccccttgccaggtaaagtgtccaaaacacacggttgtagaaggcagaggaaaagacagggaactttctgagttcctttttgacgtcatgatgattttaactgagagataaatcgaaacttcctctctccgtagaaggcagtccctgacattttagagagccacaccatcgacacttttctttctggctgcttttgtttcaacctcctcatgctgaccagtataatacccacggtggtctgatggcaaagctccttgcaacactgaagaagcactctatcatagtggactgtgtttgctatttttaagcagttccaattggccgcagctacgcttctccctggcttaacctatccttttacaggtcctcgggtaactgatctggctgtgcattgaaaatccttatgaaaaggtccaggaaaatcacagattttgtttcaaaatctggagctacaaaatgtccagcaactctcttcactttcttctatttcatgttcttttcttttactctccaattgggaaaataatttcctttcttttgctaagctaacttaagataaatcttctgatattttcagttgggttgtattaagtgttctgctgttatatacactaatttttaattatgcaagtttattaactatagtcctgttcgagatttctttagagagacttctaagatggcatttattttctccaagttatgggttcttttccttcatactggcggcctttaatttttagtttgttttcccaatttgctgatctctgctttggggcctcctcctttctgcttgccttccactgagctccatgacttactggtagtgtacactacattgataaatttcgggacagacatgatgccttagatgcctggaatgtcttggcctgttgtagatagcagaagaaagtagaaagtaatgtattgttggagagggtgctaactggtgagaaaggtatgttgtgatgtggttgatagctgctttggctgatgatcaatacagatactttcattcagttgatgctaaaatcccaagggacatgcttttagaactgttgcttgaactgagcagaagcagaggctcattttctgctgatttccttataatggattaagtctatttagagcaaacttgtaagcataagagaaggcaataggatataatctgagagaattgaagggtgtgtgtgtgtgtgtgtgtgtgtgtgtgtgtggttacaatagtcgaaaagaccagaggttaaaatactaacagtattcaaaatcagtgtgggggcagggaggttagcagcctatatttagagaactagagaggaagaaatcaaaagctttaaatcttgtgctaggtaagtagaatggctttgtgagcagacaaatgcctgaagacagtgaaagagtcaagaccccaaatcaagtagctgaggaatttcaaatggaaaaccaactgtccaaatccaattgaggtccccgtttactgaccacctgacaccaacaggtgttttgggaccccagggtagaggggggatttgggtaccagacatgcctaccctgttttcctttcatcctagcttttcttagccctgaatagcaatacctcacacctgttccaaacctgtatttcttgaggcagcaaacccggctggacaggaatggcagcaaatgaagactgcctccgaaccactgtaactctgcaagagcagctcccaccaggtctggcttcctcttactatttcctttcttttctcagcacttttttttctttttctcttttctaacttctactcaacactaactgatctctcctcagagctcctcttgctcggcaggcactctaccactgagttatactcccagccctttctctgcatgcatactccccatgatttctgttcctagtatttatatccctgcactgccacattttaggcaaatccatgaccctagatcctccgtgctccacttcatggcctccctacttcactttccaccatgctaactaacatcccagtgtggacacatgcctactttatttcctttcttccttctctctctgtctctctgtctctgtctctgtctgtctctctctgtgtctctctgtgtctctctctccatcttctctcctttcctaatgctagaatggcaggtgggcaccatcacatccagttcccacttctctctgctcatcttttctccccgagtcttttctcctatttgactacaaagtgctcaccatggggcagagacattactttgtttatttttttaacctttttttaaagccaagggtggaaaattccaaaggcctgagttagtgatggctaggtgccttttctggaaacctagtaactggactgccaagggaatgtcatgggacagcacatctggaaaagccgttccccaaaatgtcctggttttgaatttaggtccatgtgaaagaagaggaggtttttagccttgatgaaatcaatcattacaactgaacatccgagtttacatcactttctttttctgtgctgctgggcttcattgggaaatcatagcctttggctttttaggaccttctagagtccaaccttttgcataagaaacaaatacatctctcacagctcagcttaattgatgatttcactttgttggagtcattgtttggcagaggccagctccatttcagagcaactggagtgggtctcctggggcaggggagcatcctcccagatgttactaggtggagctgagtagatgaaccccaccctcatgtgtcttgcttcgtccctgaagaaataacctgggcagggttttgcttgcatatccctgagggctgtaacaaattaaaggtgactatcttgacaattcgccaaaaagcaatcttcttttttttttttaaaatatttatttatttatttatttattatatgtaagtacactgtagctgtcctgagacactccagaagagagagtcagatctcgttatggatggttgtgagccaccatgtggttgctgggatttgaactcctgaccttcggaagagcagtcgggtgctcttacccgctgagccatctcaccagcccaaaagcaatcttcttgaaatgcatagaaagtagttcatcattctgctgcttctcaggaaggtaaggggaaacaaaatccctaagaccagaaaaatgccaactccatttgcattggtttcataaggaagcacttagaatttcttcaagtcacccagtatataggcttacctttgtcccatcttcccccaccacagcctcacctatagattgaaccccagcctctctgagctatcactgcttccaaaaaagacactatctgttctccccttccagcctttctaaacctccctcttaaactgaaatgaccctccacccttctcttatcaaagggaaacctgtccatcctacagggctcataccaaatggccatcttcaacactaccacttcactgagtagcatattttttgttttgttttgttttgtttttgttttgtttttgttttgttttgtttttttctctctgaaggtatgtagcatccatccaaaaacatgctgtagactaagtggaatgaaacaatacatttattccttcatagttttggaggtcagaggtccaaaaatcagaatgacagggccaccttccatcagaagacttcagaaaggtgtctgttgctttccctaccagctttgttagctcccagcttcctgggtccaaggctggatgactctggtctttgcctctgaaggtctgctacacattatctttgaatcaagacaaattacctctgctcttttcttatattaaagaacacttgaaatagcatttagagcctggccttataaaccacagtgatctcctcatttcaaaatctttaactcaaccacatctctatgtgcctttttgccataatgtcacattagaaggttccaagctttagacaggggtacgtgtttcagaggccattcttcagatcatcttactagtgttaggttttagagtgtattgatttcattctgtctcatcagtgtaaactgttgataactttttcttccattagaatattgatgccttaagggactgcaggagagtagcaaaagctaatgtgcagtaagtagtccatgtgccagaggactcagcatagcacttttagtttgtattaacactggggacttccatgcagtcatttgtaaaagggaaagaataacattgtctttgggacttggcagaactgttaagaccaaaagaaacacaaattcaagtgttcaaaaataaggggtagggacttgagagatggctcggtggttaataatgaatgctacacttgcaaaggatccatgcaggaagacttaaaaccacctgaaactccagctcctggggaatccagtgcctctggtctctgcatatacaccctcacgcgcgcacacacacacacacacacacacacacacacacgctcaaatataataatgaaccttttaaagtaaggggctaggcaaattaacacccatacacaagaaaacaatgcaggcattgacatgacttctcactatatgattcacattaaggaaaagtttcacttattgaactgcatattaagtatcatcctatctctgtagactaatacacatctggtaggtgtaaatttagctatttaactactccccaactttgtttcctcatttgcaatatgggtataatgctggtgtagactacaacaggaatgttgtgacacttaattaaaacagtaaaattcttataactgcatagcacagaagaagtactgaattaatatagacattggatttactgatattctcaaagaaagtgtctgtgggacatttgtgtgtttgtaagcagcatctccctttccctctgcacttgtgtgccattttccttactagcgtgcacatctttgaatgtgtttctttcttcttgtctttgtctagcttctttccactgcactgcccatcccagccttttcaagtaatacactcattatgtataagatggacatgtaaaaatatatttgtatttatattgagttttgaatacttccccataacttaaaaataaagagggataaggtaatagtcagaacataggatgtttagtctagagactaatggttgttctatagtagaggtagtacaggtttgtactcatagaatatttaatatgaagagtaatctctaatatacactgtagactttggttgtcacatcagtttggctttatttctttcttgttgttcttttgttttgtattttcagacagagttcaactaggtagtctaactcttactccttactatgtagaccaggcaggtgttcactttgtggtgatcctcctggctctgccttctgagagctaagataacaggcatgaaccaacactcatggcatgctttctgtttttaaaacctttatttttttacattaatcacagtaatttttaaaagcagaaaagtagatttcaggacaagaactgtacctttgaatgattatgtttatatgacagacacttatatagcactatctgtaatttactatatgtttaatatttttagacagggttttcctatgtacctctctacctaacctggtactggctatgtaacctgatctggcctagaactcctggcaattctcctgtaccaggcttccacatgcaggaattataggcatactctaccatctccaatttactatttatttagttgtacatacatgtgtgtttgtgtgtggtgtgtgtctatgtgtgtgaatgtctgccatgtttgtacatgagagtgttcatggaggctgtaaagagggtgttcgatcctctggagcctacgttacaggcagttgtaagttgctgggcatcggagccaggaaactgaactcagggcctttagaagaccagtaagttctctaaatcactgagccatttccagtcccatttattattattattattattattattattattattattattttcttatgtagctctgtctgttctagaacactatatatagaccagctgtcctcaactcacagacattcacctagctcttgagtgctgggattaaaggcatgtgatatcacatccagcttcaagtattattattaagacaatttcttctacagaccttcagacccttgcccagtgatttgtacatctcaagttctctgttcaatgaagacaattttccgtggtctggaagttacagactttggttcctattccctttcagtcctgcttgctcagttttttcaagctttcatcataatatgctttacttcctttgcctccttcttcccattctgtgtctcaaaagcagagtgtctcaactttcctagtgctgcgaccctttaatacagttcttcatattgtggtggtctccagccataacgttattttcacaaatacttcgtaactgtaattttgctactgtcatgaattgtaatgtaaatatctgtgttttctgacggtcttaggcgacccctgtgaaagacttggtcaacccccaaaggggtcttgacccacaggttaagaactagagtctgcctttcttggcaaatctcactatgtagttcaggctggccttggacttgtgaccctccagtctcagtcttacatttgcagagattacaggttgtgtcagcacatctcattttataatgtgggtttgttgttgttttttttttttttttttttttttcagagagagacaggattttattctgtagcacaggttagccaggcactcatatagaccaggctggcctttaatttgaaatcttcctgtctcttcctttcaggcactcatatctgtgagccaccatatatggtgggggcttaaaattcaaataaaattcattagtagtttacaggcattatggttagaaggacttaaggcagagatttttcttttcttttcttttcttttttttaactaggcttgtgtcttggttcttttatttaaaaactttttttttttgatcttttgacataggattgtcctgtgttagaaattacatgtgactttgcaaagcatgtcaatagagtttatttaaaacaaaaagaataagtgtatgcttaaatgatataatttccctcaaatttaacttcactacagtctgcattgtgcaaacacagctgtaccaaagctggaacagtgattggcagctatctatgtgctatgactctgggctgttcacaaacccattttatggacacactaccacccaggtcacacagggaagagtataagttataatttctaatacataatccctcacattaataataaaattgcttggcttttacctattagctttcattcaaaaccttcaaagtgttcaatccacatttgcttccctaaaattctaccaaatgagtcagcaagagaactaggaaagcaaccttccaaactatcagcaacagaagaaactagttctctgctatgtcctctgacaacaggaaatacagcagaaattcataacagttggtttatcttcagagagataaatataatattttatgtatattttaggaactatttttagagtaagtgtaaagtctgaggcaaagcagaacagcaagcatggagttcacttctcatgcactacacagcctctgttcattagcaccctgcaccaaagtggtgtgttacaacaagaacaacaaaacctacattgagtggtgaagtgtgctgacacaggcctgctgtaatcccacacttggtaggttgagatctgaggatagtgaatttgagggcaatctgggctatacattgagagagcttgtcttaaaaatagatatctatagcagactagagagttggctcagtggttaaaggactgctgtgtaaacatgagggtctgagttcagatcctccacactaagtgaaagccaggcatgtttatgcactggcctgtaacctcaactcgtgggggcagagacaagcagatctttagttcctgtactaggcacagtgagaggtttgtctcaaaatcaaggtggaaatggatagaggaagacagccaaagtcaacctttagtctctacacatgtacacacaattgagtgcacccacaaaaatacatgagtacacatacaggcaccacacacacacacacacactcacaaaaacacaaagttttatgcttactaaatggactcagatgtcagatttatatatttatgcatatatatgtatattaaaagaagccatcaatttgagagggaatgggaggagaagagaggttggaaggaggaaaagaaagatgatgtgctgtaatattaaaagactttaattttaaaaatggctaggtataatcccagcatttgggagactttggcagaaagatgactagttcaaggccatgctatgctacaaatgaatgttaactccaaaaagaacaagaaagaaataaagccaaactgatgtgacaaccaaagtctacagtgtatattagagattactcttcatattaaatattctatgagtacaaacctgtactacctttactatagaacaaccattagtctctagactaaacatcctatgatctgactattaccttatccctctttatttttaagatatggggaagtattcaaaactcaatataaatacaaatatatttttatatatccatcttatatcataatgggtgtattgcttgaaaaggctgggatgggcagtgcagtgtaaagaagctagacaaagacaagaagaaagaaacacattcaaagatgtgcacgctagtaaggaaaatggcacacaaaagcagagggaaaaggagatgctgcttacagaggcaagcgccaccatgatccaagtgtcctaaatgtcagagacaagcctttccaaagctcccacttcagcagtccacctttccattcctgttgtgttgcgattgtttttgaggttctcactacataaccatgccaggaagagaattcactgtgtagactatactggcttcaaactcacagacatcctcctgtacctccttcctgaatgctgggattaaaggctcccatacattcacttttcagttcttgagaattataagaatttttcttctttcttttatttttgagactataatataattacaccactaccccattcttttcctccctctaagtcctcccataagcccccttgttctctttcacatcaatggcctctttttcattaactattgttatatacatatatgtatgtgtatacacagacacacatgtatgctatacgttttattgttattaaataactgattggtgtgctcttccccggggaaggctattcctcccactcttggaattcattagttgtctgtggttctttgtgtagggttgaggccttgttggcatttccctgtccattttatcatgtctattgttgtttttctagttcagttcatgtctaggcagtcatgttgctaaaactttatgggtgtagcttctgacattcctaggagtcataatctcacagcaaactccccagttctttgtctcttacactcgttccaccccatctcccaaaatgtcctttgagctttaggtgtaggaattgttttgtgggtattatcagttgtacaatactgcacaattctgcattttgattggttgtagggtttgtagttatctctgcctcttgcaacacaaaggttccttgatgaggagtaaggactacacttacccgttggtactagtacacatgtttagagggtaggtagggattatgctgatttaggtaagatgtgtttctaggttctcctaaaatgagatttggtgttaaggaaatataatcaattgtcatttgtggtttcttctgagaattaagtaatgtagcccctcctttttttcttttatttctttcattgaaaataaattctcctctcgttcaatatatccgtgccagagtttccccgccctccactcctcccaggtccttccacctctcctctatacaaggttggcattgaatccttatcctcctgccttcaacctcccaagtggtgaaattacaaggtatgcaccaccatacctgactcctaactgcctgccagtcctacgagcacatgatttattccttcattgaaacctgaaagaaatccagggacaagaagacaccatagaaaggatttacattttgcttctaaatataaatgctggaagtcttaaatagtaggaagctcatgtgatatgggtaaaaactaagtggttggagccactatattaatgatgtggctgaaaagagctaggggtgtactggcagccatttgcagattgttcctttgggggattctttctggcagcctcatggatcttgagccctagtgagattgtgtactgggccctgctttcctcttttgtgtatggagcccaacctatcctggaccgcatgcattttggagtgtccttgtgtttccatgcccccatagtgagattctgctagctttgtgtctgcataattgttttctctctcaagaagtcttttgatgcaacttttgtgtgtgactagtgtaaaggaagtaggagtatcagtgtgtcttgcattagggcctgaagtgttattagacacgttctcacgaccggccaggaaagacgcaacaaaccagaatcttctgcggcaaagctttattgcttacatcttcaggagccagagtgcaagagagcaagccaacaaatggcgaaaccccatccctttttaaggagaattatcctccacctaggacgtattactccctgattagctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacagatcccccttttcttttaataagagcaataggccacccatattaatgagagtggagatagaggtcaaatccccagtgtgcaggtaaaggagccgtacacataacctcctcccaggctcatcacccagaggggtcctggtctggtcccgtgttgtttttcctgggggaaggacacttgaacactcaaccttcttgaaagatgacatgtctccctagaataggctcatatgtgccgcagagcctttctactgcagtgcttagccttgcaactctctcgggctgctgaagcacactcactctatcccgtgcaatgagactagcctcatgggaatataagagctgagtggccagcgacctattgcctaagcatagatatatcagggggagcaccatgttctagagctgcaagcgcctgggcaataaccaccttgtctctcctagtttgggccttaagcttacagaccaaccaaagaagcaacactaatccacagcaaagtgtatctccacataatcccacccccatccattctttaaagaaggaaaatgctgaggagatccaattgggtaatcctttgatcagggacaggtccaagcgcttggagttgacctgaatgatggcaagtctcaattcccgaagggtctattcaaattcagccatccaattctgtaacatatactgaaaaagactttttgacaaattagctgccctagtaaatttaacatactgaatggaaataacacacaatcccggaaacttttgttcacatccctgctgagttatttgtcataatacatctagttgtatctggacaagatctatgagttgattaaccagcatgagacctctctgtactgggccaaataagttcatttgctcattaatggctctgaggtcatggagcagtctccactttcctgactttttcttaattacaaaaattggagtattccaaggtgaggtagagggttcaatatggcctaattttaattgttcctctaccagttgaatcacagcttctagtttttcagaggataggtgccattgaggaacccacactgggtcccctgttttccatggtatgggtcgtgctgccccaatggccactaaggaaaaacccagaccctgtctgtcttggtttccattaggtaagataggctctatccttccctgttcttgatgtcctaacccttttccttctttataacccatctttgccatgatattttttgctttagttgaataccctcctgatggggcgttttcattggacaaaataaggcccaaatgctgcataatatcccttccccagaggttaaccgggagtgggagcacataaggtatgaatttcccttgctgtccttcagaggattcccacgtcaaggcaacggagcttatagtgggacatgattgataacctaggccctgtaatgaatgagatgactctgtggtgggccatgctttgggccaccaatgtgtagaaattatacttttatctgctccggtatcaaggatgccttcaaactcttttccgttgatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttggggcttgagcacaggacctgtatttcaggggaatgttgacaatccataactccagggtggactactaagccctgcaaggtgagtgaaccccggccgagaataaggcccatggttcccgggggcaaggatggtataggctccactggcaccggctgaatactcatttgaggcattaataggaaatcggaggcggcacgcaggtccacccttgtgggtcttcctgggtcgcctctctgactgcttcctgggtcctgacaaaccggttcccatatctttgagggccctgggaccgagggcccgatgacccgttttttggcacataagctgattgactatcaggtgggggaaggactctgccctttatatccctcacagagcgacactggtcagctctatgataacccttgccacacttagagcaaagagtgagggtccccccctgtttacctggagctctgcaatctttcttaagatgcccaggcttcctgcagttaaaacatgtcctccgattatttctgcccatggagcggttttgggattgaaggatggcagccgctaaacctgcattgctgagaggtcccccaagctctcgacagaccctgagccagtcttgtaagcctttgttctttcttggggctatggccgctcggcactcctttgtggcttgctcatagattagctgttttatcagaggcgcagcttgctctgactctccaaaaatacgctctgctgcctctgtcattctggccacaaaatctgagaaggattcctgaggtccctggacaacttttgttaattgaccagtggtttcacctgctcgggagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcttgtgcagtttcgtgccaaagcgctctccattccatatatttgcccatactagggagagcggcttttacaaccgtttgccaatcaccaggagtcatagcgtgattcgcaagcctttccacttgtgctatagtgaaattagcactgactccatagttacggaccgactcggcaagctctttaatctgtatatacgctaccggagcgtggacacgcccaccctcggctccttcaaagaccggaaatgcctgttgtattttcctttgttcctcctttggaatgaacgagtctgtgcattgcctctctgtccattgcctctctgcgcagggctgatgcactacgcagggcgggggctcagcatagggtggaggtgcactatgaccttgaagccgactgccaagaggccaagcagcaagctggcctttgccagccgcttttggctttttccttaactgattagctagcactttacctggctggtacccttttttctcataatgagctgcttcttcctcccagtctgtttcttcagaggagaattcttcatctgcttcagaactactaagagctggctccccgagcccatccagcgatgagcacaggctccttttcctagagacctccgctaattgatctttcttcttttccctttttcctctttttcttctaatctctctccaggtattcctacctaaccttaacttttcctcgggttcaagacccgtggaaaggcctgtacgcttattttgtgcaccatgtttcctctttgctcctactctctctccccgctttacttctgatagattgtcctgaatttcctctagaatccgccctgccttaaccacttgataacatgtgaaaaggaacaaaagggcttttaacactagaaaaaattcaaggccaaacattttccactttacttctgatagactgtcttgaatttccttagaaagttcaaggccaggcttacctcgtaaagctatactcactggtactctcgttccccagctgaaaagttctgaattcatacagttgaatccttctcaacagtctgttttacgggaaccttcattaccgtgacccgcagttctggttctggaatgagggatcttccttgcgccagtcccgagttttttctcgtcccggaattcggcaccaattgttattagacgcgttctcacgaccggccaggaaagacgcaacaaaccagaatcttctgcggcaaagctttattgcttacatcttcaggagccagagtgcaagaagcaagagagcaaatggcgaaaccccatccctttttaaggagaattatcctccacctaggacgtattactccctgattagctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacactgaagaaagatgctgtacctctaacacacatgtttttgacagtcgaggataggactgttgaaggtaagcttctccaagactgggtcagactgtctttccttgacctcactgaatgctacttaatggaaaaatatgataagggttcaccctatggaatcgttgcttaatattgcagatgactcattggaattagtgagttagaaaatcatttccagatgtgtagcagaaacttttccaaaaggaacaaatcaactctggaaactgggttagttttctttctttaaatgatcttagagccagagttagtcagttcttctcacttgtggttagtcaacatttatttggggttctccatggtaagatcctattcatctacttttagaatgacaagcacaaaataggtcctgtccccaggctatcccgttatccgatgttgccttctccactcttcaagagtcctgatgtattcataatgatgaatgaccttgagtgacccctactcccttgggcactggccttgttctttatcagtgtgcattcctgtgggaaggcttctttctaggtactttgaaggatggcagaaaaccttagtggcagagtaggagcagaatgtgtaacccagaagtgactgagaacggctgctctggagtctgggttgggaaactactttctatctatagcatatgagaaagttaactttagcatccctgtttctttatttctacaacaggagcaatagtaataatattctgaatgaggtcatcccttggaaactctccacatagtccttctctgagttgcctctgtgtagtttggtgtgaaggaggaaagggagatcttacttgcagatggaggctctccaggaagccatcacagtgttagagttttgcaattccacctttaccatacttaactccagtagggaatccacaggcttctcacattcagtcaatttttagttgagctctgtgaaaagaaatactgtgttgtcatctgcttgcaagcaacagacagattttgtacctcgtccaatagtcagaaggaaagtattcgccagtagcacagcctggagctctagcaaaagccaagtccgttctaataaggtgtttttggtaaatataaacttatgttttctgtcttgctcagttttcatgacatatctagtcttacatatatctggacagtttccacttaatgtgtattctctcaggacatctcaaagacagcagcagcaagtgtacttatgtgctagggtatgggcccccaaatttgtgaacttggaaaacatcataaaaggaaaagatgataaacattactgttccatggatttatggatttttttttttctcattgcttctctctctatttctacctctattctcctaccccctgcagctcaggatggaacccaggacctcacaactgctaggcaaatggtgtatcattgagttttatacaccttctctactggttttaaagctttgaaatgtttagaaatttgtaaaagtgctacaaaagtttgtgtagtggttaagagttcaacaccatggttaagcagccctggcttttttctttttaattctatttattcactttacatcctaatcaccgcctccaagcctggtcaccccctcccacaatttcttccccctccccttctactctgagagggtggaagtccctcccttctgggtatcctccccaccctgaaacatcaagtctctgcagggcagaaaaggcagctcagctagaagaacatatcccacagacagcaacagctttagggataataacccctgctccagttgctgggggatgcacaataagaccaagctccacgtctgccacatatgtgtctgacagccctggctttgaatccctaacaaattactttctattactgtatggcaccttaccataagcccagaagcttaaaataatgcacatttactagttcctgtttctctggagcagtaccatgggcagggcactaggggaggtgcttttctgagtccacagatgttggcagcactgtgtgggtgggggtcctcatctggaggctcggagacattttccaagctagttcagggtgggcataatctggttctttgttgttagttgtaggaactggttccatttgctgcctgctggttgtcagcctccatcaactctcaaagaacagtgtcagtcccagcctgccatattacatggcagtctattgatccaaactcaacaggtgactctttcttttcaagatgagcccttcccatctttgagggatcatctgatatggtcaggtctcctttggatgaatttgaggtcaattgtttggtaacctacttgggagagcaatatttcctaatagtcacagttcccatttacatgtaattgaggcagacagaccatagaacagtactagagggtatcatagatctccacttgctctaccaactccaccaatcacttggacaatttgcctaagctctcttcttttgttttcccagtgctaaaatatgagtcatggtagcattctccaccgtatgaggttgttgctgaattgcatgagatgacacacgcaatacatctcagcttagccttggtgctaacagagctttccatagacaccagagtcatagcacagaagtggttccttctttcccaccttgtctttacttacttctacccatgatgaaatggttttgagggcgaagctcatgataacatgcttgaaaaattcagaattttcccctagtgttctggtttgtgttacttcaaagagagatgatacacatttataatcccagtactggggaggctcaagagagtgattatgagttcccaggaagtttaagctatagagtgggaccctgtgtcaaaacaaaaagtagataaggtgaaacatttcccagatgttactctgcttttgaaaactagcttggagccaggtgtggtgcaaacataacagcacacacttttaatcccagcacccaagaggcaaaggcagctatatctgtgtgagtctgaggccagtgagttttagaacagccagaactctacatactgagaccctgtctcaaacaaaacaaaacaacaccccccaaaccaaacccaaacccaatcaacacaaagaaaaccagtttggtaggttactcatctgtaattgacagtactgttttgtggtatgtgctccagcagtgtgtgtgtgtgtgtgctccagcagtgtgtgtgtgtgtgtgtgtgtgtgtgtgtgtgtgtgtgtgtttaaatatgtgtgagtacacatatttgcaggtctatgaaaatatgcacataaggttgatgttaagtatctttcctgatcatgcttagcttagctgtgtttattgaggcagggtttcttgatcaatccagagttggccaattctaactagtacagctagccagcttgtctcaggaatcccctgtgtctggttccctggcttttactaatgtgctgactcctcatgcttatgggatgctgaaaataaggctccatacttgttgtgtgatcctgaagactagatttcagaacctagcacccatgtgacaacccaagcatcctctaaacacttgtaactccagctctgactctctttggcctctgtgcatgtaggtacccatacacacataaatctttttttttttaagatagaaaatttcaaaacctgatgtgtgtttctcacctatagattaaggactttgaagttctagaaatctgcactcagtttattgtgtaaaaattgtaaagatcccatcttctaaaatgaaaaagactggggtttagtggcacacatttgtaatcgtagctcttaggaggtggaaacatttggatcactatctgtgtaaagctagtttggactaactagctggggctacccagcaaaacgctgtttcaaaacaaaactcagcacttggtttgttcacattagagatcaagccacaaaatggttggaaatatttgaaaaatatgtgtatgaagaaggattaatatccagaatatgtgaagaactcccctaactaaaaaatggtggaaaaccttgtttttagattacaacgggaattaaatagatatttctcttaggaatattaaacaaatggccagcaaacacctgaaaagatgctcaaaaattatggcaatatgaagcaaaattatgatcacacatatttgggtgattggtgacactcaaaaatctgatatggtgcaaatggaagcttgtttagtactggcgagagtttaaaaatggtgtttgttacttctgtggaaaataacctagtagtcctcagaaatttaaatatagaattgcctctatatagagttaggaacttctcaccaaagagctgaaacagagactccaaaagatatctgtatattaaggtttagacctgcattactcatagtcaccaaaagttagaaacatcccagatgcccatgggcaggtggaacaaacccaaaatgtatgtatgtgtaagtatgtatgtgtatatacatacatatataccacaataatatatatgtatatgtattcatatatatatatatatatatatatatacacatacatatgtgtgtgtgtataaagagagagagaaagtaatattaatcacaatgtgaaactctaacgtacatgacagaatgggtgaatcttgaaagcatcattcaagtgatacaaaaccagacagaaacagaccaattttgttcagttccaattatatgagatatgttgacaaggcaaatacatagcaacagaaaatagagatcatcagaggttaggaggaacagagagagcagagaggtggtgtctaatgaatatggagtttctgttcgataccatttaccgtttggaaatgagtagtgctgactgcagaacaaagactgtactctattttcaaaatttggtttttgagataaggtgtcaccatgtagcccagggaggcttcaacctcataaatcccctgcctcatattcctgagtgctgatgttagagatgtgcgtcaatgcatatggcattgggactgtacttactgccactgaaatgtacccataaaagagtgaaaatggaagctaaacagtatgtagacattccccacaataataacctgtcctccaatccagtccttgtatgtctttggactatgccagaaatacatagtattagaagtctctgagggaaaaaccagacactgaaagggaaacacacacacacacacacacacacacacacacacacacatcacatcacatccacaactctaaggaaagctgttattttaatttctccatattttacttaaccacttagcctttgtcggttaacagtcattttctaccacttcctgtgcaagtggcatgctgacatctacttagtgagccttcccagtcttcatcccctattagaagaaaaatagaaaaggcctctgagctagggcaaacacagctccacagcaggcattctgtcactaaagctgtcctcagcagcagtggttcttgggctccagccacaccatgggagcagctgcaaggaagagctgagaacctggggtcagcaaggctggctccagctagaatagcatgagcagtatatagcagggtcagggaatctctgactattgtcagaatatacacagggccctgcagctgaggcatacatctttgaagactcttaataatcctttcagctctgagtggttctgctgtgccctcctgtgtttctctctgggccttctagtggacagtttggcaatgggtctctgagccagggaaaattgttgctggagctttagaagtctccttagaaggaggctaattgcctgtggctgattgaaagtgctcactgttcaggtcttggaattcaccagaaagcagggtaagtccctgaactggctgggacctgtggtgcctacactgggtgatgctgggtttcccagagctttagaattctttctgacagagttctggattcttctttagagaaactgctggtgtctaaggaaggaagactaacagtttagcaggggaatgggctgaatatttttgaaaggtatccagcactttcatgagcactgcctgacttttggaaaggactgtctttgccagtcctcttgatagggtatcgagttcgaggctagcctggtctacaaagtgagttccggggagccagggctatacagagaaaccctgtttcgaaaaaccaaaagaaaaaaaaaggaaagaaatagggtattattgggttgtcagtgtggcttgttgatcgacttacccaataagcgcacggtcctgcatttcctcctacaaactggaggggaaggtgatgtgggggcggggggagaaaagagagcaaatctcaactttgacataaatggcaataaatctctcacttactccaagaaaatcaataatcctcttttgccagaattatattgattgtgaaatatgttggtgaactaactgtaccaaatagatatccctaaaagacacccacacaggaggccatacacttactccctaatattactgatggaaataaggggaaatatatactcacaaaatatactgtatgttttatcatgagtgcatttctggagtaaggggaaatgtatcattttaaaacttgacttctatggaccattgagatggcatggcaaggaaagttgctggctgacagcctcaatgacctgagtttgatccctgggactgagaatgtggaaagagagaattaacttgtacaaggtgtcctctgatctccacacatgggccacacacatacacaaataacttgtctctaaaatataggagcattgggtggatgagatgcttaggtagcctgacatcctgtcaccaagcctgacatccctgagaaccagatgttcaaaggaaagaaccagtctctaaccacaagagatggaatcgttctctttcaatagaatcaatcaataaataataaataaaatgaatgtttaatttttttaaacaaaactgacttagtctaattgcttctctccaagtctgtaattggattattgctaccatctgtctctgttttttcccccagttgatgcaagtccagacagtttaagtgaaaatattctatttgataggctggggattcacatagcctactgaaatcctaaaaagtttatttgagacagggatccttaagtgtccctgacaccccttgaacttgtgttgctactggttccaccttccaacggctgaaatcacaggggagcacttacatgcccaccataatgccttgaatttttaaatgtataccctttacttgcctaacatatggcattcacatagtaagtgtgttcgtggatatatcttggaacttagagggagggtttttttttttttgaacattcatccctaattccttttatgctaaaagtttctatttgaaacattgtggctacctgaaagcaacttcacatgcaattggaatccaacttgaaatccaatagaaataaaatggagaaacagcaaactggcagcagtgtgcccacagaggtggagagtttctaagtgagtgagtgacttctattttcttttttcctttttttcttttcttttcttttcttttctttctttcttttttttttttttttggttttttgagacagggtttctctgtgaagccctggctatcctggaactcactttgtagaccagggtgacctcgaactcagaaatctgcctacctatgcctcccaagtgctaggattaaaggcatgtcccggctgacttctattttctaagttgtagttttggattaaaaactcttcagtgaaccaggcagtggtgagccatgcatttaatcccaatgttcaggaggcagaagtaggcagatctctgtgagtttgagaccaggctggtctacagagtgagttccaggacacccagggctacgcaatgaaaccctgtctcaaaaaaaccaaaccaaaccaaaccaaacaaaccaaacaaaaagtccaaacaaaaaattcttcagtgaacgtgtatcacttttacaattatggaaaatcagaaattcacacataatataatgcagcttgtttataagaaagttagcatagtaggggttaacctttcttgggtctcacattcttttgaaattgctgaaagttccagacccttcttgaagagtgttatacacatggtgttgtcagtgaattctctccattcacaaaacctcaagtttcctattcttctagacaactgggctgtcatagctggatcccctagctctttctttcctgttctttttttaggttggtgtcacaggtgcctagagtataggggactttgaaggaattaaagcttgggctaagcttagaactgggatcactgaggaagcctgtgaacaccaagttgagatatccccctaggaatagggcacagcagagaagacagcaggaaggctgatcttggtcttagagcagtgtctacagtagctacagtttaaaaatgacaacagctaaatgagagcactgtcagcctttaggctccagttcaactgataataaaagcaggaccctaatgcacatggaaagcatgacaattatgtcctctagctaaaggatatgtaagagagaaggtgcagagcattctcaaggacagtgtcttgtcattgagatagcatttcagtcaatgctataggcagaggcctctagacatccccagtcctcattgtagaatttgccaggggtggggtgggcactgcaaagggggaatgcttaggtaagggcatgatggagtgtttgttgtagcaaaatccttctttgctttctgaataaatatgactgtcctttagagtgcttttagccggaggaaatcagcgaatgttcttgtgggcatgttcagcacacagactaaatgtgaactcaacatgggggagagagagcaggaggcagaaacatagaaaatgactgacttactgattgattgtttgcttgattgttcaggtggaagaaaggcactacaactgggacttttgctcaaatcatagtctccctctccgttttagttcaaacagacaacatcatttggaactgcccagcatggggtttctttgtgtaggtatgccttgtcctctgagaacttcatatatagtactatgtatgtatcctgagagtaatgggtgaatcatgttcatgctattcagatgggtggggcaggcactaatgaatgtctttcagtgagtgctcatcttgagaagactgcaagagaaggacggttgtactgctgagggttagaaagatgttggcagtgagtctgcagtttgcttattctcccattcaggatataatgtgggggaatttggaacccagcagtgaccaaggccaacaacctaacaatcgcaaagctttctcttggtggggagtgaaagggagaaaattgatgagtactaactgcatcttaacctttgaatggtgggctaggatgggaaaggaagtaaagtacttgttctatgctttaggaggtgtcattggatccagtgagtgtcattggtattagaggctggtcacatgtacctggatacatcagttatctttaccaggtttcccagggtagtgggggagaaaattgaacagaggaatcaggattagccaaaatgagatcctgtgagctactaagagttttgtccactgtagttagagggcttatgctagagaatggggctagaggccagatcatgaagtgtcttagcacacttcttggcagtctgggtcttgttctgtaggttctgggaaggagtgtaaagaaaggaatctgtgaaccaaccttcatctcgggaaaagtttaacagatttgaatcaaattagccaacaaagaggtgctgggaacaaattaagtcacagattggtagttgaacttttcaaaataaaatgtttgggttaatttagtctgtcacaggggagataggtgcaagcactctcttggtgtcctttaaaagaaagaattttcatgcaaagttcctacttgctttccctctagagttgtgtacgcagctctaataaacagtcttccatgattcagtgtattgctcctgaaaaatagagacagtagggcacatgtttaggctatgttgtcattttatggattaatttccattactgtgaactttctggttttccgtgccataaatatgagcaaaacatctgtccgtgtcattctcttgataaaaacaacagcagcagcagcagcaaaacaaacaaacaaaaattaaaaaaaaaaacaaccaatcaaatagaaaactgtttgccgactccccacttctacatgaggaactagtcccagattatgttcttgatgaatgtggctctccataagcagacctctctagctcatctcatccatcttcccctttgccgaacattagcagactcacaaacacagcactctaagctctctgtactcaatgtcattctgtttactgctttccccatgctacctgtattcaccttgcctgctctgggatgatgatctcccatcatccagggatcagctcaactgcttcttttctccctcaccagcagaatgaatctctcccttactactctctgtatatctcgatctgttgaggagccctaccttccaatcataacatggcccttgctgtattaaaatctgaacagctgggattactgccatgacactgtcaggagctaatgttcccttgctgagcggaaggagggctcctgtggctgtacaggagaggctcccaaggccctgctttctgtctccagggtatatataactagttaaacattgccaggaactgggctttttcacccaccttcctgtaggtaactcaaactgatttcatttgattcaccaagcttgaatttagtggtatccgttttctgttctgttattggtgtcctacttgaaataaatacatatttatctccacccaggaaacgttaacatgctaccatcacagcccttgccatgctctctgtgtgaaagcatggctgtctgcccctctagttcatgaggtcactaagagccccggatctgcgtcttgtccatctttcagcactttgtagctcactgcctggcccatggctgatgctcggttagtacatgtgaccgttttgttttatcagtgccctagaagaattctcaggggatgactgaccagggagcctcacttttgtaacaggttggtcaacaaaattttaaatgaggtgtaggatctcctcagacattaaaatctaactgtgctaatgagcaactgggtttctgtacagggaacctatctcttaggagaccctgggtttttccctttctgtatgtacaaggaagtgaaactgggtacgtgatttttttttttttttttttacttttcttttttaagttttgttaatcttggcatacatagtaattgggcttcatcaccccacagtatactttaggtatttaaaaaatgattcataggtcctgactcataatattccaagtctcctttctctgtgtgttggtttagctttgctatctcgacacaagcaagagtcatccgagaagaggggccctcagttgagaactgttcctatcaagatggcttgtaagaaagcctgtggagcattttcttgattaataattgatctagaagggcttggcccattgtgggtggggccaccccaggggaagtggccttggggtgtatgagaaagcaagctgaatgggccatgtgggaagcaagtcactaagcagcgttcctccatggtcctgcttcagtttctgtcttgacttctccatgatgggctataagctgtaagatgaatcaaaccaaacatattagtagggaagtacttaatttaggctaaaacagtgtgggtatgataataaatctgcccagggtgtgtacaggtcaataagttatcgaaatgcagggccaaacggaggcaggtgtgcattttgagttatagtaggagagataggattaacatcgactgggtcactgtgtcctgtaatagtaagaaatagagaagttcccaaatttttacagatgtaaactttgcctttatttctctaagaagcttttactgtgtactatcccatctagtggtacagacttctagtagtgggaggggttcacaaaaaggaagaaggaggaaaataagatccaagatgaccaattatgggaaagactaaaagatttgctacaagatgccgttttctccttttcaagattcattttcaaactgggacctttcagctttctttactcgttgtcagggccaaattaatgaagtggacagatctctggtgcaatctcatgtaggaaatgacatgtggctgcatgctctaaagggttcagatgatgttcaggtgttcactatttcactgacagtaaatctatggaacatttgtacatttggattttttttttctactgaagaatgcaatgtatgccatgactctctttaaaagtaaggggaaggtcagggggaattctattttattgttttggggtttgctttgttttttcagacagggtttctctgtgtagccccagctgttctggaactctgtatgccacactggactccaaatcacagaggtccacctgtctctgtctcccaagtgctaggatcaagggtgtgtaccaccagcacatggctagtgagaacatttttttaaggtcaaaactatccttgaactccagggcttacatagttctgtctcagtttcccaactagtcaggactgttagagatggctccctgctcctagtaactccgtggtgatcacagacatccaggcaggttaaaattagttgataagcactgaataggttgtttgtcacagttgggtatgccttgagagcttgtattttgatttttccggaaagttgttatgtcttgccaaggtgcatttttctcctatcaacaatggtgttaaatcaaaatagtattattcatattgacatcctctccgttccctcagacccttctgttcatttccccgtgttcctgtcttgcttttgagtcatttaaaagttattagcacaaagtgaataccaagtcaggaagaattgaatccaaatcagttcttgcctgagagccagtgggttgagttaaggtataattactggctacagtgaagttttggggtagagagttcattggcattctgcttactcctgtggagagaatatgggctatttgcataatatctgagttggcagtaaagaaagcatttgtaaagcaagctaagcctctcatagagcatgttgtctcattagaataaaatcttttttactttttcagactagttctcaaaacaaatagcaagtagacttggaaagaggaaatactcttgcattaaaaatttcccgtgttaaagttctaaaattgggggaaaatagggagggataggtaagcctatttttcaccagttgtctttatgttcagttttaagtaccttcaaagtctcattttgtggatttttagagttgtaagtagttccttaaagctggaaactgaaaatcagttctgaagactgttggctctcctgtcctcttgggtggcccctctggcttggaaagcttgtaccaaagaccagcctctttgtgttgtgcagctgtctatccccaggaaccacaaaagcctctggctttggagttctcaccactccctgctgggttcctgctaggttccttggaggatattgagatgaattagattcagagattcaggtcccttgacaatatcttacttttttttttttttttttttgtaatttgattcttccccacttgaatctaccagctcctttcctcaaagtaaaagatccaaggtgttaatccctactcattgaagacaaatgctaaattggaagcaacagcctagaaatgcaaaactccttatccaattccaattcaagctctcccagtcagccatgctcagcatcatctgggtcagaagggaagatctcatggtggcacatgcctttaatcccagcactctggagccagacacacacacaggtctttgtaactttgagagaagcctggtctacagagcaagttccaggattgctaaggctacacagatataccctgtctcaaaacaaacaaacaaacaaacataaaatgaaaacaatcccccaaatcccatgcttccaagttttagaaaattataaaatgcaaagttcattgagcgaaacaaagcgtggtaggtaagatcaagaatgaagaaatactaagtatctgttgagtttagagcacacaggcttatgggtacatattatggttaagatcaatattgtactaaacctcactttcctcatatgtaaaatgtacataaaaaagaagaaaagctcctgggatttttttcagggagttaaaagaagagacatatagtgcttaacagtttgcataatggtgccgagtctatgaagcaaagtgcaaggcatcatctctgctgagaagattctgctgagcaaactaaacagcaaagtagttgagtgccaaagtaaagctgtgtctaagtgcattccacaatcaatgggaagagtactgtgggttagagaagacgcaggctaggctcgctcaaaaatagtaaggcctagggagatggctcagtaggtaaagcacttgccacacagccatgaggatttgagttggaatccccagcacccatatataagctaggcagtctagtgacctgtctgttaccccaggcctttcagtaggtcaagacctgggattcccaaggggctagctgttcagactagctgaattggttcaataaataaagtggagaataatcaagaaagacacctgatgtcaacatgggacctctacatgcatgtgcacctgtaccaccacacacaagtgtgtccacacatgtgaacaagcatacacaaatgaatacacatgcataagagtaacaaattgataaaatctgattttctgttgttaggtatttttttccttgtgtatgtgtgtgtgtgtatgtgtgtgtgtgtgtgtgtgtgtgtgtgtgtgtgtgtgtgtgtgtgcacgcacgcacgcacgcattgataaggacttcctgcccggcctcaaatgcatccatcttcttgcctcagcctcctgagtgttaaggcgccaggggtgccattacacctggctttctcctcgagtttatgaacaaaagtagaaatgcaaaaactgatcatatactacatactctcacgcaatgaaggcttttgattgaaataagtggtaatagatggattcccatgtttctgtgtgtaatgtggtttgtggcagcactttgatagaagctacactagacattggaaggtatgcagaaaccaagtgtggctttaagacagcttccaggatcaagtcagatgtctaggtttatctgccttgcaccgtgagttaagaggattctcaagggtaaggtccaattctttctgtgtccacatcaccagcagctagcacagggtctggcccttagtagggacccattaatatgtcacatacttgaacgtgctttgttttctctcctgctggaaggaaattgccttcccccagtggccattttgagtacagagggttattttaagatattctcaagagagaacactagaaactgctgttgagtgcctaaaaggaaggaagagcagaatgacaaaggggagtgtagaaagttccaagtgaaggggatggagggagaatgggatggagtggcttatctccttttgaatatggtgcttcttccttttcactgtcatcatccataagagaatgtgattccagcacttgggagtagtgtcatgaatttggggctggcctgggatacctagtaggtttcaggccaacctggactacagaggaagacccttttctttaaaacaaaagaacaaaacctttcaactcagatgccactgtctcaaaatcacacacacaaaaaaagaaattttggacaaaatcactgtcttaagccagttgttgccgtggtctttattaaactgaaacctagtgtggaacgtggcttgttggtggtgaaggtttgaaattggccccattccaccctcatttctaagctttctgctttccctcccagtgtttgataaagaagggaatctctgcagccagtgctcactttagacttgccgaagacacattctctgaattcttcaagacaactggtttctaaaatagaagatttactggtaaactcatgacctttagtataatacctaagcagaagttaaatctggctgattttgtgatgcatccagagaaacatgacattatttgtttttttaaattttattcttgtctattgtgagtgcatgtgtgtgtgtggccggttgttcatatgtgctatggtgtgcatgcgcaggtcagagaacaaacagctccatagagtaggttttagttgtttccttctgccttgaatgggttcccagatctgaggtggtcaagcttgagtgtcaagtgcttcacttgctgagccatttctgaggccactttattgtatgttaaatgaatggatctgtgcttctgtttcttttttttgggggggggtggtcatgacagggtttctctgtatagccctggctgtcctggaactcactttgtagaccaggcaggcctcgaactcagaaatcagcctgcctctgcctcccgagtgctgggattaaaggcgtgtgccaccacgcccagcttgtgcttctgtttctaatggtaaattatatagacttaactagtcatgtgtattttgggcaacattcagtgagtgagttgtcaatatcaggagtcacagtgtctactataatgctaacgtgtgtatttactcatttggggattacagacttggtattttgcacatgtatagttaaaacgatgaaagaacagcacattggatgtgttagagctgccacaaagaagaatgtccaagttgtgatgctgtagagagaccctcggttggggtccattctttccagtctttttaccaagactgcggctgaatctacactgatgacttccctgtttcccccatactaacaatgataagatggtctcaatttgtagaattgtgcatttcttcctagttttaggatttacacactgaaggccatcaagagttccacttaggcagcttaaatatgcatgtaacccatgaactacatacatctcaagtcatggttccaaaatgattattgaaagtttttttttaaatactagaattaggtaaacaatttattgtctttcacagaagtgtcagaaggctttttagtaaataaatgcatctcaatggagatgttcttagagtggaagttgagcccagggtctcacataataccgtatgatatctgtatatctgtatcacagagctacagttcctgtctcaatgaacatatttgatttgaggattgtatacaaatacatccagtttgtgcaacactgacaagaaaaggaaaacaggatcaggagttagaaggtatggtttggggctgcagtgtagctcagtcctagagcacttccccgccacaaacaaggtcccatttccagcctgacaagaagaaggagtgtgagcttgactggttataatgacgattctgctgatgaatgatgagcctctgagccactcccgtcacatataaagttaaaatgatagtaatttatgtatgtacatgatggacattctgtcaggtcagtggggtgcagattcaagtgctttcttaatgatgcaaagtgatcttcaaatgagcagaaggaaaaccaaaccaaaccaaaccaaacaaaacaaaacaagactactaccaccaagttatttcaagggaacttatggctcagtgaataagggttttgacagacagttcgctttatttttctccggtgaaaactgagtaggttccagatttaggctgcagtttttcttgtcactcctcaggaaggcaagcctgaaacatgtgctcacttcactccagattgtataaataaatgcctttgccttttgtttaacactattacagaactgtagaggagcatgcagtggggccttgctgctatttgaaggattggtgaagttttgttcattataatgcaggtttctggggttataaaaaaagtctttgtaggctaattattatacaaactaaactaaaaggaaaaatcacaaacatgaaagaaaagtacattttcttttcttccttcttttgtttcttttttctttcctccttctccttctccttctcctttttttttttttttgttgttgttgttgttttttttttttttttttgaagacaggagccctggctggcctggaactcatcatggaccaggctggccttaaactcagagatccatttgcctctcccttccaaatgctgggattaagggcctacccagctttcatttttttaaatatttaacttaaaatattttatgaatattcatatatacatacaatgtgttttgatcaaacccacccccatgaaaactctgtaagtgtagttagacgtttttctttgataaccatagaaatctaatgatagaatgattgaaaaaaattgaaaagcaaacttaataaaggttatgatggctggggagaactactactcaacccacaaatccaaccttttccttctctctgatgactgaatccccctggaaagggaaatagagggtttcagttgcctctcctttttttaaaggcccaggtcttcgttagagcactggttctgaaccttcctaacactgcagccctttaatacagttcctcaaatttacggtgacactcaaccgtaaaattatctttcttgctacttcataactgaaattttgctacttttctgaattgtaatgtaaatatctggtatgcaggatatgtaaaacgaccccccaaaggggatgcaacccccaaattgagaaccattgtgttggagtaagcattgtggtactcagaatagttactctaattttcctaatatcctgaatctcgtgacagaggaaatagaaatggcaactcagaaacttaggttgaatcagtttgaaatgaaaagtaaaacctttttttaaaagtgtcctttaaaatgtggggaaactgttgctttcatttctacaaggcatatagtttacatctaaacacatgattcctttttgtcatagggtttttatattaacatgacatgaaaaagccaaaaataatttctttttttttgtcattttgctaagttgcttgaagcaggtgtgtgtgaaattcctatacagagaagttaatagatgttaattcaacaagttacacattgaatttggactggttttaatatattttattttaattaactttgtagtagtaaggattgaatcgagggccatctacatactaggtaaatgctctgtcattgacataatgaaggttgatatcgcaaccttccttttcagtttttttttttcagggtcttagtatatagcctggggtgacctggaattcactctgaagatcaggctggccttgaactcagaattctgcctgattttgccttctgagttctgggattaagggcatgcaccatcacacccagctcacacacaaaaccatggaaattattgtacatactaatgggtacatgtaatattttgaaatgtatatattatatgtgtttcagccatgttaatcatatttatttcttcaaatgtcacttctttgtggtgacgatttaatatatctttaatatttttagatttgttttattattttttttatataagtgctttgcatcacatgcaagtctggtgcctgaagaactggtgagcatctatggaggtgctgggtcctttgcaagacaaatactgtcaaccactgagccaactatctagccttagtttactacatcttaaatctgtattcagtttctattaatacaagttaaataatttcatttaaataaaacatccttagtagaaattattgacaaatattgtttaaacaactaatgtgtaattacttagaatgcatgtcaggacatggttctaagtgggtctgaatatctcaaagctcattatataatgaatgcttggatgtctaccatgcgcagtgaacaaattacagcttttccttggttctggtgctagcacttcacaactgaatcttgctggaagggaaaggtagtccttttccctttactaatcatagagatgaaatttgattcacaggtttaggtcttctattgtaggaggctccctgtctttgaatagtcagagaagtaaaaatagatcatggtatattcagtgaaagaaaatgataggcaggtacatagtggaataatctaagttcaagtcgttcaagtccttgcatattaatatccttttgtatttttgagtgggggaagagactgcatgagagaaaaagaatgagtcttttacaggcacagacctagggttgactttcgactctgaagatttatttaaccttagttaagtcctctttctcaactctaatatgggagaattgattatgcctatttcataggttgttagagcattgcattggaacatatacagaaagtacttagcaaagttgatggctgctgagcaaggaagagttgtttttttttttttcagagacataagccctgagaagccatttcatgcttttagaagatggtcccacacccatgcacatattaggcagtactaagtggacccagtgaaattttaaacaagaagttaagagatgaagtgggggagatgggagaagaattggaaaggagagaatgggagtggacttcatcaaaacaccttatatgcatgaataagtagtaaatatagtactttaaaagaacacgtttgatgctatcattattagtagtattactcctcttcctataccatcttttgatttctcatcttcattggctctgttcctcataaaatgacccttaggctggggcccttctatcaatgatcagctcacttaactgtccaacaggaggccacagagtttacctcctgaaacctcaccctttaatgccatgtcggcagaattcagcatctccaggactcttgcttgtcatagcaaagctggaatgtcataggctttggattgtatatttggcacagggaggacacatgaatgttcatattttctccactttagttacccagcaaatagagcacattcactaaatctctcataggtttttaaatatactgtttttgtttgacttaaaattcagggtattttttttttggaagatataaacaacatggtactctttctttagaattctttttttatgtttttatttttttaatttattttaattttttaatttaattttatttcttaattttttattgggtattttcctcatttacatttccaatgctatcccaaaagtcccccataccccccccccctactcccctatccacccactcccactgtttggtcttggcgttcccctgtactgaggcatataaagtttgcataaacaatgggcctctctttccactgatggccagctaggccatcttctgatacatatgcagctagagacacgagctctagagggtactggttagttcatattgttgttccacctatagggttgcagatccctttagctctttggatactttccctagctcttccattcggggccctgtgatccatccaatagctgactgtgagcatccagttctgtgtttgctaggccccggcatagtctcacaagggacacctatatcagagtcctttcagcaaaatcttgctagtgtatgcaatggtgtttgcatttggcggatgattatgggatggatccctggaaatgatagtctctagatggtccatccttttgtctcagctccaaactttgtctctgtaactccttccatgggtgttttgttcccaattctaagaaggggcaaagtatccacactttgttcttcattcttcttgagtttcatgtgctttgcatcttgtatcttgggtattctaagtttctggactaatatccacttatcagtgagtacatattgtgtgagttcctttgtgattgggttagatcactcagtatgatgccctccaggtcaatccatttgcctaggaatttcataaattcattctttttaatacctgagtagtactccattgtgtaaatgtaccacattttctgtatccattcctctgttgaggggcatctgggttctttccagtttctggctattataagtaaggctgttatgaacatagtggagcatgtgtccttcttaccggttgggacatcttctggatatatacccaggagaggtattgctggatcctccggtagtactatgtccaattttctgaggaaccgccagactgatttccagagtggttgtacaagctcgcaatcccaccagcaatggaggagtgttcctctttctccacatcctcgccagcaactgctgtcacctgaatttttgatcttagccattctgactggtgtgaggtggaatctcagggctcttttgatttgcatttccctgataattaaggatgctgaacagtttttcaggtgcttctcagccattcggtattcctcaggtgagaattccttgtttagctctgagccccatttttaatggggttatttgattttctggagtccaccttcttcagttctttatatatattagatattagtcccctatctgatttaggataggtaaagatactttcccagtctattggtggcctttttgtcttattgacggtgtcctttgccttacagaagctttgcaattttatgaggtcccatttgtcaattctcaatcttacagcacaagccattgctgttctattcaggattttttcccctttgcccatatcttcgaggcttttccctactttctcctctataaatttcaatatctctggttttatgtagagttccttgatccacttagatttgaccttagtacaaggagataggaatggatcaattctcattcttctacatgttaaccgccagttgtgccagcaccatttgttcaaaatattgtcttttttccactggatggttttagctcccttgtcaaagatcaagtgaccataggtgtgtgggttcatttctgggtcttcaattctattccattggtctacttgtctgtcactataccagtaccatgcagtttttatcacaattgctctgtagtacagctttaggtcaggcatggtgattccaccagaggttcttttatccttgagaagagtttttgctatcctaggttttttgttactccagatgaatttgcagattgctctttctaattcgttgaagaaattgagttggaattttgatggggattgcattgaatctgtagattgcttttggcaagatagccatttttactatattgatcctgctaatccatgagcatgggagatctttccatcttctgagatcttctttaatttctttcttcagagacttgaagttcttttcatacagatctttcacttccttagttagagtcacaccaaggtattttatattatttgtgactattgaaaagggtgttgtatccctaatttttttctcagcctgtttattctttgtgtagagaaaggccattgactcgtttgagttaatattatatccagccacttcaccgaagctgtttatcagttttaggagttctctggtggaatttttatggtcacttatatatactatcatatcatctgcaaaaagtgatattttgacttcttcctttccaatttgtatccacttgatctccttttgttgtctaattgctctggctaggacttcaagtacaatgttgaaaaggtagggagaaagtgggcagccttgtctagtccctgattttagtgggattgcttccagcttctcaccatttactttgatgttggctactggtttgctgtagattgcttttatcatgtttcagtatgagccttgaattcctgatctttccaagacttttatgaatgggtgttgtattttgtcaaatgctttctccgcatctaaggagatgatcatgtggtttttgtctttgagtttgtttatatactggattactttgatggatttccatatattgaaccatcctgggtgaggtgggagtgctgtgttctgatgatggtgagtggtcttggcttctgttagtaagattcttatgtgtgcctttcaccatctggtaatatctggagtcagttgttatagttgtctctggttagagcttgttcctcttgtgattctgttagtctctatctgcagacctgggagtctagctctctcttgagtttcagtggtcagagcactctctgcaggcaagctctcctctttcagggaagttgccaagatatctggcgtttgaacctgcttcctggaagaagttgtgttccactcaccagagatcctaagatccggtggagattgctctggcgaccttgggggtgtccaccgactcactttagaattcttatctacagcaaggatgggtttgtcaggttcaagtgcttggtgttcacatgtgtttgatatatgtctggatccatacatatgtatggaaaagttttctcttattaaagcagctgtatgttcttattagttcaacacccccgtttttggttgtgtgcttgtttgtttgtttttgagacagggtttctctgtgcagccctggctgtcttggaactcactctgtagaccaggctgacctctaactcacagagatctgtctgcctctgcctctggagtgcagtgattaaagacatgagccactactgctggaacaattcccattttgtgaaatagtgaaccttcactacacagaatggaattttcttcttctgggagtctgacagtaacatttttttttgtctcttacaaaggaaaaggccaagttagttgaacccctggactatgaaaatgttatcactcaacggaaaacccagatctacagtgatcccctcagagatctgcttatgttccccatggaagacatatctgtgagtgcacgtgtgcttttaaaaggaataagcactttattttccaagcaagttcttagaataagagtatgatttgatttctagatctcagtgattggtcgtcagcgcagaacagtgcagtctactgtaccagaggatgctgaaaagagggcccagagtttatttgtcaaagaggtaaggggctcaacagccagccaaagagcctttttttctatttgttttattattatttttttattagtgtgtgtgtgtgtgtgtgtgtgtgtgtgtgtgtgtgtgtttgagtttatgtgcaccatgtgtgtgcagatgcccacactggccttttttgggttccctgaaactaaagttaaagacagttgtaaaccacctgatattggttctaagacataaacctagatcaaatgcaatagcagtacatgctcctaactgccaagtcatctctccagccacctgccagatgattttggtatatatatcatatatcatctatgaagtttaaattcaaatttagtttttaaatgggaaataaaattactaaacttaacctgtgtaacaaaactgtacgatgtaaggcagaagcttaaacatttataattagtatatggggttttgttgttgttgttgtttgttgtatttttttttttaagatttgagtactttgtcatgtatttgaagaaatagtttttagaaggacatgtgaattagggtctggccttgtcagttgggctagatcacttgttctcaaccttcctaatgctgtgaccttttaatacaattcctcatgttgtggtgatctccaatggcaaaattatttttgttgctactccacaactataatgttgctaccattatgaattataatgtaaacatctgtgttttctgatggttttaggtgacccttgtgagagggccatttgacaccatcatacttgatccccaagtcaagatgcctataccaacatttctcaattaattaaaaaatgctgtgggtatttcaccagaccttggcttatgtgtttgagacttggacttgaggttgcccttaaattcacgctctttctcagctctctaaatgctgggggttacaggtgtgtgccaccctggtcagctctaccggacatttaaaaatatatttctttgttttctttttctatgcttgaaatggattttcctactttcttccagtgtattaagacctacagcacagattggcatgtggtgaactataagtatgaggatttctctggggactttcggatgttgccatggtaagtttagaagggaaataggagaattctattattattgtcatcaccatcatcattattatggttatcacttagctttttagaaaactcttttgaaactcctgttataatttatgagtcagacctcaaacagcagcatatttggctcatgtagtgttttgaccagttgagtatgttttgagtgtgctcattgacactcttcccagtaagtgtgagctcacttagttggacacatccatattgactacagaataatctttagtttattctggaaactatagggacagttttcccagtggtgttggtgaagaacttggaagctgtttaaatcagtttgatacctgctgatatcccttggatgagatttggggataatctcagtgaagttgaagaactgtcatgaggactactgacccagtagtcatggtccaagttgtctttctgctctttcctagctggctaggtttgaaccatccagtcaacctgtttgagctctcctgtcaatcccatttctctactgcatgactgctggtctcccagcatctcatctaggaaatatgggggtggggtggcgggagacatttgtgaagtcctctgtagctttcaaaaacattttcctaggaaagaagctactaacattagcagtctgggctcccaaagcaaacaaaacagaaagccaaaatgacacagtgttgctttctgacccgtggaaaggtaaagttctgccactcctgacagccctggcagaggctccttagcaacttctgctctgcttgactcctatctgctctctgttttatctttgcagctggctgcatatgtgggagtccttctatacaaataaggcagtgttgaggagatagcttagtcaggagtttttgcttagcagaaatcaaacaagcagacagaagaagcttgggtgtttattcaggaataaggcctatgtttgaaaaaaaaagtgtacttttccatctcttgccttgcattttcttgcttttcagagaatgaggttgacttcaggttttgtttgttggtgatgcttataggctatgttcagagtctaaattaattttcttgcactttcagcaagtctttgagacctgaaaagattcctaatcatgtgtttgagattgatgaagattgcgagaaagatgaggtaaggatggggctagctgtctgccattcttaagctgaaagggaattccttaaagggaagatgagtgatgctgaaacaagtggttatgagtacctgtggccacctttctaaccaatgaatgttttttacttaaaaaatgcgattacacttcaataactattgagtgcctactgtgtttataccattgggcctttcattctatatacggtcaatattttaaatatttatgaaaagtgataacttcgtgtttaattaggaaatgggaacaggtctagttctttgtctgctaaatgttaactaaataaatgattggatgattgctattctactgatggtttttattctatttcaggattcatcttctttatgttctcagaagggtggtgtgataaaacaaggttggttgcataaagcaaatgtaaatagcaccatcacagtaaccatgaaggtaggaaatagttatatccatctatcatttgaagtatattgacatatataatgaatctggagaaatgtttgttttctaatgaatcctcaaaaaaatctttttttaagttagaatgtagaataatcggtttcattatggattatttaaacacatatatcataatactttgttctcatttgttcccctaccaaaaagtttttaaatgaaagaatcttaacagatgcatggaattttaaagcttcaacctcagatcaaatttagaaatgttaccttttaaagacagataatgaagctcttaatgtctgacagaagctgccaggttaatgaaggaaatagctttgcaaaaccagccaccagaggttcctatgtggaaatggatttaatgaatgaatttggcgcttattaatactagtgactgtggggaaatatactgacatctgggatggggaagtccgttgtgtccagtagcttcataattatgttagaaacataccacattaagtcctacataaaatagtgccttagggtggccaagcctatttggaaaatgaagcagtttgactagatactgaatttatgtacgggactgtgggagatagaaccaagaacactgaaaggcttttgtttgggaggcagcgaagagccattaaaatctagaggaagaataaatgagctccttgaagattcactgcagagaaattattccttgataccaaatataactgttctttcagatattcactataagatcatgtggcttcctgagtatgattcacagtaccattaagtattgaaggtcattctagctttcacatagcctgaaagcagaaaccatggatgtctaccaaaggaagactcaaattctatcttaatttaatactttgcctgctgcttttccttcagtggccatatcctgttctcactttcattttccagcccctaagataatgaatccaagttgtaggatgtttcctatgtatctgttatatcaaagcatgagatttttacatgtgtgagataataagagaattgtttcaaatccatttgttagggtatcaatgtattctaagcaccataccaagtttattttacatctcatatttatattctgcatttagtctgaatggcagttccatgaagtgagcactgttattattattcctagtttccagatatggtaaaataggcatagagaaatctgatggctaaacagaattccaggacgggggatatggcttagagagtaaggtgcttgctatgcaagcatgggggcctgagtttagatccccaatagccacataaacaaaaccactgggtaacattaccttcatctgtagtcacagcacttggtatgctgagatgggtggatcaaaggggctggcaggccagcaaggtaaatgaaaagggagttccatctttaccaagaggccttgttatggaaagtaaggttgaaaatgatcactgaagacaatgccatcctctaccttgtgcatgtgaatgctcaggtgaatacaccagaacacacattttcacatgcatgtgtgtatacaccacacgcacttatatataaaaactaaataaacagagctctaagtttttcaggagtaggatttgatcctatgcaatctattctcttggccagtacattgtcatccttagtcgctgaatgccacattgcatgtcctgtcttcaggttcagaaacacatgtgtggaggttatagctctatacagatggacagaaaatgagtctgggtttttacactttttaaaagatgcataatgtacatatttatatgttacaatgtaagctctcaatacatatataaagcataataaacaatgaatatattcatgtaattagcatgttcatcaacctaaatatgtatcaccatttcatgaatgcatgtgtatgttcatgcatgagtgtgctcctgcatgtgcttgtggggggaggggggaaacatttgaaataatctttactagatctttggaaataatatgattatgcttgccatctgtactatactaagctgtagaaattattctcaccatctgactatatacccttgtgtgctatagattaaactccattcctttcccctaacattctcaaaatattaagctgttttacctgtaccttaggtttaacacagagctaagtaaatatgctgtaatggcaaactggattcataagatattagtaagaaattaatatttactaagcaattcagaagacttttaaattatttctcaaataacactgaattgccattggctttactaacaacttttcaatttcttaagaagacataattttaggttaaaaatctccagttgcctgtaaaacagttcacggtttatatcttctttcataatttttaaaatacacactgatgtggtagcaagactaatgaatccccaaagatgcccatgtcctaatccctagaacctgtaaatgtttgcttacatgacaaaagggaattcaagttgctaataagccaatagggagacgatttggaattacccaggcaggcccagaataagcacaaagttcctgatacgtggaaggcagagggaggcaggaaaggagagtcagaggaaaagatatgaacagaagcagggtcgcagagagatgctttgtggctaattttggagatggagaaaggagtcacaagcccaaagatgatgggaatcctcttgaagctaaaagaaagcaagggagtagattaaacctgtattttaatctagtaagaccagtcacacttctaacctactgaactataatgtagtaaatctgtgttgttttaagccaccaagtttggagtaatttattatagcactagaaaactaatacggtcagccaaagattgattgttccgcttggctgtaacctatctctgaggttgaaaactcccacacttacagggacaagggaggagccataaattcatggcgtagaagtgtaagtctgaggtaacctggggaccacatgggtgaggtgaagaggccagctgctactttttgtcagctaaccatgaccttgtcccgttgagctaggttctttgctttgtctctttctatttccatctacttgctatgtagctgaggatgaatgtgaacttctggtcctcctgcctctatctccatggatggaacccaggacttcatgcatgccagttatgtactctccccaatgagttgcacccccaaataggttctttcttcttaaagccaccagccaggggacattgccctcacaaccataggtgtcctgtcacagggtgggaagaagctcttctgaagtctacattgcttccagctcaggagggcagccagcccagctcttgcagtcaggaggggcagaggtataactaaagccagaggctcataggattagaggtgtgctgggaggaaagcttctgtttgcttctagtatgtgactcttccaaataaagactactcagtaatcaatctcagtaagcaaatgggaagattattccagtgtacggttaactgagtacatttcccagtactggaggcaggtttatcctgggtgcagccggagtttcctgcatgctgggggcctctttctgtactgatgcaatggaaggtttagcaaccaataccacagaactgacccccagagaatcttcttttatcagaaaatccatgttttgagagtccttgctcagtcccagcaagccaggaaactgctgcagaagggcctaggtattcatcatcactcatgacaaataacagcccacggaagccacgcttctgtctttgtgttctatctgagtctccgtgatgggctggggcctcacaccagcctgcgtagccccttgaggctggcgattgtgcttcttctggaaagttatgtattcaaaagttttcaaattcattttaaaccatacaaacaaaaaattctgaatcttaaaaaatattctgcttgaatagctgggcctggtggcacaggcctataatcccagcacttgtaagatggctgcaggtggacagatctcgaggccagactggaatataaagggaaatgatgtttcatacaatcaaatcaggagcagtgctatgtagaatcagttctttaggatgtttgtaattatacacaacaacttctgcttttttcctgagacaggatttctcagtgtagtcctgtaactcacactgtatgtccggctggcttcaaactcagagatccacttgtctctttgtcccaagccctaggataaaagatcttctaagacctttgagctgtcacaaataagagaatcatgaatgaaggtataagaggaaaatgcgaaaaggtcagaagatacccagcatagttcagttgatttacaaaaggaatcagaaaactagttatttttgtgatcatttgagaaagcaaccatgcagccttatgcaatatcaacaacgcagccaatgcaaattatgcctggactactttcaaaaattaaacctcctgttgtaactgccagaactctgtcacatcgtttaagttgattgtgatggaccctacagaaaagaagggctggcacatagactttgctgagttcttaatgctggaataaaaattattttttccccagtgtattgttcccccgcaccagcccagaacagttaagtttagtcaataccattcactgcaattgtcattatcttccccaaagtgctttctgggtaacctcattatctgccaacaaagtatcacggagacatacaggcagtgaaagagctgctaatgatgtatctagcttcacagtgagacacagtcactctacagagtcacagtgcccaagcatttcctctccttaaggaggatgctggcctcacacagctcttgcaaaggcaaaggcgctgattgttgtctggagacagtgaatttttttttaaatttccagcacttgtaaattgccttgttgtgagcagtcatgttaagacaggacacgctttattacagtgagcaatttcctcagtttgtgctttctagctagtgagaaaccaccccatttcaattcctggaaaagaactggagagaagctgaagataatcatagagaatctatgatcacttaggcagaaactgcagtcccaagagaagcctatttggttggattatctttcttaagtagctgctagagacatctgctttattcaacttgttccctatcactgagtaaaattaatgtggactagatagctgcgctatcgggcatggccttcccctggtatttagaactatttttcctaagaagcataatgatatatggaataaggaaaaaatttgatcttgagggtggtttttagtttaaaagagttgcatattcttggctaagccttgggacacccacctttgtgcattttcttggctcagttttgatcacattccttaggctttctactccccattctcagcaattaaatgttgaagtgccttgctgtgttatcggggttgcaagttcaactgtctgatgtatgactcacttcgggtgcccttccttttttttttttttttccctacaaaagagagccatttgttatacatccagagcccagaagtctttattactctttgactgctgaaggataattctcttcttgctagggagaaagcagcaaatcaaaagaggatttcatccaagaaagcacatccaatatgaaagtaattgctaggagttcaaggtcactgtgtgtattggaacaaaagagggataagatctattactttgatttgctactccatttgaatgctccaatttactagactgcaccttacagtaaacaaaatggattaatacttgtttatcataggcagggggtttctgactaatttgcttttctgtttaatttctactcatttgctgactactgctcaaattccacttatttgatgcttcctgtatgccagacactcttaggaatcatcaaattcatcaccatatatacaaggactactttattatacatcctggaagatagaagcatcacatgtgacccttaaggctaaggacctcgttggagatgtgagacacagcataaaaatagttttttaatgggtgccccaataccaactccatgagcatggggtctgataaaaccaagccttgaaggaagggagtccctaaggagagtaagtgtgggtatggtatataaaaatcatgtgctagatgagcactggtagccatgctaggttaagttgattgattcctgagtatcctcctatgcgccagtttctcttttgctgatgtggagataaagatagtgatgagcacatagcactgtgtgagtggacatgagcagatcactcagagacactaaggcaggaaagcatgccagtcattgttattttatagtacgaggattataagaggccaggatctgacatgtgagcctgatcatgccagaaacatggcaccatcaaaaaaaaaaaaaagttgggtttgtaggctcttgcctgtaggccagtacttgggaaccttagagcaggaatatcaccgtgagattgaggctagtctaggctgtagagggagagtctgtctccaaggaagaaaaggaaggaaggaaggaaggaaggaaagaaggaagggagggagggagggagggagggagggagggagggagggagggagggagggaggaaaggagaaggaggaagaaacaggaggcgaggatagcaagaagttgagcaagaccaccattgaaataagtatgagaaaataatgtgtccacaatgacaagggaggattgtagctgccttctttcatggtttgcttcagattcatcttaaaaatctccagtgctcagctatgatagaattattcaggaaaagagaaaaaattactttattttgaacccagtttcccatagcgtagaattatgaaatctattaaaatgggacaggagtgtatgatgatacggaaagagatgagttatagggtgccagctttctggaagggggtctccagaaagacaatgcttttgccatcctagtttaactaagtgtcagttagttttctcataatgttttggggttttcttctttactgttccttctatctttgcatccttacaccattatacttgtgagacttaccgtgactcatgctccccccttttccttggagacaagagttgcacaatgcaaccccagactggtccttaacttgtaatcctttcacttgtgtctcaccagtactagggtcctgctttctccttttccatgctatcctgccattctgtttagtttaacacagccattaaatagaagcccctgcctcatttctacattgctgctggccctcctactctgtctcttatttttcagatcattccttcttaggacttctgcttgatataatgtagaggaagtacccacactctaggtaacacatataggtgagcacccttgcagtttattatataagatggtaaaaaggttttcctaattggaaagcagggtagtaggcatgggcagtccacctttcctgctcatcttccatctttgatgcaactgagtgacaacctttgttcctggtccagaagaggtctaaaatgttaccttcccaacatttcaggggcttgaaaagacttcgtatgacatgatccctgagataggctagtcttgaggatgcatgcttctcattagctaagatggggaattgtaatctgtgtttactatctaagaaaaataataaagccaaggagatgagaaggatgtgagcattacagagaagtagcattctatttcatgaaagtgttgataatatgctagaggatgaattaccatgtttttttctttttgaaaaacatgtatgcgctataagcattattgtggattctaaacaaaagttgaccttaacagtgtggaaagaaacagtaaaatttaagagatagataaatggaggtatatttggatagggttcacactgcaaaagagtgctacattgtttacaggtacttatagaaaaaccagtcaagtacggtcctgaaagaaagtggaaaggagattctgtgactattcaggcaagagaattccaggctaagggcaagaagagaaatgatttaaaggagtccctttggggttcttgactaatgacacataaagcagtgtagctggagtagtgtgattagatgcacaggcacaggctcaggagatggcttagttggtaaactgcttgccctccaagcatgaggagcttcatctggtcccccagaagtaatatataaaaaccaagtgctggcctgcttgtaatccccatgccaggaaggcagagatagaaggatcatggtgcttgctggtcagctagtctacccagctctgaggtccactgagagaccctgcttcaaaaaggatggagaaggctggagagatggctcagcgattaagaacactgactgctcttccagaggtcctgagttcaattcccagcacccacatggtggctcacaaccaactgcaatgggttctgatgccctcttctggtgtgtgtgaagacagtgaccgtgtactcacatttataaaataaataaattgtttaaaaataaagatggagagcaatcgaacacacacatatacacacagacacagacacacagtgacctgcggacatatgtaccatgttctaagctatggtaaagatgttatttatttaaaatctgttattattgttgttgtttttgttgttgttttgctgggtctttttgagtcagggtctcaaggagccaggattggtatcaagctcttgatcctccagcctccacatcccaagtgctagaattacagttatgtggcaaaatatctagcaattttatctatttcgtacaaacatgttacatgttaatgaggtaacatgagttttggaaacagatatacattttatcatgtttaaatttgattgagcacatattctcattattgtgaagactttcagtccttacttttttgaagtgtgcaggacatttcataatcacatgattatgtaatagcaccccagagctgcttcttcctctctggctgtcactgatgacccctcccccactgcctttcctctgcaccttccacagcttggattttgctctaacattagtgggaagccattgcaaagtttgagaaacactctttgtggatgtcacaggattctgacttcaatttaagtagtaaccactgtgaacttaaatatgttcttagtccctctgttaggcaaggtgggtggatatatatatatcctgtaaaataattatctattgctatccaaggactagaggcctttgaatgaaagctgtgatgtagaattattattttaacatctatcttctttctgaaatgtacaaaagtatttacctgtaaactaaatatttacatcttggaaaattttaagatattgtgcttctgatttcttcttgtttctgtaggttagagttaggatgttcctttcttcttcgaaaaaaatggaattccaaactttatagaagttaaaaccctaacatatagcagttctagagagatgcctcaggggttaagagcacttgctaatcttgcagaggactcaggtttcattctcggcatccacgtggcagcttataaccatcggcaactatggttgcaggggagctgatgccctctttggcctccattggcagtggtcatgcaagtgctgcacgtacatacatacatacatggaggcaaaacacccacacacataaaatgatttaaataattatttttcaaaaacaggtacatcatttgaatttgaattttagaatgagaagagatcagagccatctcccaatctgttgttcactcacaaactgttgtctacacaaggatggcttaaaaacaatcctaatccacatctgtgtagtcattgctactctggtatccgagacaagaggatcagttgacccaggagtaaaaggttatcctgagcaatgcagtgagacctccatttcaaaaaaagcaaactaaataattccttgctgtgcaaatattgtgcttctaacgtgtgggctcacgagtgtttgtgtgtattggcggtgtatctgtcagcccaggaaagttaatatgtaacttgttcagtgaactttttttaatgctgtggagcatctcacctgctagtgtatgtttgtgttagggggacataactgtcactaggaaagctaatgtgtaacttattcacgttcagtgaaatgattgtggagtctgacaaaatgattttcaaaatcatctgatctggtccaaccatgttacaagccaggagactaaaagaaaaacattgtcatgggaggccctgaatgatgggcaagatcctaagactctgacagatctgtttcttccaactgctcttttaggcagatgctctctctgacttgggaactacctccagcattactgtgaggggtaattgctaagttgcagggagtcatttcctacaatttcatatcctgttgctaatcttggaaggtggtggctgctgcagaatgtctttgcttggtgacacagctgtatgtgaaagcatttgtgcagactgtaatttgactctaggctacacatagtttgctctttgttcttccttctctggcctctctatgggccctgcaagcagatttggccagctgcatctctaaatctataaactttgagttttacatttggtaacatttaaaattttaattaggttgcaagtttttttaatcatattaattttgcccagaaatattctgatttttttttgtcatgagatcaatgtcataactttttttaaaaagtcatatttgcaccagatctcactgcttagtaaattattcactacaaacaagctcggtatataattttagggttttctggttctatcattttattaagaaatgtgaaccggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaagaaatgtgaaccattgtcagaaaaatccataaatggaaagaatatcatcaccagttttgttgtttttgagacaggatatcatattgcccagactggctttgaactcaccgtgtagccaaggaaggccttaaactcctgatccttcagcttcctgagagtttatgggcatgtgccaatctgcccagctatagtagccatttttgtttagtttaacaattttcatatatatatatatacacactatgtgtgtgtgtgtgtataatgttacatgtataatggtataatcattacttgttaaatatgcattcatatataatgaaatacttgagtacctcccatctaaaaaatcccatattcactgatttcagatttttggattaaggatgtattcttttaaaatgcttctctggccccaagcactttagttaaaggctattcgacttgtatataagcgtatgaaaaacataagtgcacatacaagcatattttctgtatttctgagtctcaataaagtaacatttatttgaagcactaaaaaacaagctggtgttttctgctttgtctcccttctgttgataaaatatattccatatggctactacctgaaatagaagctgccacatttatccatctaatttggtaaggggttcttaatactggtttatttatgtattcattcacaagtagatggcacttaagtccaaaatgtctttaagcattattattatcctactgctttttatttctaaaatgaaacagcccataacaaatctgtataattttactggttcatgctatagagaaataaatagttggtgttttgaaattctttgccaaaagcttacgtagttggcaggaattatccggccaaatgatgttcttttcataattaaagtcctttaaataccagaccacagatcatagtggatcatccgcaaatggcaagcttaagtcttaaggccagcttttgtgagtaagacattacacataggcatgtatttcctctgtgattacttggagtctgtttttttctgtctctgttaccattctcgttctgcagtggttttagacacactatcctgggaaattatgactggagtaagttttcctttcactatgataaatgcttgacacagcctgttgtttttgacctattgagagaaaaaacaaaaaacaaaaaaaaacaaaaaaaacaacaacatacaaatctcaaagtgttcctaaatgccctttgctctcccctttcattgtgttctatgggagtgttttgagggagaaagaaagggacagcatgaaggaattcaggcagtcttcctctttttcctcattcctgtgggctttgctgtgagttgtagcaaaagactactcccacctctgatctcatagcacagtcctctttggcatattgatttagacttcagcatgcaggcatccagcaactggtctgacagctcgtggttctctctgcttccctgggaggaatctgtatgtagggttttggagagcaagagccctgatccactataagtgtcatatgaggtaaaggtgatgtaaatgtatattcctttatatgcttggattgatggagataaaacaaagttggaaatgatccaattgtagcttgtaattagattaaaagggatgctgggtaaagaggccagtgattcatatgtaaaagtacttcatacatattaaggtgttagatactcaccatttcttatatgtttccttatctgagggtaaattacatactacctttaaagaaacaagaaacaaaaataaaaattaaacttatttatttatttggagggtgtgtgtgcataaatgtgcttgggtgtatgtatgagtacaggcttgcaacagcatatgtgtggatgtcagaggactatgtacaggagttggttctctccttccaccacttgagtcctgggtatcaaaatctgttcaacaagcttggtgtcaagtcccttaacctgagccttctcaccagctcagaaacctgattcttaaacatttctggagattgtctgactgttgttcagatatggtagctggcaagacgtttaaaatttttagttcaaataaacatccctactgttaatagtttatgttacaagtggatctttgctgcatttctcattataggtgttcaagagacggtatttttatttgactcaacttcctgatggttcatatattctcaattcttataaagatgagaaaaattccaaagagtctaaaggttgcatctacttggatgcctgcattgatgttgttcaggtaaggctattgcagtaatcattctttctctttcgctaagcaggttgttgatgaacaattaaaaatctaagcattctttccttcttggttgatgctatccccatgcccaaacacctatattaaaaatttccaaatcttctaagtacaccactttcattcagtgccaatatttaaaggtctatcaaacccatttgagtctgactccaaagtacttcttgatgcatattatcttttaattctgggctttttctctgagtatcccttgtattgcctgtcctagagttctgccttcttttttgttttgagattcctattattatcattatttttattatgagtacttgttgtgaatgtgggtatgtgcacatgagtgcaggtacccgtggaagcaagaagagggcattggattcccctgaagctggagttacaggcacttataccccgcttaaggtaggtactgagaactggactcaggccctatgaatgaactactaaacactgagccatctctctacccctaagtcttgccttcccaccttccaatttgctgttttatgtgagtccatcttccttcctgagacatacagtggatcattcagttgtattttcaaaacctttggatcttgatttcctgtcccacaatgaaagatttaaagaattcaaggcccatgggggttttcctttagcctatagtctaatttcatcccttttcattcctatataaatccatgttctgatcacaacacacagtatattccgtagagttaaggcatgtatatggcttccttatttattatttatttttgtgatgattagaattgaatttagttttgtgcatgctaagcaatatttgtagccaatgtttactgttgacacaaaaccttgctaaattgcccttatcttttaaaacttggtttacattccatttcaaccttaaagtgctttctgtttccttcctcgctttcatatccacaggtcaaatccagttccatgtcccctgggctatcatttggctcttacctttatcaaaaaccatactttaaattgtgttttgttctcttttggagttgtgttgcaaaacccgtctcactcattcctgtatctcctacaataattaataaggctgtgcacaccctagggagtagcaaatgtttattgatttggattactggagctatagacaaaggtcaggtgggaaagagatgtgcagaggaaatatttgaatgtaagtcaattgacagagggaaggagccttgagctgctgaagagggagtgctgattagttcaataactttagtttatctgaatccttattttcaaaactgtagtgttagattaatgagctccacgtactctatccaatactattccatgaggtgcaaatgcaaagaaattaaaccgtgagcatctgtgtaaattcaacatgttttttatctagttttgtttagtgtgcatggtgccaaggctggaacttcaggtcttaagtaaacttagcatcagccccagtccaaaggtgctttttaaatacaaaataatcacacctttgaattttactcaaaagaaaagacaggcacacatgatttctagattttctcaattagccctgatctagttccctttctttgtattgttcccacagacatccatttatgattccctcttcctagtattttccaatgcataaacctttacaacttgctacgctggcttaatttcatcctttcctatgccttgaagacagaaaaggaggaccttccttggtttcttcttgaataatgaccatgcagtagagaattattgatctatgggcctatgagtcttgacatgattgctgaggctctggaggggatactatgccacttcgtttgtcatgacagagaaggtggtaaaagaaaaaaatgtgttattgggtttgaaaacaggatgggtttttttcccttctattctaatatgtagtgtagaccactccacatattttaattagagtcacagtttaatgtgaaaccgttatgcccttcttttaccctagtgatgtatttgatactgttcattttgaaataaattgcatatgtgtaataatgagaaaatataaaggaagcattgtatttgtttcaggtcatattttcacttgcttctatcaccgagttttgaaaatctataaggaaagcacgaaaaaaattttgagtgaagatagcaaaatgcattcttgtttgaatggtggtggtttgcttttctaaatgtgaaagatcccaaagaccctaaatgattgatgccaacttcacccttactccattttgttccaaactgggaggagcatcaaagataggtttaacgtggtctgggagtttgtataccttattgaaagaagcaatgattttgtgaaagaattggtatacatataggctgagctgaggtaaaagtaacgtgcaaatgaatgcatttaatattaaagagggcagcttatctaattgaccaagtgtttccctttctccctttctctagtgccccaaaatgcgccgtcatgcttttgaactcaagatgttagataagtatagccattatctggcagctgaaacggagcaggaaatggaggaatggttgataatgttgaaaaagattattcagatcaatactgacagtttagtgcaagagaaaaaggacacagtcgaggcaatacaaggtaaggattttgaaatgatttgcgcttgaggtaaagccctcattttcaatccatagaaacatcctttgtgttaggtgaagatagaaccttaatattgaaggctaacctgcttctttatgaagagtggcttcagaagaggcttttcaaagagttggtactgcacaggacctgccatttaaaacacactcggaagaaatttgcaccagattttcaaaagtccattgaagcttttcctgtgctttcataatcccaattctttgtcataaatctagtaggaaaggatggagtgggagcaaggagagtcctcttaggttattagtaacgctctgtatggtttggaacatctgcttttaatgaatttgcagaggaggaaactagcagccaaggaaaagccgagaacatcatggccagtttggaaaggagcatgcatccggaactgatgaaggtatatctttcttatggcagcttgccttcccctgacacaaggcagggcaagatagtaaggttttagtgctagatttcatttggaaatgtcactttcaagttcaaaaccccaccaaacttgttaaacaggtagagagaaaagatacagtctaaatgatgcactgaaagtgtccactctcagtgtggaaaatctttttttctcctttctttctttctttctttctttctttctttctttctttctttctttctttctttctctctctctctctctctctctctttttatagacacaagagaaaagaagaaaaaaacattctaagcttttgtaacacctattttgtctatttttattcaatttgatttgatatataattaaataaatattcttctttcaatgggctaatgatgcagttcatgcaaatgatattcagcccaaagacacatggtaatttcttttgtaaattatgcaaataacttattcagataaagacttcggtgagcagctattgtttgtattgttttacccttctttgtggagtttgaaatgaacaaattttgaaagtagacagttattaccatgtgtatcttactctgtgttctatattataattaattgaaagtgacaaaactacttatttgtttcaatcgttgctgagtctacgtacatttttactttattcatttccctggcctggtgatacaaacttatttctgttttttctcttttcaatttagctctctctttaaaaatttaaaacgtctttaaattactgcactgtactcatgacctcattgctgtctatgatttagtggattttagtcgaatcctttttatatttttcagtcataatagactgtgcagttccttatcttccctaagactatagactcagcactgtatatgataacaggtgaaaagcactatggagatgtcagacatggtattggtctcttttatttcttgtttgcatccaaagtcttttagacttacatttttacactgagtactacatgtagaatattttagatcttatggaaatatataaagatcagatttgtttcttattatgagtctcaataatgtgatacagcggtgatgaagttgtataaatgacatggctaactggtatttagcattgttttgaaggaaatgtagcaacattatggctttttacattttagtatggcagagaaacagaacaactgaacaaactcagtagaggagacggaagacagaatctcttttctttcgactcagaggttcaggtattgatctatttctaattcaaacttgatcgagattgttttagatttgtcttattcacgttgaacatgtgtgttaactgaatcttcatttcataagactgttaatagcatggggctgagtgtatatatcttttcctcagtcctttcatcttgctgttcaccatggataaattagataatacctagcaataatttcagtattctctggatccattaagtacacctgtgatctagtgctagtgaatattcacaatataaagagtgctgaatgtaatgaactaaggcttttctccatttgatattggtatcaagaacaggaaaaatgtgtagtgtatggctctcagaatttccctcataaagaatatttcacaaaattatttggaggagtgaattctttgttttctttcccccttttctatatgaaaccctgttgaacagtttattattgttgctgttgttattgcgcgcgcgcctgtgtgtgtgtgtgtgtgtgtgtgtgtgtgtgtatgtgtgttatttgtatcccgtggcacacatgtggacgtcagaagacaacttggtggatttggtcctttaccccttaatgagccctggggattgaacttagaatttctaccatgtacggtagtgcctttagctgctgagtcatcttgattttgttttaaatataaaaaatatattatatgagcacagcaggatttagctcagtaaaagcatattaagagaatataaaataatttgagaaaaagatgattttgttatttctttttatgcttcatagagtactctaattgagtatgtataatgcatactttgataaaattaccatgtaaagttgatatcatgtgtggttcttgcatgtgtatttggggagggtatgtgcatacctttctgtgcacctgtgaagtccagaacttgacttgaaatattgtttcctatcactctccttataccttaaaatggatttctcactgagcctggagcccactgttttagctagacttgtcagcaaacccctgagatccatctgtctcttgtcatgttctccagctctgggcttacaggggtaccgtgttatgccaggatttcctgtggatatggaggctcccaatgaggtcttcatacttgcacagtaagcacttcagccagtgaccttaatgccagcgaattattttttttaaaaaacaacttctattttgccatagcaattctatatattgttttaatgtcaattatgtgatacatacatatagatgttggtgagatggtctagttagtaaagatgccaatgacttaaattcctagaaccccctttaaaggtggaaggagatgattctagaaaattgtcgtctgacccttgtgcatgtgctattgtatacataccaacacacacacatacacacacacacacacacactaacggacccgcacacacactaagtaagtaaatgtaataaaacatagatcagtgagtttcagagatggtagctctgagatactcattcagaaaactacttgttgcaagcatgacttagcctttgattgccctcagtgaatgggctgtaattggacatgtcaggctctttgacggagtacaaaggaggcaattgatggtggttgaaactaaatctagtatctttaaaaacttatgatgtagtgtttttgtggtcatgaaactgaactgatttttttatcagtgagctccagtgagagaaaacccacaaatgaatgaatgaatctttaaggaccatctttaagaatgtagtgttgattgtggaaggtcatctcaccacggagtaatgttgtgttaagaagaaaaggtgaaatgctatcccctaatttcaacttccttttctggtcacatttcaatgtagagagagaagatttttgcctgtgaccttaagggaataatgaaatgctattttgactgaagggatgtggatcaaactttaaactgtggggaaggccatatagctcaacgtttatacttggggcccatagaaagagaaggatttgggggaagaggtgctttgggccaattactcttcacattccaatgtccacattctgaagacagaaaatagagcagataaatgggcagaaattagaattgatctccatggcaatggcttgcctctgctggccccatagataagtgtttaaaagggctctgcctagtcccacacttgaattatttttgtagatagagtcagagtgaggaaaccatacattcagatacaaattttacacattagactctttacatagggcttttattatcgacacaggctgggtcaaaacagctataattatttagattcttcaggtataatacttgttttgatgaagtaactgaggaaaaaaatcttatagttcttggcttgattgttccttcttgtgaacagtctttggtcaaattcattttgagtcatttctcccctaccatgctatggcattaatgaaagtgtaagttgttccatagtctacacttggctttctgtttgcaactagaatggacaaaggtacttagactatgtgagccttgggaactggaagctttctctgaggaaacacagattcctaccctactcagaactgattcccagtatcttttgtttaaaaattgtatttatcttgaaatgcaagtactttttttttaaagaactgtatcctttatggtaattaaggcacattcctcagttctattataagctgagctcaagtttatctatcttctaggcagaaacctctctctctccctttccttctccccctccccctcccctggctccccccctccatcatttaaatgtaggtggttaccctgggtttcagccttggctgcctctcaccctagataccaatgactttccaatccttaccaacaacccagacctctcagttttccagccatgtaattacctcaaactcaaaacatccctaactgaattgctcatttctattcacctttacccccaaatctatcattcatttgtatgacacaatgaagtttttgacttcagtgtctctgagatctcctgggtctgacaccactttgttgttcttgttgccttttaaacctattcttgttagtctgacctcctaaagagcttgtgaaggaaacaaatcttactggctttgaggatatattttatgaataagaagaggaggaggaggaggcaggaggtagaggagcaggaggagcaggagaagaagaaccaattaaataatactaaaaaataatgttagataaatctaagaaaggacatatagactgtccggatgtatgcattttttttttacagggagttggggatgtgttcattgctttaggtcaggttctcatcatctccttccaagagttctctgtcagctctcaaaagttgctataaagtcttctgacaaatcttgttgaatgaaggcattaaagggggtggggttcaaatggacagagctattggattctgctgccaattctaatatgctgatctgaatctgtatctatcagtgttattatgaatactgtcttcttaaacaactcatactatctgtttttgcagagattagacttttcaggaattgagcctgatgtaaagccatttgaagaaaagtgcaacaagcgtttcatggtgaattgccatgatttaactttcaatatcttgggtcacattggagacaatgcaaaaggaccacccacaaatgtatgtatgaccctttcttctactgtgctggacccagcatattaaagaaatacctttcttttttataagtaagaactaattggcaggatgaaaattccagtgttaaatattatgataaatttggcatgaagaatttcatctttttcttttggccaaaatacaaaggtgttctcatcttgagagaattcctgcaaatcttacctcctcagagtagcacatagagaatgtgctctcttcaggacaggcatgtccctagaagctggaaaaaaatctgccctcacactggatttgactaaggaataggatttcttttagaaaattggttcatagaaattaattagtttccccaagccttagtgagacatagatgctgtttagtctgctaggctcactcattatcctatagaatgaaattcattcttggtctgtgtaaatattaggtatcatgagttgacgtggtctgaaatacttgccactgtaaatttcaaatattcagagagactatataatgttcatctttattttgggtttctagtttcaaaaatatcaagtaaagatattctttcacaaagtacctaaaacacatcagagcactttcctgcctgcaaagggttaatctttatgccatctggcatgaaatttctctttgtgagcagctttcaaatgccatctgtaaggaggaatcatgtcttccaaatttgctgatggggcagagcattttttgagtagttcactgttgactgatgctggcttttatgaattgtatagtctagtacattgcagtataccagaaagtaattgttttctaatctataagttagcaatttttggagtcatatcagtaaatgtatagagatataagttttatttgtagatcaatttttctttaggtgaaacttttgaatcctgttcatctttttaaaactataacttgttaatttttgtgaattcataccttggaaatttatacctgacaaaattaactttttatcttaatttaaaaattaaaattaaaattaaaagtcttatttctgaatgcctctcctgttattcgatgcataacaagcataatgcacttttaattaactaaatactaaactcagaagataacacaataaactcaaacttgaagggaaaaaaaacccgcattatgcaacttttctccaaaagtcttagttttaaaatgccaactgtcttcattcctaggttgagccctttttcatcaacctcgccttatttgatgtaaagaacaattgtaaaatttcagcagactttcatgtagatttgaacccaccctctgtccgtgaaatgctgtggggtacctcgacccaactgtccaatgatgggaatgcaaagggcttttcacctgagtctctcatccatggaattgctgagtctcagttatgctacataaagcaggtgagtgttgatcagtttgcagcaacttcagaacaagagagagaagcgcctttccttattttctcgtttcaggcaattgtcttatagcattccaccttttagaaggtctgtctacaaatggtcttttgctgactgaggttggcaatgggaaatgaaaagcgatgaacatgttagtcacattttggcagagtgacatttttaggtagaaccatggtaggaaatccaatgggaatattttgggaagtccaatgcaaatgtagcgccagatatacacatgtgaatacatgtacacatgtacacacacacatacctcctctgcataagtgccaaaacattgggaattttagggtcagatattatgttcattgctataggttttttaaggactctgggtctgtgatagcttttccatagattaaaatccatgtagcctctttgcttgttctttagataatagttgccagatacaggaacattcaccaacaatgggaaaagctcacaaaagagaagttgacaaagtacagcattcttaattagtatatgagaacccgatattgaattctatgtttctagtttccaacataatgtcgaataagtattcttaagtctgtttattgtattatttcaaaatattggatgttgagataggaacttcagtggatcaggtgattgatcgggtggcattcagtaatctacatcaagaagaaagttatcattgttgttattttggtattgagatgaagttgtattgatccaggctggtctggaatgcctggactaaagatattctcctgccttagccttctgagtagctggacctacaggtttaggccaccatacctaatctcaacacttaaaaaaaatgtcctttctgtgctaacatttccactggggtcttgcataatcaaaatagttttgtggcatgacataagtgttattccttcacaggcaagcaaattgacgattgggggttgggtaagctgtccatcatgacatagctaagagtgctaaagataggatttgaacctatatctgaaagatctcaagcaacagtattagaaagaatgccatgtaactaagttgtatgacatgtaccatcaccacaagcactgctggatcctgggaattgtattaggagtggagtgaggatgttgatatattctttagaagaaggtggcagtgaaatggctaggagtcaccccggtgaaaaagaattaaaccagagcctttggcacagaggaccaaagtctcagccaacaacgggctttctttagtaactttctacatcaagggacagggagatgctagacagttatggggtcacatgcagaaccccaaagggtgtgccctacccctgcattgtagcccttgtcagtaaaaacaaaatggacttctaggagctggggagatggctcaccgtgtaagtacctgctgctcaagtgtgaggaccagaacagatctctaaatatgcatataagccaggaaggcttagtggtctttctataatcccagcacacagacaaaggatctcagagacagagataggatattctggagcaagatgactatccaggctagtcaacatggtaagctctaggttcacttagagacccttcctcagtgtttaaaatggaaagccactgaggaaggcaactggtgtcaaccttgggttcccacatgcacacacataacacatgtgtatcgtacattctaaggaacacatacatcttcacacaccacatacatacatatagataataaatgaacctctgtgtgcctcactaccctctcctctaaagtgagagcagtgacactcctacttcccatggccataatgggggttagacaagatgtactatccctagaaagcactctgcaacaggcacacccaccttgttccatgcaacaccttttctcaactcagtgtgcctgttatgggtatctaagtgagcttagataaaggagggaaaacatgtgcttttatcaattgccaagaattattaaaatataacattcattgctggctttagtgtggataaattccaaggtggctggaatgggaaataataggtactcagagaaaggtagcaataccaatggtcagtttgactattctaacctgtccacatcatgtgacatactggtgcatggaccatttggaagccgaggatgcaatcttcttcactgtccccttactatataagtatctctgagcctctgtttctgaatcctttaaatgtgtacataactagtggcttcactactactcagtagggagaagaaaataatctatgagaagtagagggagagagggatttgggagggagagaggagggagagggaaagagtagctagttcagatatgggagaaaatgggggaggaagtacagagggtcaggaatttgaaaataggtgtgtagcagtgggggagggggaactggggggtagccactagaaagtcccagatgcaagggacccaagaggttctcaggacccaacagggaggactttagcctaaatacccaacaaaggggagatagaacctgtagagatcatatctagtggataggtacagcccccagttgagggatggagccacccacccaactcaaaaatattaatccagaattcctgctgtcaaaagaaaatgcagggacaaagagtggagcggagactgaaggaaaggccatccagaaactgctccacctagggatccatcccatctgcagataccaaatggggaaccccttggtcctgtggaggcttgatgacccagaataagggaactctaggcctctgaggcaggagtggttgggtgggtgagagagcaccctcgtagaggcagggggagggagggggcttgtggatgggaaactgagaagggagataacatttgaaatgtaaataaataaaataaccaattaaaacatgttgaaaatgaaagtgcagtaagataaagcatacagttaggcatagttatgcataaattatttgacatgaattagacttaattgggcatgatagtatataccagctgcttgagcctgggaactccaggccagcttagccaacatagcaagatgggtatgtggcgagaagagagggaggaaggaagaattggaaggagggagggagggagggaggaagggagggagggaggaagggaggaaagaattggtcaagtcaggtaagaagaaagagatggtaaggaagagaaatggagaagggaagggaaggagaaaaattggaaggagaggaaatgttaaaaatgggaagggaagaaaaactgaaaatgaagcatttaggaaatccaagaaattaaactggacaaataaattcaaatgggaagccactataaacgcctaagacttgaatgttgcaggtgtagctttttggaatgtattaacagactactatttccatcagccagaaggctaaggaatgtcatcagatagcacctgaagcctctacagagctttctttcaagtaatctacctagctgatgactttacggatggatttgaaaagtgccttgatttataaattcctttgttctatatctgtaaaaatttctcaacacagttaccacattggaacatgggattttgggtaacgtgaatctgtgttagcaggccatgattgcccatgtttggctccagaatcaactgtctcttatgcccctaaaataaaaacaataatcaaaatagaaaggactgaatgcaagtttcagttctgagcacacaccttctgcagttgcagcatgtcaatctattagcccagctaaagagcaaatgtctttccagcaataccagaaaccaggttctgtgactatggtatagtttgataggccaccctagtgataatcagacacctaatatgtgttattgcatcaccccatgtaagaaacttctgataacaatattattctcagtcccatcacttcataggacctgagatgtagaaacccgagatgtaggaatggccaagccagaaatgaacccaagcagtctaactcctcaaccatatttttaccttgttccatgtttgtttgtgcttgttgcttggtaatccatcatccagacttgccataaattctttgaattggctggggaggagacactgctaacccctcacactgttttatgctgtgctttgtcaaattttgaagcttcagtttagaactcatgaggtaatatgtctgcaatgctttgaaaactagaaagcaatattaacaaagttggtaatacaccaagtaggaaaagaaaacttggtaaagacccactgatgggttattttatacaaattcatttgatgttccttcaagtatgcgacaaaaaccactgacacaatatttagagaatttctctctctctctctctctctctctctctctctctctctctctttctctttttggaaagacaaaagatggtatggttattctacacacattcaaataaaatgatgtcactttggctgtatccacatgggtgcccttaaagagaggatggagacactaggcaagttctagagcctctgctgcttctttttactttgacagcaccaaagcttttaaactgcagagttttccataagatggtttgtgtgtgtgtgtgtgtgtgtgtgtgtgtgtgtgtgtgtattgcctgtatgggtccatgtgagtatatgtatataaatgtgcatgcaggtgtggagggcagagttcaacaatagtatcttcctcagtcactctttaccttcttttttcttttttttttttttgaagaaatttaatttttcatttatttatttacttggctttaatcatgtgtatgtcaaagtatgcatatatggacaaatgtgtgtgaatgtctacagaggccagaagactgttaggctcctagacctggagatacaggtgtttgttagccccacccccaacatgggggctgggaactgagaactgaactcttggcctttgcaaaaggcaactttctagtttcctccactttttaaattttatttattttatttatttttgagccagcatctctcggtgaatctggatctcttgcatccagctggactggttgaccagtaaactccagggatttacccgttttctccctagcactgggattacaggccgactgctggctttctgtgactgccaaactcaggtgctcacgcttgtgtgtcaaatgcttgatcaccccgccaattttctcagccccagatggtgagtttttgtgttagggaagcagtggaagtgtgttcttccttcttcactgtattcagtatgaattgtgagcgaattgcttggtagatctagctacttgggagacacggtatctttagtatataccaattaaaccaaacgatgtctattgtgttcattaggtctaagaactcaccttgcaaaacagccacggagaaggagcttggatgcatagggtgacactaatgacgaaataggaactgcatttggaagctttggaatctgtagcaaaagcagccagcactaccctgtggatagggtggggcgcaccgagggtaccagtgcttcagcattcaggtggcaggggcaggacggttgcttcaacttctaacctagcatgggctatgtatagctagactgtctcaaaagcagaaagcaccccaaacaacaaaaatgttctacctcttcctggaatcctggacatgatcctatgttgaatatcaacattctgtactctccacactacaagatatcagttgccaaacagccatatgtatgttacataaaaatatctaacagaagtcattttccccctagggaatcttctcagtgacgaacccacatcctgaaattttcctagttgtgagaattgaaaaggtgctgcagggaaacatcacacactgtgcagaaccctacatcaaaaactcagatccgataaaggtaattgaaaattggtacatattcctgctcaatagagaactcacccttttctggtattttaaaatagcattgtcagagacctttgtgatgaaaaatgatcttctctgaggactttttacattgtctactatggaaaactgtacctatatccactccaaggagtttattatcaatgtattgacttcaaagggctgctgttcactgtggtccatctcactctttatactatttcagtgtgatttctttcatgatgtgttcacatagtacatggtagggattttccattttctttttcctgaatgttcttaaatggcaaaattaaaagtttgccatttttatcattatcaaaatccttaaatcatgacatctgactggttagaaactgaatcctgtcctctcgtgtaataaatgagaaatctgagacctagggaagggaaggatttgtggagcaattaattcatacaaccatagttattgtgcaatttaagagtcatcaatctattgaatgttagattttactgtgctcacgtaatatttattaagaggaagatgctgaggaggcatgactaataggtgggggactttatttgcagtgtacacaaaagcctttagcattttgtatccccagggataagcatccagccagtgcttcgacgcctatttaggccttataggcagcttatcctctttgtcatctctcattgcctgttcaaacagcagctgctgcccacatgagactaattgcattgactcttgtcacttgtgccttatcttgggagtagaaggtcaactgtatctagaacaaacttcccctgtgaataatgagtatctgccagcagcgtggaaggaaatacacgttaacactactcaaagtgttcctagcagaagtctgtggtacaaaggagtccaatatctcattagtctgtcttctgaaatgaagaaaagagttgttagggagaaaacaacatacctttaagaattacttttttggctagggatatggctcagtggtagagtataaggctgttgctttgatctccagcataaaatacatacgcgcacacacacacacacacacacagagacagagacagacagagagactgagagacagagacagacagagagatagaatctaaaaagaaatgctttagttttagccttgaaaatgggtagcaaagatatattttaatatttatttatagctgtttccttccaggatttttggtgtgttataatgatgaattggggggaggtttaaagatgaatccatggcatatcgaacaaatctaaactcatctttttttctgaccatagacagcccagaaggtacacaggacagctaaacaagtgtgtagtcgccttggacaatacagaatgccatttgcttgggcagccaggttcgtgtaaatgcaatcctgacccttctatttttagttctcttaaattggggaccaatgtccttaccagcaattcagtggtccatttctggcaggctattagttgtgtcttgggacacttgggatggaaagcttcttcagactttgctatgcatctaagacctacttccaaaactctgcctgtgtgatgggaaatttcttttggtttgggttaatctgatggacactatttaatcttttattttaacacagctcattgctaaagtgatagaattttccctaaagaactagattatacaacaaattatgtacaatatgtccagtttttcagagttggctgaatttatggctttaaaacctatcggctgggcagtggtggcacacgcctttaatcccatcacttgggaggcagaggcaggcagatttctgagttcaaggatagcctggtctacagagtaagttccaggatagtctgggctatacagagaaaccctgtcttgaaaatcaaaccaaaacaaaaatatatcagaatcattctgggaaaaatgtactaaaaattttgatggcaaagaatacagtcatgaagtgcaaacttataattaatagattttctggtgaatcctgtgggaatcatgcttttggaaacatacattttctatgattcttatgttatagtagcttatgacagtgttttatccaaatcttgcaaatctacaggcaatgaggatttgaagcctgtttcttgtttatccccactttgaagtgtaaattcatcagctggtttgtggtacagcctgtacaactgactggaagttcttgggaaagggcatcatgttctgaataattcaatcaactatgttctctgggtgctagggaatagcacagggtaggagagttgaagtgaatcaacccttctgtcactatagccatttcatttggggtaaggatctcaaaatatatcatgtgctaataaatgacaaggcactattttccttgtttctcatactagtaaaacaaatgattgcctaggataggtgactggcaaaaactaatgcaggctggtattctagaagggaaattgtggcttataaaatatacacatatacttaattgtatctaccttaaaagtccatttctgctgctactactctttattattaataataataaagtttaactctgtccagaacactcacttatctaagtacttaatgcatattttgtttacatattttttaatacatttttttgccttgtaactccacttactctagagctcactattatgtcgaccaggctgtctttgaacttgcagcaatttcatgcccttgtcttgagaatgctgttatcacagccattcactcctatgctgggcctaatatataaatatatatttaagagatgggtaccactgccccatctttgagatgaggaaatggagacacagacggaaaggataaagaaaatgaaacccacatctaaactttagaccatgtagcagagtggatatcagcatatgggctatcccacattagcactgattctagaccactgtggcagtctcctgctcttaggcagttacagacactgcctgttgctcttttgccaggtgagttaattcattctgaaaacttcagagagaaactctgatccccccagttctagtgaggcattatgctgctttctcctgcctggattttttttcccatcagctgcagtatcgggatttactaagtcttgtccaggacatttaaaaagcgtatgataagcccctgttactagaaataaatattttaaagcaggagcaatgggctttgctgaggagtgtcgggtttctggctattgctacttccagtgcattaggggctcctatattactttccattttagcagcaaaatagctgcttaaaatggtagaagaggctgggtgtggtggtgcacacatctttaataccagcacttaggaagtagagggaggaggcagacagatctttaagttcaaggccagcctgtttcagaccagccaaggctaccaagtgaaaccctgtctcaaaaaaaaaaaaaaaaaaaaaaaagagttggggaaagcctctcaaaatcatatgattatatatgtagtaaactttatataaaattatgtttaggagccaatgtaatttttaatttttatcagttttatggagataaaatgaattatatatatatccacattaataaattttcacaaatacaacgaccactttaacaatgactggtacaatatagacagaaaggttcctcatggccctgtctaggcacccaggcaaccatccatctgattatcattggataaaattttgtctctcctgaactcatcattaaagtggaatcctgcagcatatgttcctgggattggttatgtgtactcagtatgcttttgagattcgttcctgttgtgtagaattccttttgggtggcattccactgcataatatgccagtttgttcattcatttactggatcaacttctgatgtattaccagtttggagtaaattttctgtgagcatccaggtagcatgtggaaccatgcccagaactacaatggcattgctgtagggtaggtggtgtgtgcttcactttgtgagaccccaccagagcactgtcatgcatgtttacagtttcgcattcacacaggtacaagttgagtttattggtacttcaaattttgtcttaaaagcctttctgttgctgttctagacccattttcaaagatgttcagggctctctggatctggatgggagattttcccctttgtataaacaagacagtagcaagctttcaaatgaagatattctcaagttgctctcagaatacaaaaagtaagtgtgtgacattgttatactaaatgaaaggaatggataaattaatgaatttctaaagtactaaatatgagttatatatgggcaaaattgaatacttaaaaatttgagattggaattcaggtaaccaatgcatgtaacagtcatcatactttacctctaaactattattgatttctacctaggccagagaagacaaaattgcagattatccctggacagctgagtatcacagtggaatgtgttcctgtagatttaccaagtaaggatgtattacatacaatacaattgacaattgtaatcagaacttgagtatctatcaacagtttactgcaggtttgcacagagttttaatttcctagggctttgcggaccagcaagggaaggagctagctagcaaaggatgtttggggtcatatgttgcagactgaggacatcctatatattgtaaaaaccttgagatagaagcattcttaatttgtatgaatagagaggaagttggtgtggctccgtggtaggatgtggtgggaacaatggaacaggaaatggtagtagaaaaagaatatacagaattatatagagtggtaaccccttagatctgtattttattttaagtacactgagaaatcactaaaggattgcacccagggaacaatacccaatgtgcatttaaaaatatataagagtgaaatagatattttttccataaaaagaatcattgaagggaatagagaaatggcccagtagttactgctcttccagaggacccaaatttaggtcccgccacctatatttggctgctcacaaccacttgtaactccagctttaggaaatctgacaacctagcctctgcaggcacctaaacacatgaatacgtgcacgcgcacgcacacacacacacacacacacagtcaaggaaatctttaataagataattgaaatataggcaggagttgatgcatatgcacacagattttttttttacaatgttctttaacttagagggaacttggaagctaacagaatcaagactgtcagtgtgcttcgaggacttattgcacagcattaccataaaactggatgcaatgattgaaattggtgtttataatttgttcaatgagatatcagataaactatcaagattgagttgtgtacacaccctgagactttaactttgctgtgtaaaaatgtgcatagagaggagactagaagacaacacaggcaaatatccatgctagttatctgtggtagtacaatgcaatgactgattgccattgtaaatctttaatttgtgcctccagaggttctattattagcatgcattgttttagtaatcagaaaaaaaaacccaactataacaaaaatgctgtgtccttaggctcagtttagcctgggtcttccttccacccacatgactggacaataaagaaagggtcgtatggctcttgacctctcctacaatggcagcttcagaaacacatatggttcaattgctcagacattttgtgtgttttattttattatggtaacacatcataaggtctataatttcaaaagaaacttccattattttgtagtgaaaatttgcacctgcaccaagttacctttttaaaagtgattcgccatgagctaattggaagcataaattttctctcattgctttcccggataccaataaaaacttgcagcgaaagctaaaattgcagccacaggagggaaaatgcagtgggtttcttcgcagagtttgaatttgtccaaattatgatgtgttatatttggcaaatcattcagtgttgagaatgaaatcacaacccatgtctggtgtaaagggtaaaatcagcactcactatgtccttttagggttcttaaagttgtttaactttttgtcaccaactaagaattctgttttgaaatcattctttgcaaacacagcccgtgtatttctagaaatgcaggaacgtgttaatgactgttaagttacatgcttatttgtgtcctaccatagattgtattacctcttcatatgtgcccctgaagccttttgaaaagaattgtcagaatattactgtggaggttgaagagtttgttccagaaatgacaaaatattgttatccattcactatttacaaaaatcatctgtatgtatatcccttgcaattaaaatatgacagccagaaatcgtttgccaaggtaagaaaagtatacattcttggagcgtgccatattattgatcatctgctcactgcgtgactcactttggctgattaatgattttaggctaggaacattgctgtctgtgtggaattccgggattcggatgaaagtgacgcgtctgcgctaaaggtttgtttatggtggtgatctgtgtgtctttttggaaaagattgtggagatgaaaatttagtacttgatggtgtcatgctgtaagcttaatgtctttgtatttcaacaagaaaatatgctggagtggcaaagataatatttcatttcctactattacatgtgaactaaagggtttgtttaaatgatctatagtcaaaggtagtgtagatatgagctgagaagatgggcaaatgtgggctggggatgtttatctatatgatggtcctgctctgtagtatttgcctagcatgtacaaggccctgggttccatcttgaacatgagaaagtggatgaggttcccttattcccttttgacatttattccacttgaatttgcattgcttagaggtccaatcacaaggtcatttttttaaatgactaaatagtttataatgtttccttcaggaggccttatagtgttactattaggagaccttcaactcctttctctttgaaacctgaacaggcttgttgagctacaggagcacagcatgatggctttgatctgagctaggacttttgctccacaactggccaaacagtgcctccaaacttggcactgtgatctctccaaggcagagtctcagtagcatgcagtgcagccatgaatacccattatgatgcagtgcctttatggttttactataaacttcttcttcttcttgagcccagtgatcagaaacctgagacagaagccccaaacaatgcagccatcacaaagtgtgtatatggttccgtgcttctagcttgaatctaaagcagtcatactgtaacccactagagaaagataccccagcactcccaactaaatggtcgaatattgtactgcccctgtgtttgaaaggcgctccctctctcccaaagagaacattaaattcaattaaggattagctggctcaaatgcagtggaatttttcctccctctgcttgtctcttcagtagggatgagaacaaccagttccctttcctccttaaaatatcctttgagtatcatgtagaaacccttaggttacttctcagcagttcttggaaaaaaaaaaaaaaagagccttgacaactgtatttccggagaattggctgtggacttgtggagtctcaatttcctttcttagcctcctggaggctcactccacagtaagagtggagcagttagtaacttggcatgctggctctgtattcatccctgagcttattgggccaatggacgtaaaagtaaatcagagtggtcgtgaaatgggagcattccaaggaaccatagaaagccttacatgtgatgccacaaaacaagtgattttaaaaaaaaatgtgccttataaagtggtaggttaaaaaaggtaagagaagctgggcacacctgtaatgtcagcacctgaaagacagaggcaggtatgcttgcagatttctgaattcgtgatgagcctggttttcatagtgagttccaggccagccagggctacatagtgaaactctgtctcaagaagcaaacaaacaagcaaagctttatgatgtaagagaacagtaagcttatctgtctgtagcttaatagccatttgatttttttaatttttaggttgtttgtttttttaaaaaacacaccttaaaaaaaaaaaaaagcactcaaccaggaacatccaaaacgaaaacttgcaaaggtccagctatctgtcctgaagagctagaagattttagagagcatctctctcctaaaggggaaaatatctgcagcatcccactgtcagctagtttggagagcatccttttggtggccagatgttggaaagtgttctgtagccagctgagttaggaactctctggagtgctgtctgcagacactgcttttaagtgcgcgggcactttcaggcttatgatagcagctgagtggactcacccacacccctactctcactgcttccaaatgtatgtgggtcggtaacatcgtgttaaaagacctgggttaggaatggtgactctgttcctatcttttacagtgcatttacggaaaaccagcagggtctgtttttaccacaaatgcttatgctgtggtctcgcatcacaaccaaaatccggagttctatgatgaggtaaaaccctgacatttcagtatttacaaaattcagtgcttgctaattcctttctttctttctttcttttttttttttttttaaatttcaagccattcatttgcccatgcaatccctgaatgttttgtcccatgaaaattgaaaatgtcacattgaaaggaagggctcatgccctcatgatagcctatgatgacagggtgagatttacttacaatatgaaagacttctctggttatgatgataatacacaaatctcaaacaggacctgcaactctggccctcaacatttttctcagactggctctgtttcaatgaggaagtcaccgttgcttttgggggtcaccatttcttcagcattcaaacaaatccagagccaggcctggtgcagttggcctggaatcttggctgttctggagtattatacgttcaaggcttgtctgtgcaacttaattgggggtatctcaaaatgagcattaaaagggaaatataagccaatcgtggttattcacctgtaatcccaacatttgaaatgatgaaacaggagggtccaaagttcagggtcattctcagtggcatagcaagcttgaggctggcctgcgctttatgaaaatgtgtcccaatacttattgaaaacagatctggggatgtagttctcaggtaatgaatttctctagtatacacaaggccctaagatcaagtcccaggaccagaaattaaataattaactacataaatgtgggtgtagccaatgaaatgagaaaagagactaccaggaaagaggaaaggggtgttgaggaggagggaagggggatgggcaatagtgaatacctgtgaatgaagtcaaaatgaggctaaggggataggggtgatgggagaaagatagaaggcaggcagcagggacatagtggtggacatggggagctatacaaaaattgtctttgaaagtgccatagtaaaacttaatacttcaaagtgctgctaattttaaaacagaaacaaaattcactacatccagactagctttcctgaaggcacagccagctctttcctcctatggttttaactggtaagggccagcttgtttataagtgaagcactggagggagaaaactgtacagctgggtgtcaaagtcccacttgctgccctgtccaccttgttggatgggatataaagaaaagtgctgtggcctggtgttcccttctactctctctggtttattcttttctctttgtattgcccagtgtggctagtcacaacctcatctagcctctgtgtatttgcttatccaactccacaggctgcttttgattcctagtatttgcatgaggcctgaatgagcatcctgaaccagatgctctgctctgcctaggccctgaagtctccattcttggcttggtctgaaaccatccctcctgctgtcaggatttctcttgatccacctgcttttgtaaagaccctcctgccccagctctgggccccacacattcttttttcaatgtacttcccctggtttcttggggagtggagaaggaattaataatgtcttacatttttgctacccgggggtggggggagagtatgcccatgtttatgtgcagtagagcatttgatgcccagatggtctggatgctgtgaacaggcatattcgataatgaatatacctataacagaccttggtgataatactcccaaccatggccttgtatgcacgataattggaccaaatgtccatcgacatactgttgcctctctatagctaataccaaccagtgcagtgatctgaacataataaatgtgacatgattattttcagagtgtctgaaataatagatttttttctattcattcactgtatattgactaggaaagacagagaacagttattttcatatgtatctgtatggatatgggcttatgtatcaaatttaaatttttggtttttacttgctaataggagacataagcatacaattggtttctaattaggaaattacttgagaatgagtcttataagcatcttttgaacctaatttttggagtcatatgtgacatctttttgtctgttcaagaacaaagttccatttttttttctagagaaaattttatgactttgattttgagggtactgaatgcaatggtggatatttgcatattatttgtaagattttaatttttccatgcacagaggaataacaacttaggtaatataacttttcatattcaatgttcattttaaatagattgcactgagttatgtcatctctggccatgaggatgtggtttttaatctactgttttataaaattctgctttaaagtggaaggtgggagattccattgaaccatacagaaagaagtattaaatcaacaaaagttttaaatccctacaacttaggaggatagtactgtcaaactgaaactgaccagaaaaaatatctgaagtagattgaaatgattcctgctatttggccacttggcttatccttcagggggtagttctggaacagtatagtgaaactgagccgcatgtctgacagcccaacctaaaagctaaaacaaagcaaaacaaaatgttgtatgtgctgtctctgccattgcagatcaaaattgagcttcccattcacctgcaccagaagcatcacctgctttttactttttatcatgtgagttgtgaaatcaacacaaaaggaacaaccaaaaagcaagacacagtggaaactccaggtatgtgtgctgcttctgtgtgtgtgtgtgtgtgtgtgtatgtgtgtgtgtgtgtggtactggggatcagacccagggtcatataatctttctctagttgtcatttcaccaagttgtcaactgcttcactctttgaccaaaaattatatttctgagttctatagttcattgctaagccaaacacattggtgtatacctgtagtcacaactacttatgaggctaaaagtaaagtattgctggaacccaggagttgaagagcagcctgcgcagcaaaacacgtttcatctgaaagcagttcattgacaaaagacaaactatacattgatttttattatcatgcatatcaaatatctttgtccagacaaagttctttaagcaacatcaagtaacagtgctgttcttggggagaaacacatattacaatacagtattgttatttcttttatggagaattgcccagcaactagaattttccagttctgcttattgaggaagagaaaagtaagcccagagccagggacatctgtgagctggagggagactggggactgcctgttgctaatgagaacagatttaatgaagttgaataagctttagcagtgaggcaccagttctgattccatgtcatgaaagctttaaataaaccagtagaagacagctttaggagaccatccaaggactgtgagcatagcttgtgtcatttccactttacgaatgtcatctgcctcaggatgcattcattcagcagatatttatgcatatttttgtgaactatatcagtagatactacagagaatgtagtaaaaaatgcaattatcgagcttgtcttagagttaatattgatatgataaaataacatgatcacaaaagcaacttgaagaggaaacggtttatttcgttttgtagcttgtagtccttcatgaagggaagacagggcaggaactgagagtaggaacctggaggcaggaactgaggcaaagaccacagaggggtactgggggcagaaactgactcgaaggccacaaaaggggactgcttagtggcttgttcctcatggcttgctcagcctgctttcttataggactcaggaccaccagcctagggatggcaccaccaacagtgacctgaaccctcaccccatcaatcattaatcaaaaaaaaaagtttgatagacatgcctataggtcagtcttatggaggcaatcttaaaattgacagtgagtccttcccaaatgtctctatgtcaagttgacagaaaaaccaaccaggtcagaggtcatcatcattgagcatataacctagtcaaattcatggatcctatgtagacaagtctatctaatataagatagataatagtgagcactggaaaggttgtgacacgtgaacacagatgagtgagtgattcagctagtggagggacaagtggttgtgactcaggcaggctctcaggatggcattgaatgaagtcttaaaggaagggattgagcttagagtgctatgatggtaggacggtggagtattctgagttgaaggaacagcttgtacagagtcagaatattaaggggatatggacagaaatctatatgtacttaacaaacataagaccccaggatgctgggcagggaaccacaggatgtggttgaaaagcattgtggcaaactcttgaatgccaggctgcggatctaacttggttttattaccagtgtgggactattgaaaggttactaacaccagtgtgagctctttgggagaaaaatgggccaggaagcaaagtaaagggcagtgtgaggtagagcaggaagaaggaaggaaggacagaaggatacaggttggagacctatttaaaaggttatataaaggaagagggtaaactatgaccatatcaggaaggaagaatacagaaaaggaacgacaagtttgaaggcttgtatctgtaacagaaccagacagaactgtaaggacccaggagtctgtggcaggaggattgccgtgagattaatgctaggctatgctatagtatgaacttgtctttaaaaaaaaaaaaaggcaaagaaaaaattttaaggtttatgtcctctcagtaaaaacctgtgtgggttccttatgaatatattcaaccataagtggatgagaatattattttgtatgtgtgtatatattcgctgtgtatgaacacctacatgcatcaagccacaaggcagtctccagtgtcgtccttaggtgctgcccagtcttattgagacagggtctctcagtgccctggaacttggtaagtaggctgggctagctgctgagcaaacccttgcgattcatctgtctccacaagcgccctgagctggtaattgcatatcacaccacagttggctttttaaaagatttgtgctgaagtttgaatgcatgacctcatgcttgcatagcaagcactttaccaactgagctctctccccagcccctgtaaatgttattcttaaaaattgcgtctgaagctgagtgtggtggcatatgtttttaatcccaatatttgggagacagaggcaggtggatctcttgtgagtttgaggccagcttgagctactggctaattccaggatagccaggactctggagacagacaaataaaagtaaataaataaaattaaataaataaataaataaataaaatataaaaatgaaaaaatgcatctttactaagtgcatatatgctctcccctcttgttaactaattagtgaaataaaacatttacatagcatttacattccagcagatatatacaggaggatgtatgtagggtacatgttgtcaatactatgccatttttataggtaaactaaacatacacaagttttagtgtctctgagatgaattcccagggatgacagtatattgtacctggcaaatagctgactaattgctagatgattgagaggaaccattgatgtttcaaaatcaggtgatcacaaagaagatacagcagtctgtggcaggctcaggactggtgtgtttgaggagctagtgagatctctctcggcgggataccatcaggcagccgggctcattaaaactccacttagagtaggagcctggggaaatgagatgaaagcagacagaactgtaagaatccatgcaagtactttccacctgagtgataaattgcagttttctcatccaaatcctagctagaaatgggcaaggtgttcagtgaagcatgaggtggtgattcttcatgtcactcatcaattcgaactgtcctccctttaagtggcttcccacctttgagccagatggcatgctagagagcataccttttcagcttccaagtgctgcctctgagtttcaactaagggaaacacttggccatgctctgataattcacagtgcaaaagtgtcacctaagcagaatcaggcagacagaaactggattgatggtttcttggggtaggaagaaaaagacagttggagtgacgtgttagagtttcttttttggagcaatgaaaaaattccataattccttttaaatggagcaactgcaaatacatggaaaagcttacatagagtatacctcataaaaactccatgaggagaagtgttgtctaagaacaagaaatagggttttctcatttctagtttgggagttcgtgacaccccacccccattgctcaaattttcacttttacagcatcaacagcatcatctctttgtttttcatcttttaaattttcttttatttttgagatgataattactccctcactctatctttcatattcatggcctctttttttattaattgttgttacatgcatatatgtatatacattcctaaataatataacctgctcagtccaatgttacttatgtgtttgtatacttgccatttacatatatatatatatatatatatatatatatatatatatataaacctgctcagtccaatgttacttttgtgtgtgtatacttgtcatattcatatatatatatatatatatatacatacatacatacattcacacacacaattgtgtgtgtatgtgtgtgtgcatatcttaagggctgaccatttggtatttaataaccacttgttgtgctatgttccctggggaagactatttcttcctccctcagcattccttagctgctatagtcctttgtgtaggactggggcctcctgggcttcctgacattgtcattgttagtggtgcttctgcacacatcactttcctgctttttctgagagcagaggtctggggaaagcatttttgaagtggcaccgagaagatgctcttcagacatgatacagtgtctgttaaagccattcactctactgagagaaggccatgttggttatggttgtcttctaagagcaaaaagcatttgccaaattagacatgtacatgaaagcactgtaaccagatttgtgttgacttctgagttcacagtataaacacacacatgcacatacgtgcataggcattcatgcaaaggattttaaagacttagaaagcagtggatttccaaagtgctcttcagccaacaccccgtttcatttgccagaagtccatcaagagcaaggttgggttttttttaattcttttatattttatagctaaataataaacactcaaagcccagagtaatctgtataatggaaagactgacacgacatgacagaacttgagcaacacagatggctctggttagtatagcaaaacataatgagttttctaatagaaagccaagatccccctttgggggtagaagtgttaagaaatgtagagatggcaggaaatctctcagtggactgaagtcataaacactgttgcctggctgtgttctcattctactccttgacctccaggcaggaaacctctgcctatctaaatgattgactcttttactaccttggatcaaatgtagactgtaaccttgatttatgaacttaatttttccatactccaataccccagggttcccataagaagttttagaagacatgattgctgtcggtggtggtgtcaactctaaatagaaggatagataagggggatttgaaccttctaaaacatgagtctacccaagcagcccccaacagtgacattgaggcatatttgagacagttaaagattttcatcaattatctaaggccggtccctcaattctaactgaaagggctatgttgctcccgtgtttattgccaaagataagaagctaataactttttagtgggtaggctgggttaggaaatgatccaaatgcattgttccttccctgcaccacagttgcctgacacctgggttcccacatacagatccctggaaacatcaccatcctgcctgcttccccagcttgcagacatttgtgtagctaattgtatttgcaatttcatttcttacggttgattatttttttggcagtgggatttgcctgggtacctttgctgaaggatgggagggtcatcacattggagcagcagctgccagtctcagccaatcttcctccaggctacttgaatgtgaatgatgctgaatcaagaagggtaggggaatatctgcatttgggaattagtcctgttttatatatttaaaagtagaatgctgttgttataggatgggaaaggaatactcaaagtatggtctgaaggctggtcctccttcacaattaagttaagcgggaaaggctgttctgtatttacagttgatgatttcagtatcttttaaaactggatttggggtatgactttaaaaaacctcatatatttaactaattcattttatgataattatgtaaatctggagaggattggaaatccacaattctttaggacatgtttattctaaagggcacttattttctccagtatttcctttggatgaacctaatacattcctttttgaaatctcttaaaatgcatgggtgatattgtaggttgtcatgtatctctctctgtcatatatatgctcatggctgtattttctccagcaatcaaatgcggatatcaagtgggtagatggtgcaaagcctttgctgaagattaagacccacttagaatcaaccatttatactcaggtacgttacagcaccgaaatttctcatctgagtactggactatatttcctcattaaactggactacttttaatctcccactgccttggagaaattgtactttaaaatgagggcatgtaaaagctatcatcatcattttaaacatgaaaaaaaattaaacctaagttaggagaaatagcttccctgagacacaaaataataataatgagtgctagttcaaaatacatattgtgcttttccacgtcctgatgtgacccatattgtacagacttcatgagacaattgaatttcccagcagagtgtcatggtaaaactgggtactgaataccagaaatgactggccagagaaattcctggtgctacattttcttcacctgtcatttcagagctctgttcctggtcatttcattgatatacagaagcaagtcaattggatagaatacattatttctgttttgttttgtttttgttttgaagccttaaataagtgcttacctggttgggcatgtttggcaatttcctgtgtgttcaggtacaccccatgttcacctggctgtggtgctttatatgaaggtcaagaggacgtcaagggcataagttggcatagatggctcgggggtccaggtggtagaatacctagctagataggccttcaggatgctggatcggggagagctggggagcctgtgcttgacaataatgaatcaaatttcacaaggctgtttccatctgtgttccaggatctgcatgtgcacaaattcttccatcattgccagctgattcagtcgggctcaaaagaagttccaggggaactcattaaatatttaaaggtaaacgaacaggttctgcaaaaggtttttttttttttgtgcctttctgctgctacagttttgacgtgggatacaagtaccaggcaaacacctgaaaacactttgggccttaggagggcactttctccttttacttttccatcaactggctgttcagaagcaggcaggcagcacggctgcattcaggagaaaatgttcgagccaaaatttgacatcatggtttagaaacctctgattttattgcagaactggctttagcgggagggggtatctcggctcttcctgctaactaccactaaaagaagagcatgttgtagtgggggaaggggcagaaagaataaaaagaggtttccttataataaaatgtgaaatggccctgtgtctattagtgggagaatagactgtcataagggcccactaaaactaaagctagaaacattgtctgcacgcatgtagcgcaggggagggactcttaagggtaccatactgtagcagccagagaacctaatgttaggcttatttcctctgtgtggggattgtggggtgcatcctaggacctgcctggccgcagttgtttctttccatgactttgttagtgagcttggccgtggagaatatgaggcacttttatttgaagactacaggatctccctttacccattggctgctgcctaacagtaatctaaggaaccctgccttgccgagagccagtgtgctgtgacatagagccgatgggtctgaaatcataatcggattttgcgctgcagctctgtcattcactaggcctgtaattaacctttaccaagtcacggcacttctctcagccggcacatggggataagagtaattaatgcccactgcttgtgaggcttgacgaagacacctcatcttctgggtccggattgttcatgacacactaacttcggagtgcttcctgggaagcccacatcagggatctaagcaaagaaaacagaatcttactaaagaccttcatgtgttgtggagggaatgaacacagaaacgagcaagtaaagatgccacctcagatgattatagatgctatatagagagcagttcttaacctgtgagctgcgaccccttgggggggggggtgttccacatcagataccctgcatatcagatattaacattacgattcataacagtagcaaaattacagttaatgaagtagcaacaaaaacaattttcaggctgcggatcaccacagcatgaggaactgtattaaagggtcacagcattaggaaggttgagagccgctgctatagggagacaggaatgtggtagattttctgtcttactagagaggatgcctctggcaaagtgatatttgaccagctacttaaaggacgagggcagccgagtgtctggctggggaagagctgggaacagttagtacagagaccccgaggagcttggtttgatgtattgtggaggaggaaggactgtgatatggctgctggtatgaggttgggaaggcatgccctcagggtatctggggagcctctgaggctagtgaggagaggtttgttgttgttgttgttgttgttgttgttgttgcaagtcaaatagcaagtcttgcaggagttggacagagagaggcataatgtgcctttgattcttgtgctgttttgaggggtattaaacccaggacctcatgcttgccaggtacttaaacaccctaccatgcagctacggcctccctttctggcattttgtatatgtgtacgttcgtgtgtgggggtacctgtgtgtgtaagcatgagtgtgcaacatgtatgtacatggatgtgaaggccagaggtccatcttaggttctgtttctccggagctgtctaccttggttttgaagacagactctctcactggccttgagcccaccaaggagactagtgcaggccagcaagccccagggatctgcctgtggctgcatcttctctacccgtggaatcacaagccggcaacaccatactcagatttttaatgctcgtgctagagatcaaaatcaggtcttcatgcttgactggcaagcaccttacccgctgagctatctcctcggacctgtattttatttttctaaagatatttttgttaagttgcccaggttggtctttaactcactatatagcccaggtaggctgtgaactgccagtagtcctgctttaccctcccaaactgcactgaaccagactggactgcggctataaatcagagctactaggtcaggcttgactttagtttttatagtactattttatagtactattctgcctaccgcattaaaaaaatgtttaattttcattcaagagagacagtcaatcagtagtgactctgggccttagcattaaggactataatagtaatgtaactttccttttttttctaattttttattgtcatgtaagtttcaaatccagttcgtagtactatctaggaatactgcagctatatggatggacagtttatctgttaaactcattgatcatcctttggagggatctctgtgagaattttcacagagtggtgttagatacatcattttcaaatactggtattcttcaaatggaacaaaatgtatttgtttttgagggtgtggaatgacaagagttatacaatgcacatacgccctctggtggccataagtgaaatagcatgcaattgcagaaatagtgcagaaaagggttatacagaagtatctttttgaggatgagaagtcttaagtaaaggtgatttgtccacagaggtccagctacttgttagctgagccgagcctgtgacacatctcttgatgcctagtcctatgagcatcccagtcaacttttttatctgttatccctgtaaatggcagttgagctttgttatgtatgtagttcctatagagcttgcatagaggatgacttagagacattgtcagcatggatattacagcctaagcaatgacagtgcagaaagtaagttagctagcaacttcttcataatgcagagaactgttggaagacagatgtgattaaatgttacatgtttgatacagagttgcaggtattaaagattcagatcattgagaagcccatgtagagcaaggactcctatttttgccttgccgtctgttgccttaatcatttattcagctattcaccaaagatttattaagcatcttatatgggcaaggtattgttctggatgctgggaatgtcactgggggaaatgtggaccgaactagttttgtgtgggtaggaagattataaactttaggggaaaaaatgagtgctgtgaaaaaaaaaagaacaggttaatgagaacattctaggagaggcttgtctgtggaaatgccaatttcaggttaaagagtaaccgaaggaaggctgacagccataggtgagacgagattgttacagtgagtgtgtgtgccctaaacctgcgtgtttgcagggaggcaaaagatagcatagctggaacacagggagttggggaggggggccccgaggctgcttggaactcagcctgacaattgtatgggtcgtggaggcccatgatgtcctttgtagtgattttgtttgatttgtgtttaacaagggcaagatggcattaactaatttgcatgtcaaaaggacactctggctactgttgagaataaattatagaagataatagctatctagtggtagcagggagctccatcctgcatgggatgcacatctgccttgtctgcctggtatttcccttctgcttagctcacatttgcttgtggctctattgccacttcttttgtacatgtggtgcacatacctgtcctactatttgctatttgtactgcagtgatttagttccatggttttgccctttcaacagtgaactctctaatggtaggagctgtgtacacattgtttggtttgctctctgttgtttggctattagaaataaatccagtacggctccattggatgagaaggagaaatgggttcactgacatgcggatttgaattggccctggatgagtaattgggaattggctaaaacctgtgaacaaaacaaaatgaaggaaagcatatggtatatttaaagagcaatggtgatgctagtttggctttctaaagaacaatagtcaatttaaagattcaaaaatgcaggctaggtcttcagtatgttcaacttaattccatagctcaggattcctcaagttcagcactagtgacatttaggagaagatagttctttgttgtagaatgtttagcaaaactctaggcctctacctagtagaaattggtagcacatgcatgcatgcacaagctgtgagagccaaaaatagccccaaacatcgctaatctctcacagagaccatgtgacccctggatgaggaccactattcacagtaacaggaagacatcgtattctagatggctgaggatgtagatcaataggaaagtgctttcttagcatgtgggaatctgtcacatcttcagcactaatagaaaaaagaagatgaaaaccattttggtagaaagtagtctaatgtaatccgcatccatggtgggtgggcatcaatttggaaatatgtactggttacattgagaatggggagaaactatagatgttctagaaaaatgtcaaggggatatcctgaaaggggcagcagaaaagatgactgtgtagagatgtaaaaaatttctcagcaaagttagatttttctttttgcttggctcatggagtgatggaacgagtgaactatggaaagaagaaaggaatgtagcaagaaggactgtaacatttctatgtatacatgaatatataatatatatcagcactacatttagatgtttgtaataccattattagagtcagagtgtaagcatgtggaataaatatattcaaagaatgttgaggactggccagatgacccaatgggtaaaggtgacaagcctgaccatctgagtttgatttctaggacccatgtaatagaagagagaactaattcttgcaagttgtcatctgatcacacacatgcacataggcttccacatgcatgtatatgtatggtcacacagacacacacacacacaaagtaagtaaaacataaaagctttaaaagaatgttaaaatataaaactatctcagtttgatagatgctgtgggataaggcaaattatgtacagacatgttctttactgaagctcacttaacttaccatcaggctggctggaggctaagactgtcttagaaaacatatagaatgcatgacctgaaggcagatcttccagcccccagcccacaatgagtatagatttaccaaaggccagttgtcttcgtaccaagcccataaataaattgtacttgatatcttgagttaggcattcatgtctaattaacttgcagaatccaaatagcaaaagaatggggtggattgagtccttagccagtctcttgtcttgaaagtgcacatttcaacaagcatatagtcaagccagtatatcgctcattacttaattttcttattgtttcacatttgcaaattagatcatatttctgtttgtttccataactaataatgacttattttagtgtttgcatgccatggagatccaagtcatgatacagtttctacctgtaattcttatgcaactcttccgagttctcacaaacatgacccatgaagatgacgttcccatcaactgcaccatgtgagtttcggtgttataatgaaagaagctatttgcttccggtttttctttcttaatttttttgtcatggctataaacttcgctcttaaatctgtgtttgttctattccattggtttggtcatattgtctcatcattacttgtctgaaagaattttttttaacttttgatttctttctttcttctaaagaattttagattatattattttttaaaaaatcaacttgcaactaaaattaacaacacacacctaaatgaaccaaatctaaagtttgtgcatctcagcgaacttctaggcagtcagaatgccatacagaatggaagctatggaacgtccctgtttatcatatttctatgcacttaaccatcaccaaaaccaacaactccatggcagaattagaactagaaaaagttagctgtctagcctctttgatgatgtgcttcattccccttgtttggtcctttctaatcctcaaacagtcagcctttcttgttctttcatacatggtatactgagcccacaggcagattcctttacatacatacacatgatgttggctaggttcaacatgtgctagagaccatggctattctctttctgagattatgtgaccttactgaataggatacattctgaatccattcattttcctgtaactttatttctgtctatctttttgctttctttctgaccgcttgtttagaagcatggcatttcctttccactgttgttttcgttttctaccgttcttctcttactgatttgtaacttctccatactgtggttgaaaactctatctagaatgattgcagtcttcttaaatcttattaatactttttaaaataacctaatgtatgttcaatcctgcagagtatttctgtgcacacaagcagaatgtgtcttcttttactgttgaatgtgttctgtatacgaatatagtttgttaaagtatagttcaagtcaaatatttgcttcctgattttgtctggttgatccatccattgttgaaaattatatattgaaatcctacactattcttgtgctgtttactattctgtgctatttataagacaaacataaatttcaattgccctttctccagtcatgttctatttgtgttgtacaatacggtagctacttagcacatttcgcaagtgtggctagttcttccaaggaatgaatattgaattgcagttcattttagttttaaccaatatagtcactcacctataacccatgtttctcatactgagcagaatgtgtcattaaaaccgtgagttttgatttgaaagaataagctatgtctgtatgaaaacaaaggtacattataaggtagtgggtaaaacacactcgcatttcaaaatgaaaatagttaacttgaaaaactgctgtgctcagtgctggttgtctttggctctgctgcccttactgccttttcccatagaccccagtctacaaacactttcttgccctgtgcccatatctggtgtcagggtgagtcctgtttaaagtttaaggagcattattctaatataatggttctcaacgtgcatgtcccagaagcactgtgcctagcaagtttatcaaaatgttaatcattgaactttgacctcagccctacaaagtcagaaacactaagggaggagccaagcaacctgttaacacgccttccagatgatgccgttgcttactgaagtttgcgacacggctagtctcttaagtttacctccacctttcaacctattttccttgctctgtccctcctttccccttgacacagtttccatgatgtcttttgtttgtttgctttggttgagacagtctcaatctgtagcccagacaggactagactcacggtgatcttcctgccttagcctcccacgtgctgggattacaggtacacaccacctttcccagccactttattgtgttgttgttattctttttatcttcactggaaggtatttgagtatttactttccttgagctcttttacatcatagggctatgaccctacttttaagtgaatacacagatttagaaaggagacaaaacatctgggttgccaaagtaaagtatccttttgaaccaggaagtacatttttcaaggcgccaagtatgttaggcagtggactcttgtagacctagaccactgtcacctctcctctcacccctcttattgttgttcaggcagtttgtttgctttgttttgttttctgggataagacttgctcatatgtgccagtcacactaaggtcatgagttgaagcatggcccactgactttcattaatgttgtttcagggttctcttacacattgtgtctaagtgtcatgaagaaggcttggagagctacttaagatccttcataaaggtttgtggagtaaggctttcttgctggatgattttcctgcttcccaggacagttgtgtctaatggtttacttggttctgtttgcagtatagcttcagacctgaaaaaccaagcactcttcaggcccagttgatacatgaaaccctggctacgactatgatagcaatattgaaacagtctgcagatttcctagccataaataaacttctaaaggtaaggatggaggacacagctggacacaaaaccagtctctccatacttggttgtgatctttcattttatcctttttttttttaatatccttttttgtattggacaattttttattggttattttatttatttacttttcaaatgttatccccctttatcctttttgtcccagaccttccctccttctcttatattacacgtgtatctttcagagccttctccctgctccatatacaccccctgctctgaattaaatatgtaaaagataaagtttggatgaggcagaatcttgtgtttattacatacagtgtatactttgtggacctggggctgcctagttaccagctccgggccagtgttaccttatgcctaacttaacaggtagtaggtactcaataaacagttaactattatggaattctttttttttttttactatttctttattggtgatagaattattacaggccttttgagatgagttagctagagacttgatgctagctttcaaattatatgacatggccagagacttgatgctagctttcaaattatatgacatggccagagacttgatgctagctttcaaattatatgatatggccaaccatataggtcatataggcgttgccagtattgtaccacagcccaagttgattatcctttatttgtgaaagagggacaagagaggccactggggtgaatatgatcaaaatatactatatatgtgtggaaatgccatcattaaacccatttaatatataattaatgtatgttaataaagacatttaagtgttctttgtagagaatttagaagtaataaaaataactaaaagttggcttgctctcatcactaaccatgggcatccccaaacaatatcactgataaaaaattcctgccatgaagcaaccctcctattctcccagtgtgcatgcttatagaaacattgagcatattttgtgttggctaactattcctgggaatggggtttgctctggattatggttgataatccataatccagtgtcacttctttcttttctttgtctaaaatacttgggaagtattttataagaatttaatagtgaattggggtcacctgaaattgttatcaaactttggaaacaagatgtctgttaacttatcctatgtttcagagcctcaaatatttgggtatattaaggcatgtgtgggttttttttttccagtactcatggtttttctttgaaataattgcaaagtcgatggccacatacttattggaagagaataaaattaaggtaagtaggctcaataatcatttaattaattaactaatgaattagttgtgtttgaaacagcctgttgtccaggctggtctcaaacccatgttcaacctcccaagtgcttggattatagacttgagccatcacactaggctctttttaattgataaatggtaattgcacatatttatgagaataacctgtaacatatataaagaaagctaaactttacacatagcaataatatgcaaatcttttttctaatgattcttgcccttttcaagtcttgcttatagaaacaatgagtgtttgcccaaatctaagctcccacagttcatgtgttcttacagtttaatgtgcagcatctcctaaatagttagaaataattatggtaggacataggtaatatcctacagttatttactatacggaatgcatgactatgatggtttgcatttctttttaacaatgtcaatgttgaattgctggagagatggcttagtgcttagtgtttcttgctcttgcagaggacccaagtgtggttcaaagcacctatgtcaggcagctcctaattacctgttaccccagcttctgagaatgttactctcctttgaactctacaggtacccccactctccctccatatacacataaataaaatatactttttcaaataaaactttgttgaaaagattcagtgaggaaaaaagtagcaaatcagatctgttctgtctattagaaaggattaaggtatataatagaaagggtgaaaagggctcttaagcaaccagcctaggctactccatgagttctgggccacagagagcattatgtgataatgactgtcaaacaagacctcaggtggatttctgatttccattatgcacacatctgaacctaggcacatgcgaatacacacacgagcattctgttctaattcattctattattcacaacaatcttacctttcctaacagttacacacatttttagaaaaataaaaaaaaacccacaacattaatacttttttgaaatgtatcactttttttttgtttatatgaatgtggtatcttgaaaacatctgtttctgcctatgtgctatttcatgtctagtgtgtactaaggctaaataaatatttgatattaaaaaagaaagggtgaaaagaccgttagacaatattaatatcatgtgtatatttctgcatgtataatatttctgcattgtgtaataatatgaaatatatttctaaaatttggtatgtacatttacttgctttttctattttaatattatttgtcattattattattgttgttgttgttatatatatgtaatgtatggaggggaccccgtgtgagctacagagaatttttgagactttgtggagttagttctctccttcactacatgtgggttctctgtatccaactcagatcatcaggtactggacagcaaacagttttttccactgcgcagtctcacaggccgcttatttggttttgaattctgttttaaagatacatgttgagaattctggagctgaaatgcctagaaccagaagggtttcagatttttgacattttcaggtttcagaatatttgcatatacacattgagataggtatcttgggaacaggatgcatgtttaaacatgagactcattcatgtgtcatggatactttatacacatagcctgaagacaattttatgctttacatttgcacctgtgttttgacttcaatcagtaacacaccatcaggtatggaattttccatgtgtagagtcaggtctcagacagcttcaggtttttgagcatttaagatttgaggcatttcaacgagaaacaacctgtacaaagaagttttcttggttacagaaatcatagtggtgaggcatgtgaaatgaaaattcatctcataggaatttcatagaataagttgactgaaattgggatacatgctcatgttctgtaccagaaaaaataaaagtaaaagtaaaataataaataaaataaaataaaataaagaagtgtgcctgcatcgcaggagcttggattccagagctggattatattgatccatgctatgcctaataataatttcagacacatattattagagaatcagatcattcctttaagttcagggtctagaataatggttctcagtatgtgggtcccacccagatggggatctaatgaccctttcacatcacatatcagatatcctgcatattagatatttacattatgattcataacagtagcaaaattacagttatgaagtagcaacaaaagtaattttatggttggggtcaccacaacatggggtactgtattagagggtcacagcattaggaagggtgagaaccactgctctagaataaagtttactttgaacaaatactgaagtcatttttagttgaaagaaaaaaaatgtactttttaatggcatttccatgatggaacatgtttgaaagtaaaatgacagttgatctacttagacttttttaacctctgactctttttctatttgtatttaagctccccaggggccaaaggtttcctgaggcgtatcaccacgtcttacattctctgctccttgcaataattccccatgtgaccattcgctatgcagagattcctgatgagtcccgaaatgggaattatagcttagccagctttctgaaggtgagttaaaggaagccaacacatgttcaggagctttcttcactgacagggtctgaaaagaccaaggaataacagttctcttttctcctggaaaggctgggtatttggcttattttttttcccattgttgatgattaaaccatgtcttctgcatgctgggcaagtgctgcactccttagctatatcccttggctctagctaggtcttttcaaggctgttgaaataactcttgggactgatggatcagtttatccaggtttactctccctcccactgatgcaagtagttaaataaaaggctctgtctgagccagaagactggccatgcttgtttcacaaaacagtttaaatacatttcaattggaatgctgttaggtggagcaattgttggctcagccagtcctcatcagtctttatcatactctgacatctttatgcaattaaatcatttttctggtctgttggctttttggtctgtcttctctctctttctctctctgtgtgtgtatgtgtgtgtgtgtgtgtgtgtgtgtgtgtgtgtgtgtgtgagagagagagagagagagagagagagagagagagagagagttgtgagtgtgtgagtgtatgtgcgtgtagatgtacccattgcatacaccctgagaactggagcagcatacctgtcatttattgccatattcttttgcaacagtgcctgtcactgaacctagagctaggctagcagccctaaagccctggaaatcttcctgcctctcacaatccgcatggcactgggcactagaggtacaggattacatatggccatgcccagctctttgttacatagctgtttggattctaactaaagtcttcttatttgtgtagcaagggctcttaccccctgaaccatttctcatgccccaaattttgaatgtttgaactaaaggtacctacctatttgctgttgtcagcagagggtacatgtgctaatgcatatacataggaattatttgttttgctcagtgaggttctttgagaggtgacaaaaatccctatactcacaaaagatgtcagttttttactttttgttttattgtaatgtatgtaggtatgtatttatgtgtgtgtcttgttttggaaattacacagttgaggcccgtaagtcttgattctatagataatttacttttctctttttctttaaggtcacccagaagtcttgacagctattctcatattatccataaaaatgatatcccctttgtatagaacagattttcaaattctttaacatcttgataagaaacacttaaaattatataactaatcttccttctttgctttattagcgctgcttgaccctgatggacagaggatttgttttcaatttgataaatgactatatatcaggatttagccctaaggatcctaaggtaagttctaaggacatagttgtagtagcgtattggacacttaagcatgaagtcaaaggtgatagttatattctcttttagaggattcagaactgctcttttcatttgtgtactttaagtattgttaaaagcaaggattgttgagtagtgtttggagagctgccaagaccacccacagattcagcaatttactaacagaattcaacatatagttttaattctgcctaacatcgattagagtgataggatatggatacccagcaggatcaagaaagaaaacgatagcaagtgaaggctgtggtgatctccatggacacatctcatacttttcccctcttaagaagacatactttcccactaggggtgagaagacagtaaaagactgcagtatttctctttagagtttagggttctttgggattgaccaaactgtggaggtcaggaatgaagaaacatacagaaaaacctggggttggctgagccatgatggagacataccaaaagcctagaaacacagtatgtttattatctacagctgaatggggatgcaagcttcttatatacaactgatggaagaggtagggggttcactttaggggaccactttcaggatgtagtcatgcaggttgcacacactgtcaacctctgcaaatcaaaattccagactagtgatttatgttgaacacctactctactttctgatggtctagaatttttgatctgctttaacacaaagccagttctactctaagaactatataaagtgagtatacccctgtatacatgtgcattcctgacatgagcacagccatgtcaaggaccccaggtgaccctgatccataggaatagcaaggccttcccctggcccaagtacagaggttgacatgttccctctgtgataaggacctagtagactggtagaaagaaaaacaaccttatcacagagggaacatgtcaaaatcctcttttacaaatgacacccaatcagtgttgcagcaggcctttttaaatctaccactctagggccggctatgttaactctttcctgtatagattgcacctgcaagtatactttggaagataaacactccacttctgttaggaaacttaaggtcatatttttcaatcatcaacaaataaatgcctacaaaatgagacctgatatataatttatcatttaggttcttgctgaatacaagtttgaatttctccaaacaatctgcaatcatgaacattacattcctctgaacttgccaatggcatttgcaaagcctaaattacagagagttcaaggtatgtatttgtattttccattgtttgggattgttattccttttgtgatagtactagtgtaggataatgttttctaatgaaaccagttaactttgcggtaacttgagaattgttactatctgaagataggctcattaatggcattctgcatgtccttcattctatcagtggcaatagtcttagtatgaaaaatttggacatgctacatatattgttgctaaacacagatgtcagacactagtaaaatttctttctataataacagtgtattgaattttatttaagaggaaatgagaaagtatgtgaatgcctctctgctgaaagcatcaaaaataaatataaaaagtaaaatgataatttttgtgcagtaaatttatgaaatgcctcagttttaatctccattgctagttttattgaatgctttgttgtatagcactattcttatgttattatgttttttatttgtcccttttcttttcatatattaattagattttttttcatttgcggtggaccgtttgacttcagtaggtaggtttaactcggttcactctaaagtagtatgttgtgtttaaacacaattgatttgatgaatggccaagatgaatgggggcttaatttgcttttccaatcctccctagtcaaagtgagccttcagtttctggcacccataagtcgtaaaggcaagcgcttatttaccctaaaaaatgagctgcagtgctatctgaagaatcagctttcaaatgtctgtccttaggaagaagttcctctgctgcaaatcagcttggggctgggggcggggggggggggctgaatgtctgttttaagtgtttgtcacctcccttaggcgtgctgctttctctatcaccctgttgaatggctacttggccagtcttgaaggtgtacttcaccaaactgaatttattcaagtcactgaagcaaaaaaaaaaaaaaaaaaaaaatcacttgccagttacaaaatctatccatataagtccaccttggttattcaacactgtccttggatttcgaaaatgattggaattcacaaaaagtatgacaatgcaggagagtcacatgccttggtctttaaggaagtctctactcagggttagtgggtatagaagtggtgaaatgacagccagtgaaaatgagaaaatattttaagaccatagtactactatctaactacccgttactaagttaagagcatgtgcggctcacatacttgcccctgtctttttgatgatgatgaaacagtaggaaaaaggagtgggtagggcattgggatttaggaataagttggagaatttgcaacatttaaaagtcctaactgaatacactgtactgcattacattctgaatcagacaaaagaaaaacaagaaatgaaagtcattttatctaaaataaatggaaatagagagtctactacagaaattactaaattggatcccaacccccctctgatttattgtaagtcccacagtgttaatgtggaggatttaatggagatcaaaaagtctaaaaaggtgtgaaagatgcagtttgcagtggtgattttatgaaatgaaaggtctgtatctatgtgatggtgaattgatgtgagatgtgctgaactgatgatgctgaactgatgtgtgatctggtggctttttgtattagcattgtatctactatgaatcatcaggccagtatgtaatgattagtacaataatcaatacttaatactgttggcataatccagttttcttcttttcccactttataaatctaaatggataaggaaatcaagcattaatctatgaagttgagcttatagttaagatgaaatctcttcagataataaagaaatatgttaaaagatacccaaataccgaattatttcattctagaatctattgtaattgtactgagacttgaaataattatgggggaaagtatctttgctgactgaaataataattaaaataaatcatctatccctaattaagagtgttcttaattaggaaaaaatttgcatgctcattctgtattacagaggaattgtttacattgattaataatataatcttatagttcttgctagcatggccacagatgatcaaataataattatagtattttagttgtctaataatttttattttgtattaaaaactacaaattttattgtactgcagattccaatcttgaatacagtttatcagatgagtattgcaagcatcacttcttggttggcctacttctgcgggaaacctccattgctcttcaagacaactatgagatcagatacacagctatctcagtcataaagaatcttttgataaaacatgcatttgatactagataccagcacaaggtaaagctgtctgtacagtagcacactagtcaatttctactaagatgtttcaatcaagatgattacagtgaggagcatagtatgagttatcgatgaagaggtaattttacaaaccaattttttcccatttcaggccggtaagttttcttttttttaaatgccatacaaattaacttgaaggaaaacattttctcagaccattttttattagatattttctttatttacatttcaaatgttatcccatttcctagtttcccctccgaaaatcccctatcccctccccctttccttgttccccaacccatccactcccattcttggtcctggcattcccttatactggagcatagaatcttcacaggaccaagggcctctcctcccattgatgtccaacacggccatcctctgctatatatacacctagagtcacaagttacaccgtgtgttttctttgattgttggtatagttccaaggagctctgggggtactggtcagttcatattgatattcctcctatgggacttcagaccccttcggctccctaggtatttctctggctccttcattgaggaccctgtgctccatccaatggatgactgtgagcatccacttctgtagttgccaggcactggcagagcctcctaggagacagctatatcaggctgctgtcagcaggctcttgttggcatctgcctagtgtctgggcttgttggtttcaaaccatcttttaataatttgatgctggggaagaaacaagccatggtcctgcacatagcgaccacatattctaccactgagctctgtatccccagcttctcaaatcatatttttaaattaatatatataaagatctgtatttacatggcaatgaaaatgagattaggttgctttatgtatttttttatatttaatatacatatttgggccactcaaactctttcattatttattccataaactaggatttttgaaaagtcttacagggattagaaaaatggatgaatcaggagttaagagtgcttgctgctcttgcaaaggactgcagtttggttcccagtacctgcatctgacagcttatagctacctgtaacttcagttccagggagatcccatagttctggcctcctaaggcaccttcattcacatggacacacacacatacacgcacacaaacatcatatagagttttaccatgcatatgcggtcaaatgtaatgttttaaatatatacacatatccctaaataaatatgatattgattcttctttaataagacatataaagtatatcatatataaaatatgtaatatgaatttttctttatactagaaagttatgataatatttaattgtcaaaccatggaggtggctgtaaatcttatatacttttaacattatttatgtgtggccctatattgctctagttgatgtctgctactacttaaatatgtatttaaaagtcattaacattgcattttaagagcgcagaaaattaaactacaagctgaatgaatttggaataaccctaaattacttcctaataatgagaatcttaaggaaacatagtatttcctgtttgataatatatccaaaagttttaatattcaaatataaacaaacttatgatataatttgttattgtgactaatttgaaaaactgattaacaggtggattttttttcctatcattttatcatgttgtatttttcatttaccaagattttttttatctacaaatcttgccaattttttcatgattctgtctggaggtaaattgatctttcattttaagatataagttatattatgtagtttgtgataatattttttgccaaattataaataacacatatactgatcttgcaaacaaccttttcctttatgtggttatgtttgaaagctgtcactggactctgtattttgagtaagtccaaacagcaacacagttcttagataatttttgtaactattagctcatacctcaaattttggagctatcagctcacttttagtcttttaatctgatatatgaggtcaaccccattcatttatagcatatacatattattaatcaataaagctttgatatttttcagaaccagcaagccaaaatagcgcagttgtacctcccatttgtcggactgctcttggaaaatatccagcgactggcaggccgagatactctgtattcctgtgcagccatgcctagttctgtaagtgtgttaatgtatttgtgtctcaagttgtatcttgatttatctgatgcatgtggaattgacgtcatctgctatatgatctcaatcctatgaatttactttttagtccaatttacattgctactgtttttcctagagcaatgtgtctcaaactataatgtggagaatgccttagaacacaaatcttaattcagtaagccctagtgccaagtacagtcattgtgtctaataatctttagctgcctctgtctacagaggcaaagactacatttaagaagttccaaaataatggctttttactattgttttgttcttttttttttaagttctacagttatcatatttaaaaaatattagatattttctttatttatattccaaatgttatccccgttcctattttcccctccgaaaatccctggtgttaatacatttcagtgtatttattcctcttgagagaaaaatgactcttcacttccagagtatcagacactggggataaagattcctttgtttttctctatccttgatagtcattgtttaatatttcttggtatgttccttttagtttatcacagttgggtaagttttctctctattccccttggtgccttaagacttagaaggcaattaaagggtaacaatgcttctatttgtcaagcaatcttgctcttgtaatattaaaatattccccccgcaaccttagacctaaaagggtttctgtcaactgctcctagttttggcctatagagatgtgtaaaatatttatttccacctccataatttgtcccttccacatataccttctaaatttgtctccaggccatatatcatcattttgacatttgccattccaaatcacttattttcatggtgaatgcttcatgatactctccaatttgccagtggccccactaaaacaatggtgtcaggctaggtgctaccacttgaaaggctggaacttgaagatgcaaattcaaggcaaacttggacataaaatgctaccttaaaaaatgtctatattttttacttgttagcccagtggaactggtagctcctattcctcttcatattctaaatggtccttaatcgtgtgtgtgtgtgtgtgtgtgtgtgtgtgtgtgtgcacgcacatgtgcgtgtatgcatatacacacacacacacacacctatatgtatatatatatatatatatatatatacatacatatatatatatatatacatacatatacacactttacagagtcatttcatattgttgggtggcaagttgaattgtgcttttcaatataatctacatttttttccctgtaaaatgccctcgctaattttgaaagctactcttaagttctcaagaaacaactttttaaagatcagtcacaggaagaattttatttttaaattatgtgtatatgcatgtgtcaaagtgtgtgtttgtacatgaatacatgtgtctgtggaaaccagaagagagtggcatatgccttggagctggagttacgggtagtccacatgggttctgggaactgaactctgaccaagagtaattaggcacctaaaattgtggatccatctctccagccctagtagtttactgaagacagggtctcactatgactacagtctaggctggcttggaacttggaacaattctcctgaccaaatgtcctgagtgctagggttactggcatacaccaccatcaccagctgaaaatgccacttttaagctttcctggtagctttcttgcttgtggcagtggattgtgttaatgagtggaatggaaatgtaacctcactgggtgtcacattggccttcacacataatagttcatgctgatgttcattacatacacatttgacattcatgttggaaatgtgcactatctcttcttttgcagctcacattcacttaagaatatttttgttacacttcaacttcaagtattttcactggctccaaggaagagaagtgataaatatgtgtgtgtgtagtcagagattatgattattactataacaagctagcagccaattttttgaggtgtgccacttaactactaatagtacttgatgtaactttcatagtaagctttgttgaaaatcagggtaaaatctaattcagattttttggtgctagttttaaaaatggttaaatgactcgggcatcatattctgttgcaggcatctagggatgagtttccatgtggctttgtttcacctacaaacagagggagcctggccagtgacaaagacacaggtaattaatcactttaaagtttatgtatcacacaaatgtttagcaatgaacctctattctttttaaaatattctgtgttaaatctatacatctatacaaatcctgatctcttctgatgtttaaataaaatatgactcacatgcagtcatgttttctaatttatttaaacataaacaagatggctaggtatagtaggaaaactagaagataaggaaaaacaaaagacactggttccctttcctcttttctttcactaatattgggtagccactttcctaagcttgtgtttccttatctataatgtaaataagctgttttgtgaattacatagctttattacatgaacttccaaggaactgtaatacatagcaaattgttttgagaggggaaaatcacttaacatttacttgttttcttgtagcattttgatatatggatttaacattttgtagaagaccaggatctattccctgtaacatatatgtatatgacttggacttttttccagcctatgggtcatttcaaaatggtcatggaattaagagggaagattcaagaggttcccttattcctgaaggagcaacaggatttccagaccctgggagcactagtgaaaacgtaagaacctaaacatatagaataacctggtgacataataggctaccacagttgtaaaaaataaacatgcagctgtctgctcttgtagtcttttctgggtctataaaatgcaccccacaattcctgaatattttagtcgtactttcctctccttgcagctgctacttggatgtctttttctcccttaagcatagttagtgtgaaatttttagtggaagtttgagacagggttttttcaacaacgttcaagcatgcctcaagctcatgatgtctcccagacaatccttgaactcacaatctcctgttgcttcctcctccaatttactgctcaggctgatctcaaacttctggcttttagcagtcttcctgtctcattctcctgagtaattgcaatgacaggaaaataccatgatgcccagtttacctcgttgtcttaaagctgtttatagtcaattatcctcacatagtctaactcttaccttcttttgctatagttcactgtaatctagagggggtggttccagtttaaaatttctaatccaccttgcactttaattaaaacatatcagagcaaggctaattcattctttctttttaaaaaatagcatcaatttgagagaaactttaggtcatccagttgatattctcagagttccagcattacttagggtcttagagtatgccaactcttccattaaattgtttcaagcctaacattaaaatataaaatgtgtctgccttgagtttcaaaccacatcatagacagtaaagttgtcacactaggtaaagtcatagaatcatattacttagataggtctgtaattttttttaaaaatactaaacccccactcatgatttttaagtaaaactggaattttgactttggccagccatacctgaatgcatgtttataaataagatttttcctattttgtggcacacttgatgtgcatcagtcacctagagggcttaaaatggccgtacctccccctcagagggtcagtaggtctgaaacagggcctgctaatttgtgtttctaagtcctcgatgatgctgattctgctgttaggaagcaccccttaagaaccactggaatagacatatttgagcctttgggtaaatagtaatttattcacaaaggttcctatttcacactattttgaattgtgatgacaccatcatagataaggtcagagcaactaaataacttactagtaattacatgtctgacaagcaatcagaacaaaggtttgtttcaatctatttcaaagtccttagtaaatccttagttttatgtaccctgttagctcagctctattgttttattagcaatggtaaaactttgtattattgttactctattcatataaattctcaaataaatgagatcttgccattatttgggatttaaacaggcctcattaaacaataggatcaacattacttggatctaatttgggaatagtacctggtcctccttattttaattattgtatcagcacatttttttaattttaatttttactaattcactttacatcccacccactgcccccatcctagtcaccccctcccacagtcttccccccttccccttctcctctgagtggatggggaccctatcccctccccaaccctggcatttcaattttctgtgaggccagacaaggcagcccagctagaagaacatatcccacatacagacaacagcttttgggatagcccctgctttttcaggacccacatgaaggccaagctgttcctctactacatatgagtggtggttcagtctctgagggccccaagcatccaggttagttgactgttggtcttcctgtggagttcctatccactttggggcccacaatccttcctcctattcttccataagagtctccaagctccacgcactgtttggctgtgggtgtctgtatctgtctgagtcagctcctgagtggagcctctcaagaggacaacatgctcctgtttgcaagcataaccgaggaccactaatagtgccagggattagtgattgcacatgggatgggtcacaagttgggccagttattggttggtcattccctcagtctctgctcccttccccatgcctgcattacttgtagacaggatacattttgggttaaaagttttgtgggtgagttggtatgtctatcactccactggggttcttgtctggatactggaggtggccttttcaggttccatatccccaaagtattgagtcacagcttaagtcacccccattgactcttgggtacctcccttatcccagggtctgtttcttcctggagatgccctccatgtcctcacccgagtcagctacagatttccattaattctcatggccatgtagccatctctcctgtccttccccatacctgatccagaatcccccattcccctccctcccagttccctccctccatctgcctttcccctacccccacccccttccttcccattccctccccctttgaagtgaaattcaagcttccttgcttgggccttccttcttgttaagcttctttaggtctgtggaatataacatagtacctgtattttatgtcaacccatttttaaatagattaattgatgattgggggttgaatattaattaattctaggaagagattcaaatctaaaagtataactttttggagtgatggggaattacacccataacttgcatatgagagaaaaatggtctacttctcaactttgtctccaaccctaaaaagttttgttatattttcacatacctcacataatagctattctttcagaaattttttattattttagatttttattattaaacacaaagcatattggagtagagcatagatatatcattaatggctctatctttattaagaccctgaagtaatttctagtgatatcactagatactgtagcaatgaagactcagcccatttacctgtaagatatactataaaatttatagttttccacaataggactagtggttacaaaataatttagtttaaggctgtgtaaaattaccatattatttcctaaagtctcctctcttttatcttacagacacgacagagttcttcaaggagtagtgtatcccagtataatcgtctggatcagtatgaaatcagaaacctcttgatgtgctacttatacatagtaaagatgatttctgaaggtgagagactagcatattcagcaagaactgtagtaatacccccctcataggttcaggcctgtaaattgagaacatacatattagaaatagttctttaaagatttaagtcataaaatatcccttaagatgaacattaaaattagtttctaggatctgaatgtctgaaagaatttaaaactattaatttacaaaaattatgcaacaatgtttaaggggttttaagcaaatcataaaatatgttaagtagttaatatcacaggaaggaaataatcacaatacaaaattaacattttagcatttatttgaaccaggatttgaaaaacataaaaatagaagcaaaaaaaccagggctttctgaaggtaggggttgctaccattgccttttttagtaccaatgttgttgtctggagtcagtcattgtctctatagcatcactggtattgtctggagtcagtcgtcatctctgcagcaccactggcattgtctggaatcagttattgtctctgcagcatccctgatgttgtctggagtcaggctgtcaacctgcttctcttcttggagaagaatggtattatctgcttgcattacaagtttctctttatatgactatctataaacaagggattaaattcatgtccacaggagttaaaataaaattaaccttttcctcaaatgccacatttatttacaaaatttccaccctcttcttccatttctctatatttgctcaaaaagtatgcaggtctaaagaacataaaatctacctaagtaggcattatacagtgtacacatataatattatatttttcctcatgaatatagacaattaacaaagtaaatgtaaacgaaggggagtgttcaatagtaaaacacgtggctggcatatgttaagactctgggttcaattcctagtacacatacaaaacagaaagcaaaagtagttatcagcactgtaaaaatcagtaggtaaatttaaaataaattcaaaaaagcacctgagttctaatcatcattctcataaaactatcttgtgcaaatgttctattacttacattttgttttttagatttactattttttatttctctttttgttttttgtttttttttaatcagaatttcattatacaaccttaaatggcctggtaatagctgtgtagaccaggctatcctcttttgctcaagtgctgggattaaggcatgcaccatcatgcctgcttgttttacttttttatgtatatatgtaccacatatattcctgctgcctgcagaggtcacaaaagagcatgagatcctctggacctggagtttgagatggttatgagccacggagtgggtgctgggaactgaacgcaggccctttgcaagagcaacaagtactcttaactgctgagtcatctctccagccccaatttctgtaagttttggagacaaggtcatactatatataaggatggctcaatctcttgatcctcttgcttcagcctctttagtgctagaattacaagggtacatgccacatttggctatttcattttttcctatcacacttggctgtttcatttttttcctatcacacttggctgtttcattttttttcccatcacacttggctctttcattttttttcccatcacacttggctgtttcatttttccccatcacacttggcagtttcacacacacacacacacacacacacacacacacacacacacacacacataccctggtgtcagatgacaaacctagggcttcggctttgcacatgcttaggcaagtgcttcactgtcaagctaatacctaggtcatattttaacacttattttggggggtactagaaacatgaacccagggcctagcacatgagatatacactcccagcctattttatacatttttcttaattattacatactagaaaaagggataacatttgaaatgtaaataaagaaaatacctaattaaaaaaaaaaagaaaaatgccctaaattaaaaaaaaactattactttatttttgtgaccaagaaacattataacagataggaatagcaaattcttgagtataacaatacaacagtctttttttttttcatagtcaatgatagtcttaaagtcacaatcttcttgccaatcttccaaatgctgggactagaggtagctgctagcatgcccaactatttctcatttaaatttttttctggtgctacacatccaggattatctttaacaatttatagcaaacattacttgtttttctttgataatacaaaataatataaatacagattattagataatagccagttagctacagaaagattaaagcccttagccacatatgaataagaaactcttaaataaattaatacaactcaaaaatagtatttctttctttttaagatggatctttttagcctagcttgttctagaacaatcaggctaaccttgaattcaaaatttttcttccttggacccctaaaggctagaattctaccatctcatgttgaaaaataatacaaataactctgcaatccattggtctcctgaatatacaacttaggagtaaactttcaaaattatattgaagtgaaagattgaagctctatgatgggcctccatgttttggaaaagaagtaaaatgagttttaaaatcagaggttcatttcaggaaataatagattacctaataacaaccacaacacaatgctttttgccttcccacaaagataaaaaatgagagaagatggaaactaattgtgatactaatgggatttctgtgatgtttatgggatttccttactggaaccatgaatattctaaaacatttcataacaattttaatagttttgtgatgttgaaaaaaatactgtattgttggtttttaaataaaaatttatagtatgagaatactcttgttaaattcattcttttttgtatgaatttaacaagcgtaatcctataccattaatttacctatcccaagagccaacaataaaaaagatattcaagagatacgtgggggaaatgtaaaaatgggtatctctgagcacaaagaaagtagaaggacagaaaaaagagggagagaaaagatacatgtctggctacttctctccttccaatccaatgtacacacatgtacagtcaccacatactttgctagccagacaagtctggatacatgttttgatgttgtagataaagctatggcttttatttcttatgaactaaatagtttctcttgcaaatagaggttttgcttagtctgccaaatatttttccctttttaactaggtagttctattctttgtagtttcagagaggacagtttcagcaactcatatgttgtctgcatcaaatctctaaagccacactgcatcccataaagtcatattcatttttttctaaaaaatgtttatttctagatactttttaatgtgttagttcaagtgactttgtctaatagtattttcattattctatgtacatttgaatgttgaactctcatgagtttatatccttcaggaactcatatttttttaaaattttgttataaaattagtaactttaatgtcaaattttgctccatgtatatacaatcattctagggacggggaattttgaagtttccttctctgtctatatatttactatcagaaattcactgttttagggtcttaaatagcaggtatcagagttttaagtcctattgctttattagttgcatagtctgaatttacaggaacactatcttattaaacacatacacgttttccttagaagaaaacccggaggaaaactgcaatttttcctatttgctttttcttttcaacccaatatctgaaaaaaatctctcagaatcacttttggacctctttacaaaacgtcttatattttcagattcacaagtgcttttcagagtagtttctcccctggaaagcaaaggagcatgaccagatgtcactgcaatgtcagtactgtggttgctaccagagtgtgttgatctcctttttggaatatattttgaaatgaagtccacaggaaacacctgtgtactactttgccctcttttcttttccaaagataccagtgcagaactaggattacaaggcatactttcctctgaagtttcagatactattattacaggttctccagaggaactgctggaaaagctacaagtgaaggtattctttccatgtttttctgtggaagtagtcttttttccttcagggggttttggtaaagtatctgattcatctttctttgagggatccaatgcagggtttacagaacatgtacatgacagtaatatattggtctctttggtaccattttcctcaacaccgggagagtccacaaaagaagtctccgagaccacctggatttcctgactgttttgtggaattggtttatctggtggtggaggtgcttctatgacctttgacatagatagagattttttttgttcctcatgtggttttgtaatatgcctaggatatgacagcatttgtaccgcttggggaggctcctttactgtatacacatgtttaattttcatctgagtactttcaacgaaatcctcataatcactatctgaaaaattcaactgaacacgtggaggagttggttttagcctctccaaaagcattctgttctcctcttttaatttgatattttctacagtgagctcagcaatctgcactagatttttttgttgcatgttactaaattcttgctgtagcacattcctatacatttcgttcaccagacagcgctcacacgcttttgaactggaggctttgggtgcctgtgtcggtgcctgtgtcagtgcctgtgttagtgcctgtgtcagtgcctctgtcggtgcctgtgtcagtgcctgtgtcagtgcctgtgtcagtgcctctgtcggtgcctgtgatagtgttttagtaccctttggtaccgggccaccaaaccgccttccctctgtcaaccgcgcctttctcatattgcttaatttcacctgtaagcggtgaagctctttatcatggaccgctttcagggacagccacacctttttaaagtcatcagaccccaaatcacttacgctaaactttatgttctccgaccgcgtggattttttaccgtcttccctgtcttcgctcccactactgctgatctctatcctgtttgacatcctagaaacctagacaggcaagtcccaccttggcagggccactgacaaaatggccagagagcgtctgctgagtacttgtcactggctagtgaccagcaggaccaccggtggctttttaactatggagctgtggccagctacttgccatgccagtgacaaaaaaagaaaaggggggggcgggggggggaaacaaggaaatcggagaggagcctctaacaggaaggacactagcccccgcggccctgtctccctgagccctgagcccccgcagctctggcagccctgcctgtaggcaacaggcgcggggctgcggcctcgcaggcctcgcccgctgccgcccgctgcccaccgcccgctgccccgtcacagacctgcggagaagctgccttaaggcacagtccagcagagcgggtgctgaggacccacggaaaggcctggtttcttttgccctagaaagaaaccaaaggcttttggccgaaagaaaacgaaaccaaaaagtgctggagcgtgagggcaaccgcaacccaccaccgctgcctaagatggcgcggaagctctctgaggccaggcgggaatgccctcagactatcaagggggcacgcatgcgcacccccgccagccccgcccacccaccacgggagatgccaagggggccgggggaggagagaaattgcccttgccttaatcttttagaacaaatgatattttagaacaactcatatcaaaaacattttgattatgaatgattaataacttagaatcattaaaaactgttgatattcatggcttgatttaacaacaacaacaacaacaaagaaaaacactttggcgtaaaggtgaggacactgacccatgccgtaatcccagctggatccaaggtgagaaggatcatgagttccaggccaacattttacaacctcctgagattctagacccctgacttaaaaataaaattcagaaaatgctttgtgagaggcaaaggtaaaggaatggaaagtttaaatacaatctgggctacattttctacctagaacccatcttcaacccgggccacggagatagcatttgccgagtaacctgaattcagtcccggaggctcatatgtgtaaatggaacacttgagttgtcctccaacttctaaacatgcgcccaacatgcacaataaatgtaataataaatatgataatggaaattgtttttttaagaactggtgatatgctgtgtgatagagcactttccaagcacatatagagtattaggtttgatgccagtatcagaaaaaaaatgtatttaaaaaatgggagaagcaacatcagaaccccttaatccttcctcactcaatcttaaggttggcattgtctcctcaatctttgtccacctaaggctgttgcttaggtgaaagaaaagacagtagttttcctactttttatgacaaaagattttgtcatttacaatagtgtagtcaatactgttaggtatataagaggagtataaaaacaaagctatattctgacaaaaaataatattttttcttttttgattttttttagccagagctggccagagtggtacattccctttatctcagcacttggaaagtagaggcaagaggatcaggaattcaaggtcaaccttgactctgagacccctgtctaaaacaaataaaataaccccctgtaggtagataggtaataaaaggtctatttggaaaaatgaaagaaatgtattaaaggaacttacgtggataggtttaagacattcttccgtctgaaatagttggacacatagatacaccatcagcattattatccaaagaagaaaatggaaggtgataatctctttctctaaattcttaaaatattttggttaacatagcccttcaagtagcagataaaagcatccgactctctctctagaaaactgcccataaacttaccactataaaattttagagttggctaagccttgggtataaaaaaataaacaaaaatttccttattttgtcttcagctatgataggaagattagaactaaccatcgaaaagaacatctataaagtaaataaaaagattaggacctgaaataaagattacattattcatttgaaatcaattaaaaaaaatatgcatgtgtattcttttgagtgcagtgtgatgagacacgagacatgtttggaatgctagcactcaggaggtaaggcaggaagtagaaagtctgaacacatgtttaagaccagcctgggcctctataaaatcctgcctaaagaaaggagtagacagccgggtggtggtatcgcaaagcctttaatcccagcacttgggaggcagaggcaggtggatttctgagttcaaggccagccaggtctacagagtgagttccaggacagccagggctacacagagaaaccctgtctcaaaaaacaaaacaaacaaacatacgtacatatatatatatatatatatatatatatatatatatatatatatatatatatatatggagagagagagagagagagagagagagagagagaaaggagtagacttggggctggagaagagcagtgactgctcttccaaaggtcttgaattcaattcccagcaaccacatggtggctcacaaccatctgtaatgggatctgatgccctcttctggtgtgtctgagacagctacaatgtactctttttaagtgaaagaaagaaagaaagaaagaaagaaagaaagaaagaaagaaagaaagaaagaaagaaagaaaggaagaaaggaagaaaggaagaaaggaagaaaggaaggaaggaaggagaagacccccccttggtagtgcaagcctatcttcccagaactgtgaggcaggcaagaggataaggaatcatacacagtagcatagtggatttgatgtcaacctttaaaaagatagaatgtgtgcctatgggcagtgggaagacaaatagggataaagtatgtagtgatggctctttgttctcagatctaacactttctttctcctattttcagatactctcttgacttactggaataaagtgtctcctcaggagctcataaacattcttgtacttctagagtaagttacgctattttcctaaacaatcaatccacttacttgaaaaaaggttggttgaaagaaattagatgttactgtttttctgttttcgacagttaatttgctattattgtagaaaattaattatttttaataatctagagtctagcattcttcacccagtgataaaaggaaagtggcagaatatttgtgatcccatagaaaacctcttgcctagtaatagactgtcttcaaggtgagtgagaatcttactatgaccttgaaaactaggaaactataatggcatcagttagcttgtgtcacttttttgaaccagctgctgattaatgcacagctaaaatttagatgttgagctcttagagttgagtaactctaaatactcactttaggaacagacagatgtagctgtatggatttatatagaaatatacatctacctgtattttaaaacacttggggaaaccaactatggtgaatgaaaggcgttatatgataagctactatgttatcattatcaaaaactaaaaggaaaattataaacagattgaaatgtaggaattttttacataaatagtacatgcgcattatagatacagttgatatgctcatataaaatacaaagaggataatcaatatataaccagttgatgcaactttaaaaaaaatcatagaaaatatctgctaattagcagttaagatttcaaggggggtcttttaaatatatatttcttagacttctagattacaaaataatgggattttcattatagcattttcttacaaatcatttctattgatcttatcttgctgcatcctttcagctctccccactctgctgaccccatttctccattagctccgttttccctttcacatagcctgttttcgattgcattttgttcctatttttccctttcatttactctcccggaagtcctcttttttttttcatggacccctttttaatttgatgcccccccccagctgtagtaaacagtgtaaagatgctgggaaatatttaccaatgacaacaactgatggtgagaatttgcttgaaaagaggctggaggaagattagtttgcttttcctggaacttaaacaagcctgttcttgacagctagtgaagctgggaaacaatgaacatgtgggggtttggatgttatttttcctatattcatgtggttatgattattatataaaacattttactatataaaacatattataaaaacattttaatacctctgtataaaatatagcatttgcctctacttctataattaaggaacatggtttggtcttaatgagcactagagacctttgctatggtatggtacagtgcacaaaagttgatttccatgggcaagttcttttctaccctgtagtacattagtatgtaaagacatgggacttttaatgctagtataactatagcaaatataaatgaaaaggtagggtatggctagcccataagtagctatctgtagaaatgaatgctattgtagtatcatttgagtaaattgattttgggaacatatgaccctctactcattacttgtcaaattgcaccaggtagccgtatattactaatgtgctgttgttctcttttctagagtatgtttgtttcacttccgatatatggggaaaagaaacatagcaaggtaattcctgtggtactacaacattctatttcttcattcttttccaacaaagagcaatcccatcggtggcatgtaaaacctaagataatggctttaggttaatgtaaaggcagctgtgacttattcagtgtatcccaattccaagttaaaactaatgtaaatgaatactgttttcaaaggggtagtgactagagtaatagagaaggcttctaccttctgagatctccctaaaccttgaacaaatatttgtgtttcctggaggacttaagtaagggctaaatataacagtaggcagaaatcaaaaggcagaggtggctataaaatgtgtcacttttgcctgcagtctgttaacatcccaagtactaaggtgaataaaaaccctcaacagtaattaggacatacattatatattatctatttattcttttgcctcttatatctttatgaagaaatgtttgaggggttctagggcataactcagtgatagaacatttgtttagcaaatgcacaaggccctggattcaattcctaagaccacacacacacactaaaaaaaaaagaaaaagaaaaaaagaaaaaaaaggaaaatacatttgttcttggaatatggctcagcagctgagtacttttgtagcatatgttgaagccctgggttcaatcccctacactgaaaaaatacagccaggaatttctgaaggcaaatggttgaaggcaaagaaagtcttgcttagttcaattatgagtgtatctgtgtgtatatgaatgagaactactagttaaaggaatccaaatatagtcattaaaaaaacttatgtgtatgcttggacatgcccatgccatgcaaatgtgttaaggtcagagaacagcttgtggacctagtcctctccttctactatgtcccagggatccaggtcaggcttgtttgacatggtggcaaggacctttaaccactgagccatgtttccaggaccaaatagtttattctccaaatttatttattctccaaatttaaagcccatagcagtttctttctttgttttgtttgggtttgggtttgggctgcaggatctcatggagccccagtttgccttgaacttgcttgctctgtctccaaggaggaccttgaacttttgatcctcttgcctcggcttctcaaaggctgggattataggaaatgtaagcacaccatgccaagcttagtaccacagactgaagcctttgccttcggtttattgctgcgtctctggaacagcctagtaataaatctcaagtgatatgtgttccagtggctaccatcgttccctgtgactgtgagctgctctgatctttagcaccatagaccttagcatcgcagattttgttactctgacctcatggttagaagaggacaaacttctccttcctgagtttacacatgacacagctgtaagtgatccagaaagaaactggattgatattcattcttgaatatctgatgcctgatgccagccccttcccatttcagtgtctgtcttcttgcttctccttcctcacttcctgaaaagaaaaaaacctgaatattattagagtgttgttatctacttagccccagtgttttggagaaggatagaaggctctttctaaataccttagctaatagtatatgttttttgtttttttagagacaggatttctctgtgtagccctggctgtcctggaactcactctgtagaccaggctggccttaaactcagacatctgcctgcctctgcctctgcctcccaagtgctgggattaaaggcctggtggcacacgtgtgcgccaccatgcccggctggtatatgctcttttttttagatccattaaaacttataatttaggggctagagagatggctcatcatttctaatatatctcatttaatccaagcaatagttgatagaatcttcgagcagcatattatatttatctggaaacacatcaacaaaaatcacattttagtttaaaagaatcaaacaatgatgtatattattggaacacttcagtttttgttgttactgtatttttgtttgtttgttttttgttttattggtgggggtttgaaacaaggtctcactatgtagccctggctgtcctggaacttacaatgaaaaacaaactggccttgaactcacagagatccacctgcctttgcctcccaactgccagggttaaaagaatataccatcactgcctggctttacttcagttattgatttaaaattttattttagggtacatgatgcctggctatccaaacactttggaatagatagaaaatcacaaactatgccagctcttcgaaacagatcaggggtgatgcaagctcggcttcaacatctcagcagcttagaaagctcattcacacttaatcacagtaagtaatcttgggtcaagggcatatcaaatagcatggtaatgctatttaatctttttttaagaaaaattcaatgtgtatatatgtgtgatatgtatacagatatgagcattgtgtgggtgcaagtttatgtgtatagtgtgtccgtcaaattttatttttaattgtttaagatttgtttattttatttaatatgtattaatgtttagcctgaatctatgtatgtgtgccatgtttgcctggtacctgtgaaggccagaagagggcacttgatcccccaaaactggagttacagatgagtgcgagtcataatgtgggtgctgggacttaaatgcaggtcctctggaagagcaaaaagtgctcttattagtgagccatctctttagctccactaaattttaatacaatgtattaacgtcataataaaatagcatataaaaatattcagttagagttattattgttcatttagtgactactaacatatatgttctgtgctaattacggaaatgaatcgactctagctggacttagtagttcaggcctgtgattccagctaccaaggggggtgaggcagaaagttcacaagatcaaggccatcctgagcaaatttgatcttgtctaatacaataaaaagcttgtgtgtgtgtgtgtgtgtgtgtgtgtgtgtgtgtgtgtgtgtatacatacatacatacatacatacatacatacatacatacatactggggacctagcccactactagagcttgcctcttgcctagtatgcatgagaccttatattcaatccccagtagcatgaaatagtaataatgagctctaaatactagttgttggaggtatatttaaatgtgctaaagcattgagaaggcacctaggataagaagaaaaatcttgcctaactggggccgtttggggactagataaaggggaagtaccctctgatagcacatattaataataataaaaaaaaactcagaggaagaacactttcattttcattcaggaatccaaaggtcacaggaaaagaggccaagaaaactggctttgtgaagcctaattataataataaatgtcctgcatagataggccctgagctaaaagcctgtagatgcaatttcttttttattgttccttaatcttttttttacagtctagtcgttaacccccctccctgtctgccctctggtcattcctcctccatacttccttttcctaccacctgtctccaagaggatgtctctgccaccccacctccacccctccagacctccccactccctggggcctcaagtctctgaagggttaggtgtaccttctctcactaaggccagaccaggcagctttctgttgtgtgtatgtctggggcctcatatcagctggtgtatgctgcctggttggtggctcagtgaggatgcaattttttcaagtttctgcttgctgtaaaagtgcaacaaacctgcttccataggcccataagtagcctggaatcctgtcactggcagaactgaagacatctgactggaggatgctgaatttgcatggctttgtcaggttttttacccatgctggcaacacagctgaagatgcctcctacatgacttcctacttccatcgccatagctcattactgagatcacatcaccaaagaagggtgcagctaaatacatgctgcagggggaaaaaaagtgaccggaagggattaagacagaccgtgactctcgtaaggtatctttgcagtgaagctcattaggtctgatggtgtgagatccttctaagaaggcaagactgtctcactgtggctttgggaggaagttatttggtgctgataacgtaagtctggttgggcatggtttaatatgcttctctgaccttaggttctgcaacaacggaagcagacattttccaccaggcgcttctggaaggcaatactgctactgaagtatctctgacagtactagacacgatctccttttttacccagtgcttcaaggtaaagatgactttgaaatcaatcggtgacaattgcaagaaaggaaaaaaaaaactataatagctagctagtttgaggaacaatagttcggtttgaaataacctggcaggggtggtgagaaaacactggtgacaagtcaagtttgactagctaaccttgggaaatcactgaaactcagtcatccatacagtgaactgttcctactaaaatgtccttaatccccctatgcctcttaaattctattgttttacatttgtctttagattcagttttctgccaggcatagtgacatgtgcctataatgtcaggacttgggcaacagaagcaggaggggtgccaaatttgagggcacctcatctgtataacaaattccctgtcagggaaagctctgtagaaaaagataagaggtggggggagaaagaagttggggaaggaaagaagggagggggtgttttctttcatgtttttattaaaataactactactttttacctgaaatcatgagagaatcagttagccaaaatacccattataacaaggcatcttgtaaggaccatgtccagatttttctcagatttttttttctctcaactcaaatcatcattcctttgatttgtaaaagaaagtcagttagtgtgcatgcttggtggaagggtaaaagaaaacagtagatgtgagagtgctttgaaagtgaaaactatatgagcataatgtaaggtatcataagtattagaacccgaaagtagaaaacatgcctcctgtttctcttcaattacatatcatttggcattctttgcgtttctgtttgtttgcttgcttgtttgttttgccttttctcctgtcttatgtaatatagtcaatagctgtaggcttccagatagactatggaaacgtgccccatgcttctcaaaaacattatataaaggagaatcaaataatatactaatcaattgtagtaggtgatcttacaaaatattaggtctgttttaattaaaataatacacacacacacacacactcatctatttttcatcatgtcagtagacaggacatctgagtctcatgactaaacttccattcctcccttgcttttctgatactttttatttaatagatatttgtgtatttcttggtaaaactcgagtactctcttaagcattttatgaatattatcttactatttttcgtgctggggattgaaccatgacctcatgcatgcaaagcacatattgtggtgctgtgttaccctccacttttctttggaaggatggggtaataaagggaggtaatggcataagaggacatgtgatctttatgaagttatgaaaccgctctgaagttgaattgtggttattcagtactggtgccaaactagtaacagtaactgaattggactcttaaaattgatgacattttggaaacacaaattatatacccataaactaaatacaaataatgaattaacttttaatactcataatagccttagtatcattctcataaaaataagggcccacagggaggttcatattgcacagctagtcggtggtgggatcaaaattcataggtacaccaatcataatggaagtccatggttctaggtactggccaccaatgggcctgtcaccaatttgtatagttctgtatggtgggcagaattgatataacctgcttagtttcttgaaagtcaaaaaggcagaactggagaagttaaccaatgttttgattttatatagtttggtatgtgtatgtgtctctctgtgtgtacgtgtacatatgtatgctgtatatgaatatgtgcattcatgtgtttgaatgcagatccaggtgtggaggtcaaggatatcattgggtgtcagtacagggtctctgttgttttttcactgtgtactccaggctggctggcacatgagcgtccagaaattctgtatctgcctcctgcctctcataggaacactaggactctagctgctactgcttttgtgtactgattttaaatggtttgtgggaatttgaactaaattcgttcatgtcaatcacttttacccacagagccatctctccagccctggtgcttttattttgtttttgtttttatttttgtttttttgtccactctttttttttttttttttttttttttttgcactgttgggtattgaactcaggacctcccagggaggccttctcatagcagacagacattttcccactgtagcctcttggtaatttattttaaagcaaatttcatgaaccaactgatatctctgtacaactgcactgtttactgtttttattaatgtccatttacaagaggcatttaaacagtcagttgtggtatctgttttcatggtatcatgagatattatggagggttcagtttgtcaccagtgcataaccagtgcataaatatatcttatacaaaatatatttccaaaagttagtaacataatcgatttttaaaagaattggtatttctgctaattattgctctcccagagaaatataaaggccaggtgctgtgtatttgtttttagatttctgaatgtgtaagttaattaaaaaatttttcctagccagtcatgactggatatacgcatagttccagcaaatgaattgtgactatgaactagactggcttttgaatgtagcaagttctacatcccactgagctgcaaagagaactttaagaagaaaataaaaaggaaaggaaaggaaaggaaaggaaaggaaaggaaaggaaaggaaaggaaaggaaaggaaaggaaaggaaaggaaaggaaaggaaagagaaaagaaaagacagaaagagaggaagtattgaaggagaaatattcttcccatattcattttgaagtttgatgttctctattgaaagagtaattttttagctcttttaaatgctagagtttcaatagtctagatctagtttgtatggtattttgagatatcccattcaagttgaagatcacaggaatattctcaagtaaaatcctgaaaatattgaaattttataggcagatattgatgatgcagtaaaatcagttcgtttatatgtcggggagaggggacaaactgaaggcgtctataaactgtttttttttttttcatgttttatagaaccaacttttaaataatgatggtcacaacccactaatgaaaaaagtatttgatattcaccttgcttttcttaaaaatggacaatctgaagtgtcactgaagcatgtctttgcctcactgagatctttcatcagtaaggtaagaacaacttgaaagtgctaggagctcaagggaagatggaggactggggatcattgtgctgacatctacaaacagccaataactaccacagcctttgtacggatgagcacagcatagcaaaatcaatgtagagaaccaggcaataatcatttaaaatcacaacaggctttccttttaccatcataccttcacattttcagtaggcccttttcaagggtctccctctctgccttagttagggtttctattgctgcaataaaacaccatgatcaaaaagcatgttgggaaggaaggatatattcagcttacacttccacattgctgttcattgttgagggaatcaagtagggcaggatcctggaggcaggaggtgatgcagaggcatggagtggtgctgcttactggattgctcctcattgcttgctcagcctgatttataatagagcctgggaccaccagcccagggatggctccactcacaatgggctgggctctacctcatcaacagctagacataatttgctttattttattcatatcccaactgcagttttcctcctcctctcctccaagttcctccccctctgcctcccctctccaccccactccccatctacttcttctgtctcttcataaaaggggaggcctctcatgaatatcaacgagccatggcatatcaagttgcagtaagactaggcacctcccctcctattaacgctataagaggcagcccactagtgtgaaagggtttcaaaggcaggcaacagagtcagagacattcctatccccactgttgggaatcctacaaaaagatcaagctacacaattgatatatatgtgcagagggcctaggtcactctcaggcagggcccctggttgacagttcagtctcagcgagcccctgtggactcaggttagttgattctgtgggttttcttgtggtgtccttgacccctctgtacagccaaatcttatgaaggcattttctcatctagggttccctctttcagataattctaggttgtgtgtcaggttggcataagactctccctctgcatcttcttttctctctctcaagattcaacccagggcaccgcattcctagctccaatgtcattttaaagtcatcaaccaatttttctttatcttatttatcatatgataagactaacatacccctactgtgctaatgaggcacaagtcttgcttatttaaaaaattgtgtgtaggccctttgaaagcagaaactaacttttagaactccagggtcttatagaatatcttgcaaatgaaccataagcagccagtatatgaccaaataagcaagccttacctttcattgtatgtaaaacagaaattgtgtaaatgcaaagctttaaaagttttctattctttaatatattttaataataaaggaatcaatagtgaagtgagttctgtatgagcgtgataggataaatagatagaaatacatttagaaaaaaaatcatttaacagttacttgctaggtagttactgcttataatcctgagggcttactgtgcaatatatgaaaacatacacagaatgataaatatatgatgtaccttatcaaagtttcccttcagtagtagttggacttagaagatgcaactgaaagtataaatgtcaccggtgtcttcactgtaagagctagacttcatcttttaggaaacaggcaggcatggaaatattttgagcagggaagtaaaacaatgtatattaaaagagaatcagtatgaccaagggaaagtaaacctctctaaaatgagacattggctgagaagcagagacaggcagaagtttgtgaattcaagaccagcctggtctgtgtagcaagttccaggccagccagagcttcaaagatacatggtaacacaaaggggttaatagaagaaaggaaaggggaaggggaaggggaaggggaaggggaagggaaagggaaagggaaagggaaagggaaggagagattgtgagtagttcaaaacacacagttaaaaaaaaatagatgaggacctggaaaggggcgctggtgtgcggctatggagatagaatacctggtaacaagagtttttttactttatcaccagttcaccaacaaagacatcagcatcaaagggatactggaactcgccagactgactggacttcccctgggaaggatatggagggaaaacagagatcaggatcagaacattagagaaactaacatagaaagggttgaaagagaaaactgtaaaggagacgagagaaaaaagtgacagaggtagcaataaataaacaaacaaacaaacaaatggacaagaattgacagtgtcacagaaaccaaggggcaacagagtatgggcatcctcatgaggtacagagtgccaagtgagatgaaaggagcacattagaacttgcattgaggaagttgctcatgactttggccattgttcatatctcaagtaatgtaagacgacttactgtaaggattaactgcacattgccatgtctgccctcaaatgtttttatactagagtatcttgtccagcaagagtcgatctactcttgcgaaactttatgagatttcccaacttgccaatcagaaagcatttgttacacaccctttgcttgcctaacactgaacctgctaaaaaaggtaaaatgatgcagattgattcctgaaatgcagattaaaattcaaggttttcaagaagccattttgagtagctgacactcaagctttagaagtcctaaaaaatggccattgtgcacttgaaagcagcttgcttgtcccacctttcaaggataggaggtgctaataaacccacactagatatatagtttatctttcacaaagcagcaggctgaatacattctcaaagcaccaggccacttggttgttttgaaaaatcagtgaccacttgggcactctttctctatgacaaaatgttttaactgactgtttgtggagtagaaaatgggcaggtatatatgaacacttcacataaactccattttatttaataaaaaataaggatcaatttcactactactgattttctcagcaggtggaaccttagaacaggagccatcattcatcatttcagtcattcatttattcagtatgtcatcaaatatgttcctgttatgttttggactatcttagactcttctcagattgacagcattttatgccaagtacctccacattattgcagtaccttctatactgacttgacttgttctatcattggcatatgcttgcctatatggtaacaagttcaaaccatcttcagaacagagatctgcccttgtattgatttgttatcctcgaaagctctgagttttaggagaggatatagtcagcagttgattatttggtggatttcattagattttcagatattcatttctattttccttgtttagtttccctcagcctttttcaaaggaagagtaaacatgtgtgctgcattttgctatgaggttttaaagtgctgtacttcaaagattagctcaaccaggaatgaggcatctgcacttttgtatcttttgatgagaaacaactttgaatataccaagaggaaaacctttctgaggacacacttgcaggtgagtaccaatcaaaactcttctttatttttctcttcaatcattggcctccatcaaaatcaacatctatagctagaaagatagctagctcggttggtaaactgcatgttctgcaagcatgagtagctgaatttgatccaaaaggctgtgtatggggctggaggaatggctccgtggttatgagaactggctgtttttccagaggacctatgttttattcatagcacctacagtgtgactcacaaccacctgtaactccaacccagtacatctgatgtcctattttggcctcctgtgtacgaggcatgtacatgatgctcataggcatagatatagatgcaggtaaaataactatacacatagagagaaatcatttttgttttaaagccaagcatggtgggatgcacttgtcaaccgagaactgagggaatggggacagaccaacctgaggctcactagccagccagcctaaccttatttggcaagttctaagccagtgagagaccttgccactgcccccaaattaagatagacagcaactccttccatgagtattttgttccctattctaaggagggatgaagtatccacacgttggttttccttcttcattttcttgtgttttgcaaattgtatcttgggtattctaagtttctgggctaatatccatttatcagtgagtgcatatcaagtgacttcttttgtgactgggttacctcactcaggatgatatcctccagatacatccatttgcctaagaattttataaattcattgtttttaatagctgagtagtactccattgtgtaaatgtaccacattttctgtatccattcctctgttgagggacatctgggttctttccagcttctggctattataaataaggccgctatgaacatagtagagcatgtgtccttattaccagtgggaacatcttctgggtatatgcccaggagaggtattgctgtatcctctggtagtactatgtccaattttctgaggaaccaccagactgatttccagagtggttgtacaagcttgcaatcccaccagcaatggaggagtgttcctctttctccacatcctcaccagcatctgctgtcacctgaatttttgatcttagccattctgactggtgtgactggtgagctaagatgaaaggatgtagcatccagagactaccccacccggggatccattccatagttagccaccaaacgcagacactattgcacatgccagcaagattttgctgaaaggaccctgatatagctgtctcatgtgaggctatgccagtgcctggcaaatacagaagtgaatgctcacagtcatctatttgatggaacacagggcccctaatggaggagctaaagaaagtatccaaggagctgaagggttctgcaaccctataggtggaataacaatatgaactaaccagtacccccagagctcgtgtctctagctgcatatgtagcagaagatggcttagtcggccatcagtgggaagagaggtcccttggtattgcaagctttatatgccccagtacaggggaacgccagggccaagaaatgggagtgggtgggtagggtagcagggtgtgggagagggtataggggactttcaggataacatttgaaatgtaaatgaagaaaatatctaataaaaattgaaaaagaaaggtagacagcaactgaagaatgggctaacctccacacataggcatacatgtgtacctgcaaacgtgtgtgcacccacctctcactctttccccacaaagagcaacatttatagctccatcgaaaactaaggtaagtggatatcatcttcaagtcttactttgtctatagcgtgaagtcagtgccagccagggcaacctgaaagacactatctcaaaacaaaaagtacaaagaggcctgagtttatagctcagtggtagaatgcttgcctagcatgcagaaggctccgggttctagtctcagcactgcaaaagaaatcaatatctggattttcctttctgtgccatagctcagaccatgtggctctctgccacttgaaatgggactgacccaaactgagatgtgtcaaaaatataaagactaagtacattaaaaaatagagcatctaaggtgtcttatattgtttatatgttgaaatgatttgtcaaatttggggattaattaaaatatatcaaaataaatttggggccattaagatgactcagtgggtaaagtgcttgctaccaagcctgatgacctgcttttaagcaccaacaaccaaactcctgacagttgtcctctgatattcacatgcatgtataggtgcagcacatgtggaacacacacacacacacacacacacaaagtaaataggaaaactaaaataagtttcacttccatttctttttcattgtagctacttacatatgtgactcacattctctttctcttggacaagactactctagagtgtaagtcttaaggatgcgtgttctcgttcagattccatgacagtctggacatggagcagctgacttctttagcctctgtacctcagtttcctcaaatataaaataggagaaactctacttcagaatttttgtgagcctaaagtaagatgattagatagtaagattagtagatagtaaatggcaggtgattctggttgttttgcatgcatctgtaaaacctttatttaacaacaaaagattgccaagcatgatagcacatgcctaaaatccaaacacgtgcaagattagggtaaaaggattacgtgtttgagccagcctaatctacaggacaagaagaacctgtctcaaaaaaaaaagcaggaattaaagaagaattgacctgggagtgctagcctgcacctgtatactctcatatacttgagatgccaaggcaagaggatcacttaagcccacaagtccaagatcagtctggatagcacaccaagaccctgtctcaaagacgtgcaattaatctcaagattttgtggaaattacagaacttagagagatagctatctgcttgtgctagactcatagatcaactacatacatggtgtgtgaccctaggcaagttacttaatctagctgaaccagattgctcatctgtaaaatgaggccaagtatttgccatcttatattgttatgagtatgagggtgaaaatgaaaagcatatagcagctggcaccactccagcacagagaacacactgggtgataattattctccatcttcatatcattatgattaattgatgaaacaactcaaaatctaaacacagtggggactttttggctcagtagtctactatgtaatataggcaatctctagttatgtatctccactgccttggtcgttcccattagagccctttactagggaaagggttattgataaggaaacaaccattagcctgcagtctgagctattgaagagactgaagcaggaagacagaagcaagttagatgttagcctggacacagtacagtgatacccctccccacccctccaagcactttttttttaacccttttgaaaaaagtaacctttatttcttcccacagataatcattgctgtgagtcagctaatagctgatgtagcactaagtggaggatcgagatttcaagagtctttattcattatcaataactttgcaaatagcgacagacctatgaaggtaaggaataaactcaaaccactttggctggaattctgagtcagtggtgctcaccatgaacagtgcactgagtttaatctccaacaccaaaataacgaataaaaaccactttaactaaaaaaaagagtttatattcttaaaccgtggtggaattctcagtgactgtcagtatggaacatagagaatgtgtgctttaagagttgttggcttttacttaccactggatctctaacaattatattcagcagtaactaaataaatctttaaactctgtgtctgttagtaataaaatctgtgttgttttttctgcttgatttctaaatttgctcggaaaagaaatatttattttctttcttaaaaattgttaccatttataataccagctaattaaaaactgagttggaaatttgagagaaatttcacttcttaggatggctatcagatccattgccaaaagataagaaatggaacagaagggtttcattatttgttggttttgtgacttccaaacgttaggccaaccgaatgttgcttgctataacagtccaaaattgtccatcttcagcaccagtccatcaggatcaaacctaggattctgagcactacatgcttaaaaactagggcattgtttaaaaaaaaaaaaacaaaaaaaacaaaacaaaacaaaaccctgcttcgcctactgtgttgcctggaaacaggttctgagatgcttccagggcgatgaactgtccacattctcgggaaaagtcatattctcgtatatttgacaatagtgcatgaaatctttttaaaaaatcaaaagctcacagtcacaacgtgcttgatgtttgggacgtgtagaatctatgtaccagaaaaccattcccataggagtgctgcttacagggagcaaaacactgagtagtgccagctgctcacaggctgggaaagtttgccttcaagcagctttgtgggttccccaggggatcagtatacagttcagctaatcccaggagcacagaagcaacgtgtactatttcagctattttactcatgctccaagaatttatgtttctagttgttaccatgctcaaagccatcttatacaggtagattagcatgatgttttccaagtgaatagggttgatgttagctctcctcaagaagagcccctttgccttccctttactcgtttgtgaatgacttagttttatctgctaaggtcacctgtatccctgttacaataaggttagcctttccctcaggaagtagaatttctgtgaatgaacacaagggggttagatgcatctaataatgatttttaaagcagacaaaaaggcagaacggtatattatattcatattaagttccctaactgtgtacttgccccatccccatcttggagtcagaaacactttgagaggttaatgttctctttaatgtctctggagtgtgatgtgactcacaacctttcctttgtggaaatggaaagttggcagcagggttttcactaaggtgtgtgttatagtcagtgggcaagataggcacgcttctcactatgggatgttgcctgcagagcactagctctggagccagattgcctgataagaggtcctgtctccatgacttgccaaccaagagatggtggctgagcttctcaactgctctgggactcagttttcccactggtggaaatgcataaaaagagaacttaattaaaacatataaagcacccagatcagtacccagtacctatgtgctgtcaataactttcagttactgttacaaataaaccaaacatgtagcattaacaatgaaagccagatagtgtgacctcaaagatcatgtttttatgggctttgagtattgccatcaggttcaaaagcctttaaagcctggctagttgcataattttaataaaataactaattaaaaaccctttagatttgccatatgaaatatagtactaccaactgttaataaggaataaaaaccatattatagtccccacatttggatgctcatgcttcaatcctattgacaatactgctaaatatgtgggtttttttgttttcttttgttttgaaattaggcaactgcttttcccacagaagtcaaagatttgaccaagaggatccgcaccgttcttatggccactgcccaaatgaaggaacatgagaaagaccctgaaatgctaattgatctccagtatagcttagctaaatcttatgccagcacaccagagctgaggaaaacttggcttgacagcatggccaaaattcatataaaaaatggagatttttctgaggtgaatacttaaaattttgctcccactggaactcttcaaactcctttgaacctattctgacacttctttctttgtcatccacttctaggctgcaatgtgttatgtccatgtagcggctctagttgcagaatttcttcaccgaaagagtaagacctttctgttctgagatgggaggactctcggctggactctctatctttgcagtgtgcaattgtgaatgggatagaattgagctcttaaaaatatgtttaccttcagcctcattcagtgctaaacagacattgttataaaagaagactagactgctcattttggctttggcttctgtgggaggttataagaataagttaaatagtacacggctgggcttgctgcccagtatttatttcccaagtctatctccctggatgactgccacaaattcagttcttcttagggctcaagagaagctctgcataattctttcagatttatgattgcttctttcccttcctcatccttaacttcaccaaccactgtcattggactaggtatctagagctatttttatgcagtgatacctgagtgttaaagggaatcaggcccttgaaggacatcaacacttctgtatttctaattcaagattcctaattcagggatcaggctgaaagcttccccatccctaaataatattgctgaattttataaatattcaaatagcaaaacaattgagcaaggtttaaaagttaattggtagtggcgattgcaatcaagacatctgctatctatcacaatgagggcaaaatgaaagcaacttaaaggagtcatattgctcctttttttcctatgtttttcttattttattatctctggaatgtctgtatttttcatttcacatgtaaaataatggccactgtggagattcttcccaaatatgactagaatgattaaactatgcattcatgtcatttaggtttgggagaaggggtaagatttcatatagtccaagcaaacctcagacttgctatatagccaagagtgaccttgaacttctgctattcctgcctctaccccccgccccgccgggactatgggcatgcggtgttggagatcaagcccagaactttgtgaatgctaatcaagcaagcatacctgagcaacattttcagcattttacttatattttaaactgacagtgaaatgcttctgaataatcaagtttacagattgttatactcagctaggggttgtggggtctataatcccagcacatcaaggctaaggcaggaggactgcacaaatccaagagagcctgggctacatgatgaattccaagttagggtggactacaaagtatgaaccagaaatagtcccagactcattaagaattattaggaattaactctctagattttgacaatacataattatattagagattcttcctgagaatcttgttttgctcacaagtacaaagacttgatattaaacaaaaattaagaatgatttatcaaaaagaaagcaaatctatatattgttttcattctctccttagtcggggcaagggggtctggggattgataaaatggctacaggcacaataagcatgtgcttttggaccaagctgtccaggcagtccctacaagtagttctaatggagaaagaattgatcaaaataagacccaattcatctttataaattagaacactgatatgtttgtcaagttgccctaaaaatacaaatcaaagttgcacacaggccattccatatccattgacacacatgaggttcttaaacaccattctttggttttaaatgctttccggagaaactggcttcctgttacaccagctttctaattagtgggcacttgaaatatgagttccaggcctattgaaaataaagcctttccattttgaaaacaggtaattctgttagaaattcttcccaagaatcgtgttttattcacgggtataaagaccttcagagcaagattgatttctccccactagcctggccttaagtttagaaaaagtgtatcttgctctagttatttcagcattaggcagataccttaatcggcaatctgacctgtcttaacaagtggatgtagcccaagcttgtcattgatgtagttcatgatattcctaaggttctttcaagtttatctctcatcaacctcaaagagctaaggggcaaaatgatgttttgcattttaaacaaagaaatgttaaatttgagagctgtttatatttttatttatggctgctgtctatttttgaacctgtagaaatcaacgatcttaaactagaaaaccttattctaaaagggcagcaggagtagaaatcctcgggggtttttccaccttagttttaatgattgaaagaaaaaaggaatccaaaacagcttttttaaattatctgcttaaactatgagaatagtatcaagatacttaactaagctaaatcagttaagcatactataaaaatattcttaatgaaaatggaataagatgctgcctagctgacacattgtaagcaaatgttctatcgtgtagactttttaaaataaaaacaaagtttcttctatctggtggtttcctggcgcccagggatagccactatctaatgtgagaactctgcaacccagcagtatttaaaaaatccaaaaaagacttgactcttcaagcaaaatatgctttaaattacatttagcaatgatcatcaagacacactagaacttattgttttcaattaattgtccattagtaccgaagacaaaaaaaaaaaaagagtatttacattgtaaatccctgactggtatgtagcaccaaaaatttgttttctgacatctcaaagaactgtactttcagctcatttcacccaacccttctctccctcgctctgggatggaactcagggtgatgtacatagtacacaagtcctccattattttgagttataccctcagctggccccgcagccatttctcttgaaatgcactataaaaatattcttaatcatgatgtaatagaatgctaattagctgacatattggaaccaaatgttctatcatttagactttcttttaataaaaataaagtttgttctgccaggtagtttcctggtccctaggggtgtcaccttaagtgaaggaccactgttgtaatcttgaaccccttgttttgggcactgaagtgccaggaaaagggaaaagaggaagccaggaatggtgactcatgcctgtattcaggagtgggagggttagaattctgaggccagcctgtaccacatagtgagtcccagctatggtgtgatatctgatcccattcctgcccctccccatagaaaaaagaagaaagaaaagaaaatgaaagtggaagggcatctgcaattgaccccaccccaccttccaacaggtccctgatctttgtaccagagatagcttatagatagattctcaggctcttccctttgcccaagtcagtggaagcagtgataatggggaatttgttatgttactctttcttgtcctcaaatataagatacaacacaagtcagaatttcttttcattttgtctgagagccttgccatgttctggatctcactctctagagactttggcattcttctcttttcctgagagagggcacaacacttttcccctgggaaaacaagagtcaagttttctgcatttttgtaccaccacataacatcctcgttcagcaaaactttggagcttcagattctcccataagcccaaaatatgtgatttcccttctctatagcgtctctttttctcattccttatagggtaatgctgttttcattcccaagtcttcgtatccagtgtcatatagctaaaatttcacaaagtacttcattcccttgtttgttcctagttccagcttcccctttaatgctcaccccccaagatcttacctcttactcttcttctgactgccagtcatttttctaattaagtattggcactgcaatcccatcctccaaaatcctactcactcttttcacagggtcacttggactcaaactgtttgtaccttcctggactgctgccatttttatttctctagaatggcatgtgggaatgtagaagcaataactatgaagcattaagatcaagattccgtgtcaaagctaggtggagtatacctcacccacattctcagcacttgggaggcagagacaggaggatggttataagtttgatgccagccatatatgaaatgtgcctgtttgttcccctctaaatcacaagatcctagaaaacacagactgttgggacaccatgtgactttctccacctagattctcactccacaataacaattttggtcacagttgtaaaagttcttttcagctacagtttactggtaacttcccaggactccagctggcagcagttcttttattttatcttgagaaagttactttaaaatattgacaggcttacttagcaataataattcatttagtccttcttttacactaagctctattccaagcaagtgttcatgcaattctcacaaacttctattattattcttgctataatggtagtggtggtagtaatgatgatgaaaaactataaatactagagaaacaaacatccaaattcatacagtgacacaggctcatctaacttttaaatctatgacacactcagtttctccaagggtgttttatctctgccatctgtttcacttcctgtctgtcataaatcctgggctaggctcttccaataactaactgacttccctttccaagtctcagcgaaatttaaacactagagatgattaccaaaggtctttcggtggttaaacaaaaattgtccaccctcttgtctagatgatatggacagagcaaatatagaaaagatgtgcattttaatataatttttatactaggaaatcatctacaccagccactgcagatcgtgcaccaaaaccataacttacttattataatgaatttgggctcactttgtacaggaggaagaaccatagaatatagtagatctgaggaatatatgaaattacttttacagctgaaacatgtacttatgactttgacccaaagtcataagttattaaaatatgactttgacccaaagtcataagttattaaaaatagcatatccttttaagggtatctgttatttaccaaatttttttgtaataaatatggtccgtttctggttttccacacagaattattccctagtgggtgttcagcgttcaagaaaattactcccaatatagatgaagaaggagccatgaaagaagatgccgggatgatggatgttcattacagtgaagtaagagcccagggcatgcatcatcatttatagaaatttcccattttgaattgtatttatattatgttactagatctggcttaaattgaaaaatgactaagggttggtaagctttaagtaataaaactgtttaggcaaaggaattcctgttggcaggatagaatcttgtctcagtaactcttcccattatcttgttttaaaatacaacatttagatggctagaaaaatggtttagtggttaagagcatttgttctttccgaggagccagatttgattcccagcacttacatggtggttcataaccatctcttactctagtttcaggagacctgattccctcgtctggccttcatggacaccatacactccagtggtatatatacatacatgtaggcaaaatactcatacaaataaaatgaataaaacttatttttaacctccattattgaccatctttatacgatgatctctgtgactagatcccacctagcatgtgaaaagggactctagaaaactagagttaaaattgtcttttacttaaaataggcacgatatttgtaacaaagtagtgtgaatggaagcgccctgcttcctactgcagatggttagaaaacagctttgcttgtccatcagtaaagatctgttaagcaccaacataagatcaagcctattgacttgagataaaaggactgtaaaatgatgaactatgctctccaagttctgctcgggagatagtcattgaaagaatgtaggtatgtgatatgcaaaatcagaggtataaggtaaggagattaacatggctgtgatatgagagctggattacaggtgactagacataatctggagacagagtctggggaaggtcaatcttattgtccagatgtgtggcaattatgtcataagccagaatagtaaaaggcccagggtaagcatgtagctcacttggcagagtacttgtcttgcatgcataacccctgagtttgatattcagctatgcataaactggttaagtttatccatgcctatacttcagtacttcggaggtaatgatgggaggattagaagttttaatttcaagccctcctttggtacgtagagagtaagaggctagcctgagctacaggaaaccctgcctcaaaaagcaaactactacaaaagcctatactcaacaaagctggaaaatctggatgaatggacaaatttctagacagataccaggtaccaaagttaaatcaggatcagataaaccatctaaacagtcccataacccctaaagaaatagaagcagtcattaaaagtctcccaaccaaaaaaacacaggaccagatgggtttagtgcagagttctatcagaccttcaaagaagacctaattccaattctcttcaatctattccacaaaatagaaatagaaagaacactgctcaattcattttatgaagccacaattacacttaaacctaaaccacgcaaagacccaacaaagaaagagaacttcagatgaatttcccctgtgaatattgatgcaaaatactcaataaaattctcacaaactgaatccaagaacacatcaaaataatcattcatcatgaccaagtaggtttcatcccagggatgcagggatgcttcaatataccgaaatccatcaacttaatccagtatataaacaaactcaaagataaaaatcgcatgatcatctcattagatgctgagaaagcatttgacaaaattcaacatcccttcatggtaaaagtcttggaaagatcaggaattcaaggcccatacataaatctagtaaaagctatatacagcaaaccagtagccagcatcaaaaatggacagaaacttgaagcattccccctaaaatcagggactcgacaaggctgcccactccctccctacctattgaatatagtacttgaagtcctagccagagcaattcgacaacaaaaggagaacaaagggaaacaaattggaaaggaagaagtcaaaatatcactatttgcagatgatatgatagtatacttaagtgaccccaaaaattccaccagagaattcctaaatttgataaacaacttcagcaaagtggctggatataaaattaactgaaacaaaccagtagccttcctctactcaaagcatatccagactgagaaagaaattatggacacccttcacaatggtcacaaataatataaaatatgttggtgtgactctaaccaagcaagaacttcaagtctctaaagaaagaaatagaagatcttagaagatggaaagatctcccatgctcatggattagcaggattaatataataaaaatggtcatcctgtagaaagcaatctacagattcaatgcaacccccatcaaaattccaactcaattcttcttagaattagaaagagcaatttgtaaattcatctggaataacaaaaaccccaagatagtgaaaaatattcacagcaataaaagaacttctgggggaatcaccatccctgagttcaagctatactacagagcaatagtgataacaaactgtgtggtattggtacagagacttgtagatcagtggaacagaattgaagacccagaaatgaacccacacacctatggttacttaatctttgacaagggagctaaaaccgtccagtggggaaaaagacagcattttcaatgaatggtgctggttcaactggcagtcagcatgtacaagaatgcgaattgatccattcttatctccttgtagaaagctcaagtccaactggatcaaggacctccacataaaaccagatacactgaaactaatagaagagaagtaggaaagagcctcaagcacatgttccccacccaccctcaagactccctcatagaagcaggaggggggaatgggatagggggcttcggggggaaatcgggaaagaggataacatttgaaatgtaaataaataaaatgtccaatttttaaaaaggaaaacaaacccaaaatacataggaaataacattaggaaggagagaagaatgaactgctgcttaggaaaggcaatgatctgtaggtaccttggagatgtttgggaattgggaaatgatagctgctatttacagggagagtgataagtaagtacaatttcttgaagttttttttaagagctttaattatatattttagtgaaagatacatgcagaaaaatcaatgagtgaatatcatcatattcatataccagcaaatatctttaaaagagttatataatttaactatcaaaagttttctatttacatgatagagaataagaaaagaggggagtacctgatagggatgcatagtaatgccacaaagaaacctgttgacttcatagaagacaataatgaaacagtaataaaaatattttaaaatgaaatatatcacctctaaaataaaattctagatgcaaagttttataaaaaggcaaatgtgacattcacggagattgaagtggtgtatcatcccacaaaattacattttttatttttaaaatatgtatttatttgtttgtttattatttgtttgttttgcttttggagacagagtttctctgtgtagtcctggctgtcctaggactagctctgtagcagaggctggtcttgaactcacagagatctgcctgcttctacctcatgaatgcttggattaaaggcgtgtatcaccactgtctggcaaaattctttttttctaacagttgccgctgacacaggtatggcaacaaatgcctgtaatctccatcttggaaggcagaagcacaaaggatctcaagttccaagccaatctgagccacataaggagactctacctccaaagaagaattgtactaggaatatattatgccaggcatctgataacccaagttatcagaggacggaggcaagagtattgccatgaaatttgtctagtgtacctagttcctgaaccagcctggctacagaacaagaccctgtctcaagtggagaaaggggaaaaggagaagaaaagaaacaaatcttttcactttccataatctgagacttagatataatttagaattctgttggttttagtatgtggccccagtctcacacagtacttcacaggacatatatctttgagcttctccttgtcttccaaacagcagctgtatgttatctctagagatagccttgttaacatagtgggattttgtgctctatagcaataattatacatacttttatttatttaattttataaattgatcacagtgttcaaccaagtaccagtttggtctcatgtagaagggtttcctcatgctttcatatctgaaacaggtgacactgatttagcagttatattaaaatgagtcatattcagcagtacacattatctattatcctagcagtctacaggaagaggaaagaagattgttgtgagttctgcctctctgcctctctgcctctctgcctctctgcctctctgcctctctgcctctctgcctctgcctctctgcctctctgcctctctgcctctctgcctctctgcctctctgcctctgcctctctgcctctctgcccctctggccctctgcccctctgcctttacctccgcctctgcctctctccccctctgcccctctgcctctctgcctctctgcctctttgcctctttgcccctctgcctctgcctctctgcccctctgcccttctgcctctgcctgagtgctaaagaggtgtgtaccgccatgtgcctgctaaacttcttaacatagatattgaatgttaatatgttgactctttattcaagtagtcacattgattgagcaactgctatataagaggagtatatgagttacggaagaaaactagataaataattgtgttcccatttttaaagaatcatggtttattaagaatgtcagcaattgagacattgtgcaaattttgtagaactataaatatttacccaattgattagtaaaatgggaaccaagttatttgtacttgccttctttatctggaccaggaaaaacatctaggaggtcagtacctacattattctaagaagaatggaatagaaggtagaagccttccttgccttctgatgatagctgttgatcctcagcattccttagcttgcagctatatggattctgtttctgtctctgcagtcacatgttattttcctgaatacctgcagtgtcttatgctatctatattggcttgagggttcaccctttatcagtatattcatcgtttttattagttaattttatttattcagtatattcatcttaatcaattatatctataacactttttctggatcaggttacattctgaggcaggtaagaacttcagcttacagtttagagcagtgtttcataaccttcataatgctgcagccctctaatacagctcctcatgttgtagtgactcccagtcataacattattttgtttctaattaataactataattttgctattgttacaaattataatatgaatatctgatatacaacccctgtgaaagctcatttaccaccccgcccccaaggggtagcacctgacaaggtgagaagcactgattttgggaaatacaattcagttcataacgggataaagtaaaaacttcacctcattttctagctaggaatctatagaatattgccacctgctatatcgcaatgagatctacaggatgcattcagttatctaagaaacaaacaaggatcattttggcaattcgttctgtagatctagtgactcagccagaagcatagcagttggcctactctttttttattgttgagaacatgagatgatacttcacaaaattgtggcaagcagctgttatgattctcacaggcaaaagagctctctatcataggacattaacccatccctgatgttcaaatcatatgaaggaagaatttgctctctggattatttcagtctaatgaagacctaaatcactaatgcaatagcttgaaaagctgtcacattgtctttaatgttctatgcattatttcaatatgaaagaaaataatggaggtgtacaagcttagtggaattcaccttgttaagcattttttgcattgtctagttacttacttttgttaaagcatatgtgtgcatgttgatatttctgtacattattgctatttctatacatgcatacaacatttgttgatgatatccaaccatacttctacccttaccacctgccctgcacaccctggcatgatttccatcctgtagtaaatcacccttcaactttcagatcaactgagcccataatttgaatcaaaggattcaattcagcatgatactatctgcaagtaaagtctctattatcacttaaacagaacacatgtagtttactgttgacgttaatgtcatattttagaaatatttctaatttcctggtgcttgtaacatttgattttgaaaatacagttctgagactgtattttcaactgtagtgctggcacatacttctaatcccagcaatcacaaccctaaggcaggaagctcaccagtgggactacaggaatcctgagctctatagcttactgattcagaaggaagaagtgaacagggggaagatgtggtcatactaatagacttctgtgcatttgcttgaacttagcccatttggtatgttcttttgtctctagctgcatatgtagcagaggatggcctagttggccattactgggaagagaggcctcttggtcttgcaaagatcatatgccccagtacagggaaacgccagaaccaggaagcgggagtggatgggtagggaagcagggcgaggggagggtataggggactttcgggatagcatttgaaatgtaaatgaagaaaatgtctaataaaaaattttttaaaagaaaaaagacaaataagttaaaatggttagcaattgttttgtctaaagctgcttttaatgcctcattgaatatttctcttaatgcaggaggttttgctggaattgctagaacagtgtgtggatggtttgtggaaggcagagcgatatgaagtaatttctgagatttccaagttgattattccaatttatgagaaacgccgtgaatttgaggtagggaatggacacattgccatcattgccttctatactttgttttggtcttgttaaaacactaatatcatgttgtccctatcattttactctgatgtcttctaatgaaaatactggaattgtatcacagaataagtattcttattttgccctttttgtttgtgccagggtgcataggatcttgagcatgatagacacatgctctgtctccaagactcagtccagattgtagcattcctccctggactgtcaaaaccaccaaacctccatatcaccaagaatgacctaaaaacatgattcttttctttgaacttgagtgcagagactacaaagtactggctgaccatgatgaagaaacagtatgatggcattaataagccagctgtgagtgtctaccaatgtgccctgccaagaaaactgttgataaattctagtgaagaactgctgccatgtgcacaaggcagaatttttaatattcaagtctttgggcccatatcataatttccactgcatctgtacaaaaaggggaaggaaattggcttgggattcaagctattttgagagtagatgtgggatgagctgagtgtggtgacatacaaaaacaaaaacctgttttaaactcaaaggttttgggaagttgctgaagctgaccagaggtgctaagtccctccctctccaatataaatggtaaggactgctagaagacactctcagaccatctgagctgcccagaagagtctcagatcaactgagatctctgaaacagacactctttaaccagttcagctacctgcaagtgtgctccagggttttagttctcttgggctttcatgagtcacgccacggtagacttttgatgatacagctgtctttgagtcatttttgcccatataagggcttatctcacccatacctctattagcaaaccacataaagctcattaattcaacagaaaaaaaatgtttgaagatatcgacaaatagaactagagaaacagctcagcggttaagagcacctgtggcttttgctgaggacctgggtccaatttccagcacccccatggtggctgagaatcgtctgtaaatcccattccaggggatctgatactgtcttccgacctctgtagtatacaggcatacatgcacgcaaaatatcacacgcagaaaaattcattttaaaaaggaaagttaataagtatacatacataggtaaaattcacatgttcataaaatttaaaatattttgtacttctgggcattgaaccctggctaggcaagttttctaccactcagctgcaacccgatcccctttattgcaacttttgaggtgaagtcttgctaatagcccaggatggcctggtactgtagtgggtaaagtaataccctgtctcaaaaataaataaggaacaagaacaaaataataacaaaaactaaacattgatagttttttctctcttgcgtgttgatcttgatgatacttaatgactgccaaaatcacaaagttctctattctaattttttcagaaactgactcaagtttatagaactctccatggcgcttacacaaaaattttggaggttatgcacaccaaaaaacgacttttaggtactttctttagagttgccttttatggccaggtaagtgtactttagcaaagtatatcaagttgtttgacttttaaaatattttcctttgacttactagatggcctttgtgtagtttcttgtagaagtctttcttgctgtgtacacagcacgggactcattttgtaatgttccagttcactttgcttcacttgtctacttaggtcagggatgcaaagtatgaacttctcattactaacattcatgaaaaaaatacattttagtttcctccttctaccaagaatatgtttatatacttatgaatttgagtacacacaggaaaatattacatgggaataattaatacaataaataaaaaataaaagtattttcatataacatcacccccttccagacaataatgtttgtatgcttgtgcctttgacaattctcaacttattcaaagttagaaagttgactatatgcatgtggtatttaatatattattaatatactaaaattaaaatattaatatggtcttagaatttctatttttatgttaaaacacaattattaaaagcaacttttagaagaagagtctatgtcagcttgtaactctcaagtcatactccattactgaaggaagtcagagcaggaactcaagcagggcaggaacctagaggcaggagctggtgcagaggccacgaaggggtgctgctttcctgtagaacccagggcaacctgcccaaggggtgatcccacccactgtgggcttggtcctcctatatcaatcatctatcaaaacatgccctacagccttatctgataaggtattttctcagttgaggttccaacttcccaaattactctaggttatatcaagatgtcataaactaggcaacataaatatattaaaactgatattaataagtattattttaagtatattcaaatatgttgtcactagtcatgcggattctccttgaatgtttgttcacacagtatcatttgtttacctttacaatagtctttttttgaagaagaagatggaaaggagtatatctataaggaacccaagctcactggcctttcagagatttccttgagacttgtgaaactttacggggagaaatttggtactgaaaatgtcaaaataattcaggattcagacaaggtaacttgtgccatgcatttgaaagcactgttcatttctcacaggcctagtacattgctcctgatttgtgagagggaagctgtccctaactccctgggactaagattacagatgtgcactgcccaaagggtcacattcgaggcccttctgcctacactggcaaggcattactgaagcgcctgatcccccaatgtttttttttggggggggggctggtctcaaattcacaatagttccccctgcaatttttcctggttttgtgattacagtatggactggatctgagtttctaatgaagtcagtttacagagagatagtttgggtctcaccctaaatattatctatcctgttagaccctatcataacaaggtgtaaaagatctaacaagagagactgttttgtgggaaatgcactaatccttctagatagccattgggaaataacagccagaatgtttgagtcctcacagtacccagaatgagagctcacttcctaggtagaaaggacttccgcagtgcagagtttgtgcctacatttatccagtaactttcaacaaagcaccaaaagtcaactcgacaacagttgacaaagaaaaatctcacctctttatttcctagaaacgcctgtatctcttgtgagttttataatctttaacgtaggcttaagagctttcaaagtagatgtcatgattagttccagatcagtatttggcaatacctctctataagtttcaccggttttgttttgattcattgaattaagacagtagaaaattccctgtccttgcaaccagaatctcagctcatttccatgctgttgactgctgtagaaatgaataggtgatggttagtgagactctctggacaacatgtgtctttctccttcattctgctttgaaaacctagctccaaatgctgctgaaaaaccactgtgaggcaaccagacttctgatgttattctatacttctcataggtgacatacaagaagctatttctatccatataaaatacaatcgtcccccctcataactgtggcttctacagccacagagtcagccaaccatggatccaaattattcagaaaacactgcatctgtacccaagagtttcagactttttgttgttattttgttttccttggttttgagacaagctcttattttgttgcccagactactctagaattccctatgtcacccagtgttgtgtgtcagtattcccaggaagacatgagcaagcctctactcattccagatagaaaaccaatggcagatcaaagtaagggtgccacaaagtgcaatttattgaaccgtaaggttttttcaggttttttttaatgggaacaagataagaagttatttagtaaaatagaaatgactcaaagacggctgtatcaaccaaaagcccaacctctgtatcaaccaaaagcccaacctagcataaaggacagctcacaaaaagcagacagcttccacagattagaaagtatcttttccaggcaactaatatgggctgagcttcttcctgacaactcagctcgactgtgaacgtatctcagtagtccttatttatgcttagaaaaggagagatagagtgaatgtggtcagtttcagggaccccatgaggctactgagtattttacttctttaactgaccttccctgcaagatggaatattttatatctaagaacattgtgtctcttgaggagtttccttgaagaatgcagtgtttcacctccctttagaatatcctgtatcttggagaccaagatggagggctttgtttaaccttgtaggaaattgttacacaacactcaccctagccaaattttttttccccctgaaacatttttttaacaggatctgacttaggcaggactgaaatgcaggacctgcctctgccttcagagtgctgaaattataggcatacattaccatacctgcaagatgttttctttgtaactgttccctaagtaagagagtatagcaagcaattgcgtaacgtttatgttgtagtatgatcacaagtcatcccgagatggttttaaagctgcagaagcataatttttaggttctctgcagcaatcttgccactctttatagggaagttgatttttaatatgtaacagtagaattaaaggcattcgtgtatgtgcttgtgaggtgggaggggggtcgggggggggggaatctggggacctgagctaatatgccaagcaaaccaaaaccaaaaccaaaagaaaccactctttgtttgccaaagaacaaaatctgcttaaagtcacaggcaatttgaatagaagtttagtggtgtcttccaggatcttaaatgtatgtgtcctttggcccaacatttaaatcaatacaaacttatctccatatataaatggggctagaatcttcactgaaggagtctttcctgctatttatatataaacggtgtactatttaatatgtgcatgtataaatattttaggatttgacatcccacttgaactttttattttctatttatgttttcatcttagccaaataattgctttgactgaggtctttttctaaaactccagcttttaaacgtgagagaattatttctgggacttttggctaaaataagtataatcagaaagaaaggttaatgtttccagagcaacctaagtaaataggaggaatttaaagaggttaacagtgttaagaaatttactgtcccctgtctttatgcctacatatatggaggataaaatcatacagagactgtttaggggggtggatttttgttggctttctttctttccttccttctttccttccttccttccttccttccttccttccttccttccttcctttcttccttctttccttccttttctttcactagatagaccgatgtgactgataaataaccaagctagtaaacaagtcacccagaaaactaggcagattttgttgagaagacactgaaagcaaatcccgaattttctctggagttaaggagaaatgctagagagttcgagaatccacaagtgaaccttcagcaaggacatcagcagcaattcttggcatgaaagtttgatgactcataaaatgaccagcaaccatcactagacttttgggttatcttgctgctgctgctgctgctgcctttgtcactgggaattgaactaagtaccttgcacatgctagaccagcactccaccttatatgtcttcaacatagaatcactgttttttcttttgatccctttcctctgctggctaggattaaactgatgtaggtaagaacaactactcttgaaggctgaagagatgactccatggttagggcacttgcttctcttgtggaggatctaggctcagttcccagcacacacatactggttcactgtcacatttaacttcagatccagtgattttgttgttcacttctggccttggcaagaactacaagcatttgttattttacaagtttatacaaacatgtccttgtgaacatacccacatgtagacaaactctaatacacataaaatacaatataaaaataataaaatctttcaaaaatatccactcgtatcagacactacttgtggatagccaaattgatatactactttattgcataattaggtggtatattaaaatacttaaagctatataaatctttgaactaaataattattttctaaaaatgtatcctaaggcaaacaatcagaacaacaaaaatccctacaccatttaaattcaaagatgttcaccaaaaaatgattttccatagcaaaatgtaaaaaaaaaatgaccaatataattcatgtgtattcattcagccattaatgtcatattaagccacttgtggttcacacctctaatcctaacactgaagtggccaaaccaggaagacaactgcaagtttaacattattgatggttacctagagaattccaaggtcgcctgagataagtgtggaaccccgtctcaaataatataaataaatagtgttaacactattgtcaatactccagtagaaactatagtagtttcagcatgtttttattgaggtagacttcacatattgtacaactattttaataaatatttaaagaataagattataaaactgttcaatgtgaatctcaattttgagaacatatatgcatacaaacaattggaaagaaatatgtgaaatgtagaaaacgctaattgctgaggactaagattgcagtggtgttctctgttcctcctatatttctgtagtctctataggtttctgtaccttccttataataaaagataaattatctgtaaaacacaactataatctctcccagtaagtgtacaatagatcaggagcatagttgtaatgccatgtttcttgtgtggcctcaaagcggtaagctatactatcattttcttttcattgattaaaaaaaaaaatctccttataggtaaatgccaaagagcttgatccaaaattcgctcatatacaagtcacttatgtgaagccgtattttgatgacaaagaactcacagaaagaaagacggagtttgaaagaaatcataatatcaacagatttgtttttgaggccccatatacattatcaggcaagaaacaaggttgcattgaagaacagtgcaagcgtcgtactatcttgaccagtgagtaggaatcaatatgttactttcatatctgtcttggtcccttctcatatacacaagtaccagctggccagcaggaccatgtgtctgaaatgtgaatcatttgttattttacaagtttatacaaacatgtccttgtaataaaccatcgttttcccatatgttactcctaattgcttagaggtgtctcataaagataattttatcctttcatcctgaagcaggaggaactagttggcacccttaggattttttctaagaaaagcatgggaaggcataaaacaagttgattctgggttttcctagaattctactgaataaattattttctaaaattggttttgtgctgcctcatccaaccttggtatgacgaggtcctggtctaattgtagctcattgggccttgtctggtccgggaagtctgctcttttctgaagagaaacggagggggaggagcagtgaatttgggggagaagggaggtggttgagaggagtgaatggagggaagtatatgagagaagataaatacaaagaattctactcattgctacgttaaaaaatggtctttgtatttcatagcttcaaactcatttccatatgtaaaaaagaggatacctataaactgtgaacagcaggtgaatttaaaaccaattgatgttgctactgatgaaatcaaagataaaactgcagagctacacaagctctgctcctctgttgacgtggacatgattcagcttcagctaaagttgcagggctgtgtctctgtgcaggtatgttggttggttgcgcaacaagctcaaaaggctgttgatgtttcttttgcttttatgagggcgcagagcaagcattaactactattgtatgttatattcttattgagagcaaaaaaaatcaatattcttttttaacataagaaataaatcacatttaatttatacgaattttgtattatatcagaagacattacaataaacttctaaggctggccatgacctgtattattacatcagaaatcattaactattttattggagtatcattttgccagattaatccccttagttaatgtttttcacacaaacttctcatgagaaaaaaaatagatctctaggctgcgggtttcttaggtattttattgtgtatctgctatcctctcagcccttgggggttttaatgaaaagggaaatgcaaacgctccttttgattacatgcttgccacactatcatttctttctcatgtgtaatttaggtcaatgctggtccattagcatatgcgagggctttcttaaatgaaagtcaagctaacaagtatccacctaaaaaagtgaatgagttgaaggacatgtttaggtaagtgttcgtcttcagatcatacctctattcttttcttctattttctgttaaaaaaaaaaaagagagaaatcaaaatattcactaagtaagggtattgtctgcatttgcagtgattatttgatctccaaattgctctttaagtaagtagtcaggaaccatatgatcggtttcatactctgaggcactaacactgctcctgtgacccaagggattaaatataccagcttactctattgctttggatattttaaatgacacaaacacaaggctatattcattacacgatttccttcattgcccggttgaccttgcagtctagcatttcagaccatgtaggaaggggtgcagtggggctacaaaggttgtacaggctttcttctagtccttgtgttgttatttccacttggactctgcagctctggagaatgcctttccttgtctgcagtgagtagctctgtaagctaaggcatcactgaatggtcaggaaaaagaaaagtctgactcatacataaatagaaatcaattacaaggcatgactaatagaataaaatagactaaggagatagatagtgacctataagctcgtttgctcctgactttaatcatttactttttctgtctgcgagtcatcatctagtccaggttgcagagtaacctgtacacattcatttaccaatatttattaatagtgtctgcctggcaggtacaaagaactctactagttgctatgatgggaatacaaaatatgtaggcaatgaggtactttgccactgtgtgtatccactcttcattgtgggcattaaacgcacaaaaaataagtgaagaaaattaacttaaacatatgaaataatgggagaaaagacttttatggcagttcctctactttgtccctagtcctaccaggccaaatactttacacacaatgctaatagccaaatagtaagcccccaaataaattgtgtttgaatgagtgacattaaatgactccattaagtttcctagggggcatatgatttgagctaggtattaaattatttttgttttgtattgagacaggatctcactatataatcttgactagcccagaacaggctatgcagaccaggttgtcctcaaattcacagagacccacctgtttctacctcctgagtgttggtattaaaggcaggcaccaggcactgagccaggttttaaaacagaccagaaaccagaagagaaagataaaaaaagaaaggttatttgaatgtatttcaaactaaggaagtgaccataaccaatagtaggggaaaaaaaaaacagaaaattccaatctttctttaagaaagtcattgtcaaagtaaattgtcaaacttatggatggtgctactttgtaagtaacttttcttcttctttgtatcttcatgttcttccacagaaaattcatacaagcatgcagcattgcacttgaactaaatgagcggctaattaaagaggatcaaattgagtaccatgaagggctaaagtcaaatttcagagacatggtaaaagaactgtctgacattatccatgagcaggcaagtgttaacatccttaaaagtaaggaccgactgcggtccctaaagtactacttaacaaaatatattggtttgaaatgtattgctctaaaatcatttcgtttatatttaattttcattagattgtaatttattttctttgtatgaatggatacatgtgtgggtgagtaggtggctatgtgttgtatatgtgctacagtgggcatgtgacacgacacctatactgtcctgtgtgtatgagtagagataaaaagaaaacatgcagaagtcagtttttccttccattgtgtgggttcctggaattgaactcaggttgttaggcttgactgcaaacatttttacctgctgagtcatttcactggcccattagcttatattttaaattgtgttcatctgatatcttcaaccatttaagttatgtactatgaatgaaacttgaggcagttacctaaaactgctgctgaagcaatgatctagaagagactaatttattctttatgctatgacatcaaagacaactagctaagcaagtctaatttgatctaatgattaacaagagtctctcggggagaatcccaaagaggtgaaaagattaacttagtagctacgttcctagataatgttaagaagctagatactgacagtagggtgtgtggtggatgcctttagtcccagcactcaggaagcagaggtaggaggatctttgtgagtttcaggccagcctgggctacacaagtccaggacatccaggctggttatagtgggaaaccctatcttgaaaaaacaaaataaataaacaaacaaagaatattaaaaaaaaaaaagaagttagatactggcactaggaaaatggctcagtgagcaatgtgcctgttgcacaaacatgaggaggatctgaattcagatacacagcccctacctgtaaccccagtgcttggagtggaatggagactggaggattcctggagctcattagtcagccagcctagccaaatccacgagttcaataagactgtctccagaaacaaagtagagcccaatagaagacacccattgtcatccttctggtatgcacccacatgaacccatgcacacacccatataaacaaatacatatattacatataagcaaataccattacagcttttttaacaaggcagtgtgatataggtgacaggctgaatcactgagtgttagtatcaactacagctaccttaggaaaacagcctgaaaaaaaaaataaatgtcaacacctgatcctagcttataggcaaattctgtgaccattaagtaattaccacttttacatagccactgatccttatagaaatcctgatcatgttcctagactatctcttgaggccctagaatttgtgtttacatatactttgcatatggattgccctgttaaccatttaaatctttttatcatgtttgtaaaagttgtggcataatgatctgctgtctcactgggggtatttgagcttatcataacaccttcttcctttccctgtgaatgaaaacatggaataaataatactttttctctctgaacaaggttacatgtagcccagactggccttaaactaaagctagttttgaattcctaatcttcgtgcctgcctctaccttccaagtgctggaattataggcatgatccaccatgctaagctccagagaacagaattggaaagctcattcttacagtctagcatggtgttacatctgtaattccagtgcttagtacactgaagtatgaggttagtgagttcaaggccaacgtggattacatatggactacatgctatatagcttgggctatataagcaagacaccatcccagggaaggaaaaaactcacaaactattcccagaaaaggagttcatttgtcttagaatctgggttttagtgattgaaggcagttgttccatgtgggagactctcacacagaagtttatcttacagtgtggcccagtgaacggtagaaagacttgtcagacaacaaaagctagctagctttcggttaaccctcctaggtctttgcatttctttggtatgctttaccttaaagagctatgggagatttcatcactgggtgtgactttgggttcacttttctaatcattgtcatctgctcactatggagaaccagggtggaccagaattaagtggttagtgaggtcaagtccagtctcttacatacccattctttttgtttgtttgtttgttgtttcttataaagggaaaatatttcattggggctggcttacaacttcaaaggtttggttcattgttgtcatcatgtttgtgtgatactgtcttagtgggacagagcttttgcttgtgtgtcagaatctacacatacatggggtcacgaattgttcatccaaagtcctgactttttgcaaagccttcccaagaaatagacaaaggatttgtgctacagggtatctaatttgaacccgaagctccccaattcagcaagactagctggccagtgaggcctagggatcctcctatccctaactcctcaatgctagggtaccaccatgccgagctttttctgtgagtactggggatctgaacttaggtcctcatgcttgagcaaatccttccagtcctcagaactcatgctattaagacaacctttgatatagaaagaggatgggaaaccaaaggtattcagcagacgttcagggcaaaaatttcctttatcaagttctgtagctggaaccttgaagacttgaggggctttcagtgttctttgtcttctttttgccacctttactagcctattaggtctgaatgtaaatagcaagacatttgttgatgctaggcagggacttttctgcttccatcactgcatctcgacctcaccccttagcacaacagcaaaagcaccatcactctcctgaggcatgtcctattagtaaatggtgtacatagcttgtttctttgaagccgtctgcttgatgaatctcatttctcataatacatgggggaaaacagtaacaatgactctttcacagaagataaaaaacaattgcacatgctgttttgagcccgtgtatactgtctgacagttacttcatttgcatgcagctgcattgcctagtcttgaattctaaagtattcaaattcaaggcaaattattcagtttattaccactatatgatcaagatatttagaatggtcattttgtcaggtttttccactaaaagcatgaatttttcaaatcaggtggctacttcccacctgcttatatcaattactttgttaaactattggtatttttcttagctgaagaccaatattttaggcccttgatatgagctaacattagctaaccaagaaaactttttgtttctatgtgttgcatgtttatgtaaaccattaactttatagtgaattttataaatgaattaatatattccataagatattagagtaaaagaacataaaaacagccatatctgttgaaattgatcatgctaccacaaaatagacaaagtgtatttgagtatatactgaaataagaactgttctattgagcccagtacttgatttcttcaaaaaagaaattgccttaatatttcttggcagttttcaatatattttttatagtacaccaaagtgtaaaataagtttttatacctattatttggtaaaagttaaagtaagtatactttaacttttgttttccttaattttgtgaccataaaacttttttaaagaataatttaagattattaattgtagatttcttatttaggtggagttggtggtagccactgtaggatctggtaggtttttcaacacagcctcaatggacaccccatttgtttgtcacatctgacagacatgaataattgattcgtcatcagttaaatctgtagcatgcttttagattagtgtcatgagttaagatttttgtaagatcaaattcctctaagatctttttaagcctattatttataacaacacaaatgataggacacagtactgtcatttgtaggccaaggcttaatactaaaccttcaaagccaacttgaaaacctaatgtcctagtttgcatactgttactatgtctgactaaaagcaacacggggcacaaagggattatttggcccacacatacctctcacagtccattatgtagggaattcaggagaggaatcatgagctgcttactgatgcgttccccatggcttgctcagcctactttaatatatactaggttcacttgcacaggctggtactgtccacagtgggctggatcctccttctacatcaatcattaaaggccagtctgatgaggacattttctcagttgagtttccctcttcttagatgactgtagcttgtattcagttaaaaagaacaaaagaacacacatgatatgcactcactgataagtagatattagcccagaagctcagaatccttcttagaagggggaacaaaatacccatggaaggagttatagagacaaagtttggagctaagacagaaggaaagaccatccagagactgccccaccgggggatctatcccataaacaaccaccaaacccagacactattgcagatgccaacaagattttgctgacaggaccctgttattgctgtcgcctgtgaagctatgccagtgcctggcaaatacagaagtggatgctcacagtcatctattggatggaacacagggtccccaatggaggagctagagaaaggacccaaggagctgaaggggtctgcaaccctataggagaaacaacaatatgaactaagcagtaccccccagagctcatgtctctagctgcatatgtagcagaggatggcctagttcaccatcaatgggaggagaggcccttggtcttgtgaagattctatgccccagtataggggaatgccagggccaggaagtgggagtggatgggttgtggagcagggggaaaggggagggtataggggattttcagagaggaaactaggaaaggggatagcatttgaaatgtaaatgaagaaagcatctattaaaaaataaaaaaattaaatgtattttatacatcaaacataaaaaaaatgaacaaaaaagaaacagcccacccaatatattttagatttgtttccatttgtgtgtatatgtatgcatgtatctgttatgtggtggagggagggatgtgtgtgtgtgtgtgtgtgtgtgtgtgtgtctgcctcatgtatacagtgtggaggcaaggaaaaaagggtgtcagatcctgtggaactggagttagaagcaatgtgagcctcccaatgagagtactggtcaggtcctttgaaaaagcaggaagtgctcttaaccactgagcatctttccagctttgaaaactcaatattagaaagccaaatcaaacccaaaaaaaaaaaaggcttaagacctgaactaagactcaaagagagggaatataatatgtatactattcttttcctttgtctatttcatttaagcgtaaaacctttgttgctttggcttttgaccaccttaactggctaatttttaaaatatgcataccaacatgaatgtataccttcatatacatgttgaaatataatattcacattttgtatttcatttgtttatatagattagtttgtataatcatatttcaaataggcacttttgattcctaccttcatttagtattattccaagtctgcagggaaggagcactggaaaagtgcctgagtgattctgagaataactctgttagaaggtacatggatgatccattactcttatcaaagcttttgtggtgacaagttaaaagagaattcaaagatcagatcctgtctcttttaattgaattttgcatttcctgaccttttgtttttcctaatgagtaaccagatcttttctgcttttttgatacgctgcctttgtaactcagctgtgaagactaaagccggtaatgttattctttgctctttctgcttttcgtcattttaaatagcccagtgtcagtgataaattcaaatatgcctgtaattttatatacacagtcccctttttggcactaatagtttcagttggtgataattgtgtgggttttgcttttgttctttgtttcagatactacaagaagacacaatgcattctccctggatgaacaacacattacatgtattttgtgcaattagtggtacatcaagtaacagaggttatggttccccaagatacgcggaagtatgaagagatttggaaggaaatggcaatgagactgacctttctcaggaatatttggagctgtgcaactgttagcatttagagatttgatatgtgtggagtgttgcctcctgacaccaaaatcgtcatgctttcatacagggtgcttgtatctgtaaatatttaagcaactcgaaagtgcctgaaaaattgcagcactgtgcttgctttgtactttttttaggtaaatctatatgctgaaaagtagagctcaaaaccattcgttcaatttgcttagttaccacttactaataatgagaatatgtaaaattgtataatggaacccaataaaaggtaacaaacttatttgt

SEQ ID NO: 390 - DNA, 95175 bp, mus musculus
cttaggccactcaggtcggggcccttggtgagagggagcagccgccgccgcccggcaggacccagagcctgcaaaagctagagcaaaaaggagggaaagagggaggagcggcgcgcgggaggaggagccgcgggagctgggcgcggggcggcgagctgagatgtggccggcccgtcggcgtgtaaacacaggcagcagcagcagcagcggccgcccgggcccggggcactgagcgctcccgccgagacctgcccgccacctctgccatggccgaagtgcgcaaattcaccaagcggctgagcaagccaggcacggcagccgagctccgccagagcgtgtcggaggccgtgcggggctccgtggtgctggtgagtggtcgagcgacggggagtcccgggggggggggggttcgctcacaccgggagcagcgcggtggcttcccgcgcgcgcgctggagaccacgggcaggatgggcgcagctgcggtcgagcgctaggagctctctttttcctctgttctacttaagttttcgctctggcaaccggctgcctgggggtgggagtctcaggcgccacgggacagcgctctggctaccccaccagcttgcgctgggctggaagctgaatggcacagcgggtttcacagagctgcggccggagagtgggtctccaccccagcgggggcggctgaaagcttcagatcgcacctcccgctcccccggacccccgcacaaagagctggagattagggcacgaggagatccggatccctttaagagggcacctggggcagcctaggcggaaggatgcgatgagcacagatatacttgagtgcggatacacatcgggtacacgcgcgcacacacacacactcacttacacacacaaaaaaccccacccaaaagcccagggcgcccaagctctggcgggcgatgtggacagaggaagcatagcgacttcctcctgctactggggagagggagggtggtgatgggtgttgaggggtactgccaactaagacagagggagaggattggaaacaacgggggtgggtctgcgcctgagtgggttttgagtctgtatcctctgggagaggatggttcttaagacttgtgagcgattggaggcaagaggatgtgggaaggactggatgttgctgtgtaaggatgaagaccctagaaccagacgcctacgtagactattggggatgtcttggcggcgggtagagctgggggatggggattggagagtgttctgacacccccctcggggaaccacccctcccccgcacgccagcgcaccctcatcagtcctgttcagatggtctaaatctggagggaagccttggatggtaaggggcacttgctcctttgcttttaaaggctcccattgccaattttttggactagggaccaaaccttaaataagcagtgggactaaatcattagcgtgcttttttgttactttgttttgcaggagatttgctggcttttgtctctttccactcctatattatttcatgtcattcgctgtgtttaaatctccgcacttaagagagagctttttgttagcacaacttatcctgggaagggaacctcgcagcttttccctgtaatttttatgttgatcttgtagaatcggcaataaaaccaacattaaagcaaggcaaggggcctgatcctaacagtggggaaagttgacattagtgggaattctggaagaggatcaaaggtaaaatatgtacctttgagataaaaatcggatttctaatagctgcaactgtgcagagccaagggactttaaagaaatgtctttatcatggctggacccttgaagtttaatcctgctgcttggtgaggctaaacccagacctttaatgttgtcttaatggatttggcttattgtatatttcacccagatttggagccagaacctgttgaggtcagatcagaacctcacttgtcatcagggccatttgagagaggaccacaagctgtgtgcaaggcattttataccaggttgtcatcttcagtggttattagcaagtgatccagacagcctagcacaaggatggcttttctaaaatcataaagcaaaccttctctgaggagtggctggccacctaccatagcatgtgaagagagagggaagatggacagatggtatcaagaaaatatatgaggcacagacaacctctgctgggatttgaccagcatttgacctgcctccctcaacagtaaaaagttattattctttctgaagttttaggctttgaaaagatcagttttgagacatggtctcactctgtagcccaggctagaactttggttttgtacttggtgttagtcctcctgcttcagcttactggatgctaggactacagacatgtgccacctataatttttgtgcagcacaggtgcagtggcttctttctacctcttcattcttggcagtgctggaaaaaaaaaatctattaatagagaaagactcttggagctacagcccgtggccggggtttcctggttagctgaccttacttaggttctttttttttttttttttttttttttttttttagcttttatgcaagggaatgtagaggagtgaaatctactcatttctgtggtatgtgatgtgtattaagacttgaggggagggcgagttgaatgagaagtttcttgtgctctaaatcaatccattgagcccttacactgtgtaagacatgatgttaggtgctttaggaccttttattcatttatttagttccaatctaaggggtgtgtgtgtgtgtgtgtgtgtgtgtgtgagagagagagagagagagagagagagaaactaatcgatatcagggtcttcaataatgctatttgtcaattaagagataaataactctaaacagtatattcactctcatatattactttccctcctgtttgttgttgttgttgtttggttggttggttgttgttgtttacttcataggcctgttaaccagaggtaggaaagcagggggtgactggagagcaaaacaaccacgctgcagctgctgtcagcttctggttcagttctgatgtaagccccaagtgtttattgagggacagctgaggtgggatttacacttgctgccataaacccaagatagtattagagtttcagcataagttggagtcattagcacagcagggcacacttttcttcccatgtaattcttgacagaacttggaaaccctaccaagctgaacaaatatacactatttccggtttagttttttttttcttttttacagttacacccttattggcatgcccataacgtcattcagttttgctcactgttcaaaaaaatgcacaaggcttgggccctggctatatatagcatgtcattattagtatttccatgaatctattaactatgtaatgaaacgagcagagaaagagaggctgcttcacggctgcatgttctagtgagttcagcatttttatgaagatcagttttaaaccagggaaaggaataattatcaaatcgccattgactaggataccttaagagagccttgggaagtggcaagataagccaccagtgagcacagaggctaatggaaaatgttcacatacatgcatttttaaagtgcagagttatgtggtttttgttatacttcaggttatagttcttggtgcctggtgcggatcaaaaacatgtgagaaacctgctgtatctcctagtaggggtttaagtagtgcttgctacgtatgatcaccaaaaagttgttagatattattacttgaggcaaggtaatttggatacgtcctttggctggtgtcaagggatttcaaattagagtagctagctctctagaattgagaaaggctgacaagggtcagcagctgttcacttcctccatccgccattcacaactcctttgagcagagtggctgtcttgcttgcctttaggcgagagctggaaaactcagcagctagcttctgttccttcttcccaggggggttgtggaaagtacttaatgtaggacaaaatctacagcttcatttggaaggacgtgacatttccactgtggaataaagtgagattcaacttggactttcccctctctgatgttggggacagaactcatggctctgaagtgtgctagatgttaatctactacttagccacactcttagcaacttggctgtgcttgtttacttacttgactcataatgttcctaactcagcctcctgaatgctaggggcttacaggtatgtacctccatacctggcttcaattttggcttcttgagcatgcctttccagttcaaagatttagttgggttcttattgagctgagagtgagatagttagccacagccttggcacctgaacataagaatcccttattattccttttggtagcttctcttgttagaaggctttggggtgacacactcctctaaagtttgtccaaaggaccaactcagttttttaggaaaccaaagaccatttcactgagccttcactgaagcagcaaatagaatctttatactctctttttggtgcaagtgtgtgtgtgtgtgtgtgtgtgtacacatgcagaaatcagagaacactggtgtcctgttctgtcacttgacaactaattcccttgaatcaaggcctctcagtcaccagaactagccattctttggctagactgatctatcttcttgtctctggacccatttccactatgcccacagccacacctagcttttaaacgaggtgttggggacataaatttaaatactcatactggaacagcaagtattcttatacacttttctttcttcccagtcctagaatttgttttctaagtttagcatgttaaggccatcctccagattgagactttccatattctgattaccagtgatctttctttaaacatttattgctttgccacttaaaaatacttattcattaaagaaatcttagaagagaaaaaatgaaagtgtcactatgtcagaaggaactcaatattctaatgtatgtattttgacttttatatataaatatttaaatgtttttatattgtggtcatgcaaaacctctagccagcccttaagtaacttttctcttatctatatctcatttatatttgctcatagtagccaacctactcttgcataagcatatttaatagaattgtcaacaatcttattaggagtttttatagataaagcatccttcattggtttattctttatagtttttagatatattttgtgtgtgtgtgtgtgtgtgtgtgtgtgtgtgtgtgtgtgtgtgtgcatgcatgtattgtttgtgtgtatacgtgcccatgtgtgcatctaggcattttcatcacagtgcctatgtggaggtcagaggacacttttcaggagttgcttctctgctgctttgttaaggcggggcctctcttggttttggtgagctgtatactccaggctagttggcccagaagctcctaggcaattctcttgtctcaacctcacatctctcagcgggagggggcctggaaggacaggcccctacacctgaaggacaggcccctacacctggctttttatgtgtgttccagggactaaactcaggtcatcaggcttgctttgctagcccttttacctgagctgtctccctggcccagtagtttctagtttcatgctgctgtaaacaggagttgtgtagtgtcatggatacgtagattttcactttattttgtatattgacatagtgtctttctctgtagccaaagctgactttgaatttgtaatccttgtgcctcagcctcctggaatctcaggcattcctattgtgcctgacactttaaaggaattaaaatcacttcctaaattgcccttgccttacttcagcttcttagtagccatatgtggttggtgactagcttattagatgctgctgaaatactccattccaccattgcagttctgttaacactgagtcaaacagctttgagagggtgttttcagatttgctagagtttgcccgtagaataaatttttggctatggaattccctgttcaaagcccatatgcatttttaggattgaaaatgtctcttaggggtagagatgtaactcattatgccaggccttgagctccatcttcagcaccacaaacaattccctattaaaaatccaagccaaaccaaaccaaaccaattctgttaaattgttctgcagaaagttgttccaatgtactccaccaatagagcacgagagcatacatttctcctctcctgtcctgacactggttaagagtcttcatctttgtaatctggtaaattataaagagtacaacgatgttgtaatgcatatttctttgattattgttgaaattgaataatgtttcctttgttgatggcccatacatataacttaaggactgggatccttgactcagacttgtttccttgttttggattcttggaatactcatctcaacccttcacaattctgtttggctaagtcaagggtggggccacacatccatgttctttaaagtcacccccaggctgatctgggccactcatactccaggcgaaaatatcccctagatacatctgaaaaaggattcgtttagattctccttaaagccctcttcaggttaggaggctctgttgggaaacttgggttgaaatttactatgctaagttctgtgctgatctgcaacaaaccctcctgactggaaccacatggaatgcttgcttcctctttcatctgacaacccttgaaacatgtggagatcaccaccaggccatttaaattttcattcttcaccaggtcagagagcctttgtttcattccttcattttacacatgacttggttttaagagtctccacaccatgatcattgtgtttgacttgtgttcagtttcctacggaacagaagaggcagagcctgggcctggagtgagccctggtgtgaagtccaacttctgctgctacttgcactgtgaacaaaggcaggtaaccttgtctgtggaatggggacagacataagtagcaccctcgtgaggagtaaagtatgaagactggtggacaggtagttcgtatagtattaaaatgaaggtccagagagagacagttttcctggtactacattgaccatgctgcagtgcaagaccacagattcaagaacatttgggcaacacgaagtggtcttaattggtttaaaatgcaaaagacacaaagttgagtgtgctgggaagattgtggtggacatgatcagaacaccaaaatacgttgtgagagagagagagagagagagagagagagagagagagagagagagaaaatttgaaaaaaatcagtagagtgttaaacaacagcaatgaaacaaaacacctcagtattattccctagtccttggaggtatgagcacatcatagggtgcctggaatgcagtaggtgcacagtttgcattttgtacatagctgtgggatagtcttacgtcttgggagaagagcctaaaggcaggaatctagtgaaaatatatagtccaggagaatgataacagaggccttaactgaaaaagtgagaatggagataagagccagttccgtgattaaatctaaagcacgtggtgaatgttgaaggggtagtgggaacatggggaagagaaacaacagggaggaagagggaggtggagtcaagctaattttgagtttttacagcttaggtgaatcggaggaaggtgatagagaaaggaggagaaaatgagcatgctctatttgaaagaattgtgagggtcaggccaggtttcaatgagaaccttctaaaaggaggccgggcatgtagggttgtattttggcagatgcctgaggttcttgagggcagagaggaaagtgttccaagtggaatcaggaaagggaggaaggaccaggagaagagcagggctgagctgaactgacaaagataagattgtagggggtgattagctgatggaggaggcttgcaccttttgggggaagattaggaaggaggagtcagggtagggaagaataatctagaggctagccctagactacccattagaatgatagtagaagttatcacacaatagacacacacactcacatactcatatacatactcatgggtgcgggtggggagctcttgctctggcagttggctttagtagatcttgggaatgagaagctagtgagattcctttgggtgcccagaaagaataatataatagtttctacccttaagggactcctgattcagacatgaagatgggatgcacagtaataactgatgtagagaagatggaaaatagatatgagggtataattttgtcttctgtcttcagttggttaatcctgttacccttgtcccagatccctgacactttctgaggtttttttattttattttatatttgtttagactttaatctcttctggccttaacaagactgaataggccttcactaaggaacactgggaatctgtgtgacttttcctatggagttcccctcccccatgttttataggaatggtgagagctagcagtgacatggaatggtgagaaatttgtagtatatgtgtgttgctcacgttgtcattccctttcttgacctctgtggactctaatcagtggttgttaccttccaaaattccacacacacacacacacacacacacacacacacacaagtatggcacaatgtgcttgtgaaggtctcctttcaccatgtaggtgtctgggattgaactcaggtcaggaagctttggtgatttatcttaacctggtgagccatcttactagtcccacccttgctttaaaaaaatctgtggtttttaaatgttttgagaacttcatacttgagcagtgcattaccataactcttacctcctctcactttcgaagtcctccctcccatctcctccaaaattcttgacctcttctttaattattacacacacacacacacacacacacacacacacacacacacacacttgcacaggcatgcacacacggagatgctcaacctactgactccatttagtgttacaactcagttcagaagattaattcacccaactgacgtttttctatttttctcctaagatacagtcattgagaagatgtgttgaaaactgtattttttttttttttttttttttaccactgaaccggaagccgcgggagggagtgggagctcaagcagttcctcctttcttatggtttttgtttgcttctgttttgttttacaatgtacaaaccaaacgaggacttttagaatacatttcttcttgggattgtgatttcctgatttcctatagatttttgccagcaaggcgcaagaattcctggctaacattggtctgccatttgtatcagtctggagccagatgcctttttgattctttgcacagccccaccctagaggcttcctgagcagaaactggagtggggcaagggggcagtctcaccaagctgctgttgcccctaagctcatgcttgctagagcaatgggtaagaaaagccaactgctttcgagcaggatgacaccaggccagtacatcaagaaacacattagaacatatgatccacatgagtgttgtgctaggggagacagattggttggtaaaacgcttcgatgaagacaagtgtggtcttgagctccagaacacatgggagatatgccaggtgtggtggtacacccttgtaatcccagttcagaggaggtggagcccagtggagccctgggctcaatgctcagccagtctagcgtactctgtgagagatagttggttggggtgaggagagagagagagagagagagagagagagagagagagagagagagagagactatgaaactgaaaatgaacctgagaaagcacacagcacacacttgttctctggcctccatttgcatgcgcacgcataccttcctgagtatacctgtgctctcaagtgcatggtaacacacactcactcacacacacacacacacacacacacacacaaatacaaacaatgccttgttgcttctcagtatcattccaaggctttatgtcctttctttgtgttattgggataaaaccccagggcctcacagatgctaaccatgcatgctactactgagctacacccatagtcccagtgtccttttgtattctgccattcaggttttgtaataacaagctagattctgttaagggtggcgtatccagctccccagtcaagtctgtcgggaaacactgctacacgtggtttctctattgttcatgcaaaaccttgcacaatcacacctaaattttgctcttaatgatttcctgtgattctttgccactttatttttattgcctacagagtttatcatccacaggaaggctcttcctgctttcttgacagcttgtgttggactgcctatatttcaagttgctgggaagcattagaaggtgttcagagttttttagttcccccaccccacccccaccccatggtgctttctctaatgacagaggtattttaccaagtgagatacaactggagatactttgccagtgtgctttgatgtccttgagacacaatatctttatttgaagctttttggtgcattgtgatggaaggccagctagtttatttgtgtggaatatttttcagatgatgccaagtccttatatttccataaccccaatttttgtttttgggattttctttatgttactatatgcatatagatatttcatttgcattcatatacatatctcctagaattggagttacagacaattgtgagctgctaggttggtgctggggaatagaacccaggtcctctaaaggagtagccagttcttttaactgcggaaccatctctccactcctgttatagccaggatttgaaggagagttaaaagggctgctaggtctctgatgtcatatggctgtgggtcagtgttaaacatatattacattgctatcactcctatgctataaatggagaaacagaggtgtgggttctagtgaggcaggccataggtcatccatcactttcaaatgataggaccggtaatgaactccagctgtctcttctccttcagagtagacatgtgaaaaaacaacactggtgtgcctcccaggatccacaagtaatcaggggaaggaacttcctgtgtagcttggtgatgtatataggaagccatgtctacttctaaacaagcttggtttctatagtgggaaagtagaagttacggacaagattattattttatgatttgagaactggttactgtcagctggtcttcctttctttactatttgaataaatatacagaaaaagaacatttcagaactttagctctgcagaggtacctaggatcattttcctggaacttcttttaggatttttattttttctttttcaagttggttagttctctccaaaaacaacatttatatttctttccatgccttttatattagtagttaagttttctcaattgaaatttggctgactttctgacttatagggcctcttgtcacagtgctcatgagtacatggaacagtgctgttggcgcagccagtttattttcacaggctaacaagttctgagtgcttcagtgcaccatatggcttcagagagacctgaaggaaggaatatcaccatccacggtgtctacttaccaccaagaaatgactgatgtccaaagagacttggcatcaactcttgcataaactaaacagaatcattatttagtgtgtgtgtgtgggggggctgtggctctcatttgtgtccgtcggagtgtttatggcatgctctattgctccggaagcaaagaatgctctcctttcaaacatgttccacagtgacttgttccttcacttctagtgacttctagtgaacctgactgctcacagagaaaattggtgtctatctgtccctaccaaatagtctgtcagaattcaagacgccactgtaaattacataattggttctggagaaattagggtctggatgtatattagatgacaatattgtaaaattgtaacaatcatgatgtgtttgtatagaatgttcctgtccttcgggacacacactgaagtaaaatgtagtgatgtctatggccaatttttaaatggttcaattgaaaaaaaaatcagtatatgtatatatgtacacgaatagaatgcatgtgtgtgtatttctgtatctatatacagagagcataccactgatgagtctagatgaaatgtaaatggacatttattttcctatttgtgaacattttatatagatttgagttttcatattaaaacattaataaaacaaaaaacaaaaacaaaaacaaaaagagcgccaaagtgatgccaaaaagaattcgataaggctccttgcttcaattttctaataactcactagctttctccttgcctcccaccctctttactttctctacttagagtgcagtcctgctccagtttaggaagcatcaagagcttcttacattcagtgtataaactgttggttgtaccctgtatgcttatatttatttacttgcttatatttattcattcattcattcacttacatcgagatgcagtcttatacagccaggctgtcttcaaacttaacatatataaagattttatattgtatatgatatatttatactttaatataaattctatatattatgtcataaatcacatatcatttcatgttatatgctatatgttatattaaatatttatgatgtatattgttgcctgatgtggtggcacgtgcgtttattcccagtactcatgaggctgagatagatagatctctataagttcaaggccagccttgtctatatagtgagttccaggtcaggtaggactgcacaatgtgaccttgtctgaaaaacaatacaaaaatatgtgtttgtgtctgtgtgtgtgtgtgtgtgtgtgttagatggaaccaatagactcccatacactgagcaggtaatataccatgtattacatttccagctcctatgtccctaatctgatctcttgcctatccatatctgagcccctacttggtttcctggcaggataccagctcctctgcaagtgacttcttgtcatactgttagttctcctgagcagggatgctgtgcctttaccatgactctacagctgctcagcttagcctctattcagctgaacagtatactgagagagggaggggctgcttagcaaactcataggagactgagtgcccaggtaagaaggtctagcaggtagacagcatggaaagttggactagcgagacatatggtgcatcagtttcccactccttacttaacacaaacttagtgtcttcaaaggacacagacttttatttatttacttattttattgaaaatgatttttttcatgcaatatattctgattatggttccctcccccaaatcctttctttttctcttgctcattagaaaacaaataggcataaagtaataataataataataataataatccctaaaataaaagtaaacaaaccagaataataagacaatataactagtaagaaaaaattgccacagaaaaagcacccatgaaacataaagatgcagagacacgttcattcacatacatagaaattctataaaaacaaacaacccaaaatccagtaagcaaaggacctgtaaggttaaaccaacaaacaacacccagacaaattattaggagacaaaaaatcctccaaaaatactcttgagttcattttgtattgggcatctactgtttagtatggtacctacctgtatactccctgtttggaaaaaacggatttttttcctttgcaagtgattgtcaattagagataacttctgggttggggatgctggcttgtatccactccctgtctcagtgctgacttcccatctggcttacacctgtgcaggtcctgtgcatgctgccactgtctctgtgagttcacatgtttgtcagtcatgtgtttagaagtagaaagccttgatttcttggtgtcttccatctcctctggctgagcctgaggggagggatttgttggagagatccaagttaggattgagtgtcccagatctttcactctccgtacattgtctggctctaggtctctaattttgttcgaatctactgtagggggaagtgtcctgatggttgctgagcagggcactgatctatgagtatagcagaatgtcattaggaatcattttattgctgcatccctttagcatagtggttctcaaccttcctaatggtgtgaccctttaatacagttcctcatgttgtgttgacctcaaaccataaaattattttcattgctatttcataattgtaattttgttactgttatgaattataatgtaaatatctactttgtaggatatctgaaatgtgacccccatgggggtcaccaaccacaagttaagaactgctgctttaacaggacaatagtatctgcttttcccctggatggatagcctagccagtcccagaaaggacaaagaaagttttggttctagaggttataagtctgacacaggtttcactgggatgaaaccaaggtttggcaaacctatactcccttcaggagctctagaggagaatcctctgtgttgccatcttctccagtttccagagggttcctacattctttggtacctctatctccatcttcaacccagcagtggctggccatgttccacatcatagcatactgcctctgcttctggcctcaatactcaatactcaatactcaatactcaatactcaatactcaatactgcctctgattagcctgcctccttccatctctcaattataagatcccttgttttgttttgttttgttttgttttgtttttgtggtatttgtgattgaaatcatggccctgcacatgttggacaactgctccatcactatgctatgctcccagccacatataagaacttttgtgatgactttggtcccacctgcataatgcagtgtggtcttcccatctcaaaaacaaaacaaaacaaaacaaaacaaaacaaaacaaaagaaccaaaaacctttttaaaaaaaagccttaatttaatcacatttgtgatttcctgtaatgagtaaagtaaattcttagggactgagctgaagccatgtttgggaaaccttttttgtacgtaaaatccatgaagagtggctaaaggtccatgagttggtgggcaggtcccgaggttagatgggttcctgactttataatgaaatagaagaggaacgggatctcccagcattgtagtaaagaagcatggccccttttgaggacttcagcttcaagaaagcaacgcaggcttgtcatctgtgatgttcattcgcttgttttctgaaatgctttataattaattattttccccaacagaggactccgttggtctggatttcttatagagagggtgctgctttcagacttaaggtgtttgaggatacaagttggccagacacatgcaggcacctagccagtccaggcctatggaattttccactctcagctaaggaaaaggggaaaacagtaagtgtatgcaggtgtatgttgtggggcactgtagatagatgtagataaagggaaagggatgatttcacattgccgaagaactctggctcacaagtcccaagatgcctctcacatgtcctttgtaatagatacttcacctaggctgaaggtcaagttagatggggcagcgcccttcagaactttcaaggaaattgcaggaccccttgccaggtaaagtgtccaaaacacacggttgtagaaggcagaggaaaagacagggaactttctgagttcctttttgacgtcatgatgattttaactgagagataaatcgaaacttcctctctccgtagaaggcagtccctgacattttagagagccacaccatcgacacttttctttctggctgcttttgtttcaacctcctcatgctgaccagtataatacccacggtggtctgatggcaaagctccttgcaacactgaagaagcactctatcatagtggactgtgtttgctatttttaagcagttccaattggccgcagctacgcttctccctggcttaacctatccttttacaggtcctcgggtaactgatctggctgtgcattgaaaatccttatgaaaaggtccaggaaaatcacagattttgtttcaaaatctggagctacaaaatgtccagcaactctcttcactttcttctatttcatgttcttttcttttactctccaattgggaaaataatttcctttcttttgctaagctaacttaagataaatcttctgatattttcagttgggttgtattaagtgttctgctgttatatacactaatttttaattatgcaagtttattaactatagtcctgttcgagatttctttagagagacttctaagatggcatttattttctccaagttatgggttcttttccttcatactggcggcctttaatttttagtttgttttcccaatttgctgatctctgctttggggcctcctcctttctgcttgccttccactgagctccatgacttactggtagtgtacactacattgataaatttcgggacagacatgatgccttagatgcctggaatgtcttggcctgttgtagatagcagaagaaagtagaaagtaatgtattgttggagagggtgctaactggtgagaaaggtatgttgtgatgtggttgatagctgctttggctgatgatcaatacagatactttcattcagttgatgctaaaatcccaagggacatgcttttagaactgttgcttgaactgagcagaagcagaggctcattttctgctgatttccttataatggattaagtctatttagagcaaacttgtaagcataagagaaggcaataggatataatctgagagaattgaagggtgtgtgtgtgtgtgtgtgtgtgtgtgtgtgtggttacaatagtcgaaaagaccagaggttaaaatactaacagtattcaaaatcagtgtgggggcagggaggttagcagcctatatttagagaactagagaggaagaaatcaaaagctttaaatcttgtgctaggtaagtagaatggctttgtgagcagacaaatgcctgaagacagtgaaagagtcaagaccccaaatcaagtagctgaggaatttcaaatggaaaaccaactgtccaaatccaattgaggtccccgtttactgaccacctgacaccaacaggtgttttgggaccccagggtagaggggggatttgggtaccagacatgcctaccctgttttcctttcatcctagcttttcttagccctgaatagcaatacctcacacctgttccaaacctgtatttcttgaggcagcaaacccggctggacaggaatggcagcaaatgaagactgcctccgaaccactgtaactctgcaagagcagctcccaccaggtctggcttcctcttactatttcctttcttttctcagcacttttttttctttttctcttttctaacttctactcaacactaactgatctctcctcagagctcctcttgctcggcaggcactctaccactgagttatactcccagccctttctctgcatgcatactccccatgatttctgttcctagtatttatatccctgcactgccacattttaggcaaatccatgaccctagatcctccgtgctccacttcatggcctccctacttcactttccaccatgctaactaacatcccagtgtggacacatgcctactttatttcctttcttccttctctctctgtctctctgtctctgtctctgtctgtctctctctgtgtctctctgtgtctctctctccatcttctctcctttcctaatgctagaatggcaggtgggcaccatcacatccagttcccacttctctctgctcatcttttctccccgagtcttttctcctatttgactacaaagtgctcaccatggggcagagacattactttgtttatttttttaacctttttttaaagccaagggtggaaaattccaaaggcctgagttagtgatggctaggtgccttttctggaaacctagtaactggactgccaagggaatgtcatgggacagcacatctggaaaagccgttccccaaaatgtcctggttttgaatttaggtccatgtgaaagaagaggaggtttttagccttgatgaaatcaatcattacaactgaacatccgagtttacatcactttctttttctgtgctgctgggcttcattgggaaatcatagcctttggctttttaggaccttctagagtccaaccttttgcataagaaacaaatacatctctcacagctcagcttaattgatgatttcactttgttggagtcattgtttggcagaggccagctccatttcagagcaactggagtgggtctcctggggcaggggagcatcctcccagatgttactaggtggagctgagtagatgaaccccaccctcatgtgtcttgcttcgtccctgaagaaataacctgggcagggttttgcttgcatatccctgagggctgtaacaaattaaaggtgactatcttgacaattcgccaaaaagcaatcttcttttttttttttaaaatatttatttatttatttatttattatatgtaagtacactgtagctgtcctgagacactccagaagagagagtcagatctcgttatggatggttgtgagccaccatgtggttgctgggatttgaactcctgaccttcggaagagcagtcgggtgctcttacccgctgagccatctcaccagcccaaaagcaatcttcttgaaatgcatagaaagtagttcatcattctgctgcttctcaggaaggtaaggggaaacaaaatccctaagaccagaaaaatgccaactccatttgcattggtttcataaggaagcacttagaatttcttcaagtcacccagtatataggcttacctttgtcccatcttcccccaccacagcctcacctatagattgaaccccagcctctctgagctatcactgcttccaaaaaagacactatctgttctccccttccagcctttctaaacctccctcttaaactgaaatgaccctccacccttctcttatcaaagggaaacctgtccatcctacagggctcataccaaatggccatcttcaacactaccacttcactgagtagcatattttttgttttgttttgttttgtttttgttttgtttttgttttgttttgtttttttctctctgaaggtatgtagcatccatccaaaaacatgctgtagactaagtggaatgaaacaatacatttattccttcatagttttggaggtcagaggtccaaaaatcagaatgacagggccaccttccatcagaagacttcagaaaggtgtctgttgctttccctaccagctttgttagctcccagcttcctgggtccaaggctggatgactctggtctttgcctctgaaggtctgctacacattatctttgaatcaagacaaattacctctgctcttttcttatattaaagaacacttgaaatagcatttagagcctggccttataaaccacagtgatctcctcatttcaaaatctttaactcaaccacatctctatgtgcctttttgccataatgtcacattagaaggttccaagctttagacaggggtacgtgtttcagaggccattcttcagatcatcttactagtgttaggttttagagtgtattgatttcattctgtctcatcagtgtaaactgttgataactttttcttccattagaatattgatgccttaagggactgcaggagagtagcaaaagctaatgtgcagtaagtagtccatgtgccagaggactcagcatagcacttttagtttgtattaacactggggacttccatgcagtcatttgtaaaagggaaagaataacattgtctttgggacttggcagaactgttaagaccaaaagaaacacaaattcaagtgttcaaaaataaggggtagggacttgagagatggctcggtggttaataatgaatgctacacttgcaaaggatccatgcaggaagacttaaaaccacctgaaactccagctcctggggaatccagtgcctctggtctctgcatatacaccctcacgcgcgcacacacacacacacacacacacacacacacacgctcaaatataataatgaaccttttaaagtaaggggctaggcaaattaacacccatacacaagaaaacaatgcaggcattgacatgacttctcactatatgattcacattaaggaaaagtttcacttattgaactgcatattaagtatcatcctatctctgtagactaatacacatctggtaggtgtaaatttagctatttaactactccccaactttgtttcctcatttgcaatatgggtataatgctggtgtagactacaacaggaatgttgtgacacttaattaaaacagtaaaattcttataactgcatagcacagaagaagtactgaattaatatagacattggatttactgatattctcaaagaaagtgtctgtgggacatttgtgtgtttgtaagcagcatctccctttccctctgcacttgtgtgccattttccttactagcgtgcacatctttgaatgtgtttctttcttcttgtctttgtctagcttctttccactgcactgcccatcccagccttttcaagtaatacactcattatgtataagatggacatgtaaaaatatatttgtatttatattgagttttgaatacttccccataacttaaaaataaagagggataaggtaatagtcagaacataggatgtttagtctagagactaatggttgttctatagtagaggtagtacaggtttgtactcatagaatatttaatatgaagagtaatctctaatatacactgtagactttggttgtcacatcagtttggctttatttctttcttgttgttcttttgttttgtattttcagacagagttcaactaggtagtctaactcttactccttactatgtagaccaggcaggtgttcactttgtggtgatcctcctggctctgccttctgagagctaagataacaggcatgaaccaacactcatggcatgctttctgtttttaaaacctttatttttttacattaatcacagtaatttttaaaagcagaaaagtagatttcaggacaagaactgtacctttgaatgattatgtttatatgacagacacttatatagcactatctgtaatttactatatgtttaatatttttagacagggttttcctatgtacctctctacctaacctggtactggctatgtaacctgatctggcctagaactcctggcaattctcctgtaccaggcttccacatgcaggaattataggcatactctaccatctccaatttactatttatttagttgtacatacatgtgtgtttgtgtgtggtgtgtgtctatgtgtgtgaatgtctgccatgtttgtacatgagagtgttcatggaggctgtaaagagggtgttcgatcctctggagcctacgttacaggcagttgtaagttgctgggcatcggagccaggaaactgaactcagggcctttagaagaccagtaagttctctaaatcactgagccatttccagtcccatttattattattattattattattattattattattattattttcttatgtagctctgtctgttctagaacactatatatagaccagctgtcctcaactcacagacattcacctagctcttgagtgctgggattaaaggcatgtgatatcacatccagcttcaagtattattattaagacaatttcttctacagaccttcagacccttgcccagtgatttgtacatctcaagttctctgttcaatgaagacaattttccgtggtctggaagttacagactttggttcctattccctttcagtcctgcttgctcagttttttcaagctttcatcataatatgctttacttcctttgcctccttcttcccattctgtgtctcaaaagcagagtgtctcaactttcctagtgctgcgaccctttaatacagttcttcatattgtggtggtctccagccataacgttattttcacaaatacttcgtaactgtaattttgctactgtcatgaattgtaatgtaaatatctgtgttttctgacggtcttaggcgacccctgtgaaagacttggtcaacccccaaaggggtcttgacccacaggttaagaactagagtctgcctttcttggcaaatctcactatgtagttcaggctggccttggacttgtgaccctccagtctcagtcttacatttgcagagattacaggttgtgtcagcacatctcattttataatgtgggtttgttgttgttttttttttttttttttttttttcagagagagacaggattttattctgtagcacaggttagccaggcactcatatagaccaggctggcctttaatttgaaatcttcctgtctcttcctttcaggcactcatatctgtgagccaccatatatggtgggggcttaaaattcaaataaaattcattagtagtttacaggcattatggttagaaggacttaaggcagagatttttcttttcttttcttttcttttttttaactaggcttgtgtcttggttcttttatttaaaaactttttttttttgatcttttgacataggattgtcctgtgttagaaattacatgtgactttgcaaagcatgtcaatagagtttatttaaaacaaaaagaataagtgtatgcttaaatgatataatttccctcaaatttaacttcactacagtctgcattgtgcaaacacagctgtaccaaagctggaacagtgattggcagctatctatgtgctatgactctgggctgttcacaaacccattttatggacacactaccacccaggtcacacagggaagagtataagttataatttctaatacataatccctcacattaataataaaattgcttggcttttacctattagctttcattcaaaaccttcaaagtgttcaatccacatttgcttccctaaaattctaccaaatgagtcagcaagagaactaggaaagcaaccttccaaactatcagcaacagaagaaactagttctctgctatgtcctctgacaacaggaaatacagcagaaattcataacagttggtttatcttcagagagataaatataatattttatgtatattttaggaactatttttagagtaagtgtaaagtctgaggcaaagcagaacagcaagcatggagttcacttctcatgcactacacagcctctgttcattagcaccctgcaccaaagtggtgtgttacaacaagaacaacaaaacctacattgagtggtgaagtgtgctgacacaggcctgctgtaatcccacacttggtaggttgagatctgaggatagtgaatttgagggcaatctgggctatacattgagagagcttgtcttaaaaatagatatctatagcagactagagagttggctcagtggttaaaggactgctgtgtaaacatgagggtctgagttcagatcctccacactaagtgaaagccaggcatgtttatgcactggcctgtaacctcaactcgtgggggcagagacaagcagatctttagttcctgtactaggcacagtgagaggtttgtctcaaaatcaaggtggaaatggatagaggaagacagccaaagtcaacctttagtctctacacatgtacacacaattgagtgcacccacaaaaatacatgagtacacatacaggcaccacacacacacacacacactcacaaaaacacaaagttttatgcttactaaatggactcagatgtcagatttatatatttatgcatatatatgtatattaaaagaagccatcaatttgagagggaatgggaggagaagagaggttggaaggaggaaaagaaagatgatgtgctgtaatattaaaagactttaattttaaaaatggctaggtataatcccagcatttgggagactttggcagaaagatgactagttcaaggccatgctatgctacaaatgaatgttaactccaaaaagaacaagaaagaaataaagccaaactgatgtgacaaccaaagtctacagtgtatattagagattactcttcatattaaatattctatgagtacaaacctgtactacctttactatagaacaaccattagtctctagactaaacatcctatgatctgactattaccttatccctctttatttttaagatatggggaagtattcaaaactcaatataaatacaaatatatttttatatatccatcttatatcataatgggtgtattgcttgaaaaggctgggatgggcagtgcagtgtaaagaagctagacaaagacaagaagaaagaaacacattcaaagatgtgcacgctagtaaggaaaatggcacacaaaagcagagggaaaaggagatgctgcttacagaggcaagcgccaccatgatccaagtgtcctaaatgtcagagacaagcctttccaaagctcccacttcagcagtccacctttccattcctgttgtgttgcgattgtttttgaggttctcactacataaccatgccaggaagagaattcactgtgtagactatactggcttcaaactcacagacatcctcctgtacctccttcctgaatgctgggattaaaggctcccatacattcacttttcagttcttgagaattataagaatttttcttctttcttttatttttgagactataatataattacaccactaccccattcttttcctccctctaagtcctcccataagcccccttgttctctttcacatcaatggcctctttttcattaactattgttatatacatatatgtatgtgtatacacagacacacatgtatgctatacgttttattgttattaaataactgattggtgtgctcttccccggggaaggctattcctcccactcttggaattcattagttgtctgtggttctttgtgtagggttgaggccttgttggcatttccctgtccattttatcatgtctattgttgtttttctagttcagttcatgtctaggcagtcatgttgctaaaactttatgggtgtagcttctgacattcctaggagtcataatctcacagcaaactccccagttctttgtctcttacactcgttccaccccatctcccaaaatgtcctttgagctttaggtgtaggaattgttttgtgggtattatcagttgtacaatactgcacaattctgcattttgattggttgtagggtttgtagttatctctgcctcttgcaacacaaaggttccttgatgaggagtaaggactacacttacccgttggtactagtacacatgtttagagggtaggtagggattatgctgatttaggtaagatgtgtttctaggttctcctaaaatgagatttggtgttaaggaaatataatcaattgtcatttgtggtttcttctgagaattaagtaatgtagcccctcctttttttcttttatttctttcattgaaaataaattctcctctcgttcaatatatccgtgccagagtttccccgccctccactcctcccaggtccttccacctctcctctatacaaggttggcattgaatccttatcctcctgccttcaacctcccaagtggtgaaattacaaggtatgcaccaccatacctgactcctaactgcctgccagtcctacgagcacatgatttattccttcattgaaacctgaaagaaatccagggacaagaagacaccatagaaaggatttacattttgcttctaaatataaatgctggaagtcttaaatagtaggaagctcatgtgatatgggtaaaaactaagtggttggagccactatattaatgatgtggctgaaaagagctaggggtgtactggcagccatttgcagattgttcctttgggggattctttctggcagcctcatggatcttgagccctagtgagattgtgtactgggccctgctttcctcttttgtgtatggagcccaacctatcctggaccgcatgcattttggagtgtccttgtgtttccatgcccccatagtgagattctgctagctttgtgtctgcataattgttttctctctcaagaagtcttttgatgcaacttttgtgtgtgactagtgtaaaggaagtaggagtatcagtgtgtcttgcattagggcctgaagtgttattagacacgttctcacgaccggccaggaaagacgcaacaaaccagaatcttctgcggcaaagctttattgcttacatcttcaggagccagagtgcaagagagcaagccaacaaatggcgaaaccccatccctttttaaggagaattatcctccacctaggacgtattactccctgattagctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacagatcccccttttcttttaataagagcaataggccacccatattaatgagagtggagatagaggtcaaatccccagtgtgcaggtaaaggagccgtacacataacctcctcccaggctcatcacccagaggggtcctggtctggtcccgtgttgtttttcctgggggaaggacacttgaacactcaaccttcttgaaagatgacatgtctccctagaataggctcatatgtgccgcagagcctttctactgcagtgcttagccttgcaactctctcgggctgctgaagcacactcactctatcccgtgcaatgagactagcctcatgggaatataagagctgagtggccagcgacctattgcctaagcatagatatatcagggggagcaccatgttctagagctgcaagcgcctgggcaataaccaccttgtctctcctagtttgggccttaagcttacagaccaaccaaagaagcaacactaatccacagcaaagtgtatctccacataatcccacccccatccattctttaaagaaggaaaatgctgaggagatccaattgggtaatcctttgatcagggacaggtccaagcgcttggagttgacctgaatgatggcaagtctcaattcccgaagggtctattcaaattcagccatccaattctgtaacatatactgaaaaagactttttgacaaattagctgccctagtaaatttaacatactgaatggaaataacacacaatcccggaaacttttgttcacatccctgctgagttatttgtcataatacatctagttgtatctggacaagatctatgagttgattaaccagcatgagacctctctgtactgggccaaataagttcatttgctcattaatggctctgaggtcatggagcagtctccactttcctgactttttcttaattacaaaaattggagtattccaaggtgaggtagagggttcaatatggcctaattttaattgttcctctaccagttgaatcacagcttctagtttttcagaggataggtgccattgaggaacccacactgggtcccctgttttccatggtatgggtcgtgctgccccaatggccactaaggaaaaacccagaccctgtctgtcttggtttccattaggtaagataggctctatccttccctgttcttgatgtcctaacccttttccttctttataacccatctttgccatgatattttttgctttagttgaataccctcctgatggggcgttttcattggacaaaataaggcccaaatgctgcataatatcccttccccagaggttaaccgggagtgggagcacataaggtatgaatttcccttgctgtccttcagaggattcccacgtcaaggcaacggagcttatagtgggacatgattgataacctaggccctgtaatgaatgagatgactctgtggtgggccatgctttgggccaccaatgtgtagaaattatacttttatctgctccggtatcaaggatgccttcaaactcttttccgttgatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttggggcttgagcacaggacctgtatttcaggggaatgttgacaatccataactccagggtggactactaagccctgcaaggtgagtgaaccccggccgagaataaggcccatggttcccgggggcaaggatggtataggctccactggcaccggctgaatactcatttgaggcattaataggaaatcggaggcggcacgcaggtccacccttgtgggtcttcctgggtcgcctctctgactgcttcctgggtcctgacaaaccggttcccatatctttgagggccctgggaccgagggcccgatgacccgttttttggcacataagctgattgactatcaggtgggggaaggactctgccctttatatccctcacagagcgacactggtcagctctatgataacccttgccacacttagagcaaagagtgagggtccccccctgtttacctggagctctgcaatctttcttaagatgcccaggcttcctgcagttaaaacatgtcctccgattatttctgcccatggagcggttttgggattgaaggatggcagccgctaaacctgcattgctgagaggtcccccaagctctcgacagaccctgagccagtcttgtaagcctttgttctttcttggggctatggccgctcggcactcctttgtggcttgctcatagattagctgttttatcagaggcgcagcttgctctgactctccaaaaatacgctctgctgcctctgtcattctggccacaaaatctgagaaggattcctgaggtccctggacaacttttgttaattgaccagtggtttcacctgctcgggagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcttgtgcagtttcgtgccaaagcgctctccattccatatatttgcccatactagggagagcggcttttacaaccgtttgccaatcaccaggagtcatagcgtgattcgcaagcctttccacttgtgctatagtgaaattagcactgactccatagttacggaccgactcggcaagctctttaatctgtatatacgctaccggagcgtggacacgcccaccctcggctccttcaaagaccggaaatgcctgttgtattttcctttgttcctcctttggaatgaacgagtctgtgcattgcctctctgtccattgcctctctgcgcagggctgatgcactacgcagggcgggggctcagcatagggtggaggtgcactatgaccttgaagccgactgccaagaggccaagcagcaagctggcctttgccagccgcttttggctttttccttaactgattagctagcactttacctggctggtacccttttttctcataatgagctgcttcttcctcccagtctgtttcttcagaggagaattcttcatctgcttcagaactactaagagctggctccccgagcccatccagcgatgagcacaggctccttttcctagagacctccgctaattgatctttcttcttttccctttttcctctttttcttctaatctctctccaggtattcctacctaaccttaacttttcctcgggttcaagacccgtggaaaggcctgtacgcttattttgtgcaccatgtttcctctttgctcctactctctctccccgctttacttctgatagattgtcctgaatttcctctagaatccgccctgccttaaccacttgataacatgtgaaaaggaacaaaagggcttttaacactagaaaaaattcaaggccaaacattttccactttacttctgatagactgtcttgaatttccttagaaagttcaaggccaggcttacctcgtaaagctatactcactggtactctcgttccccagctgaaaagttctgaattcatacagttgaatccttctcaacagtctgttttacgggaaccttcattaccgtgacccgcagttctggttctggaatgagggatcttccttgcgccagtcccgagttttttctcgtcccggaattcggcaccaattgttattagacgcgttctcacgaccggccaggaaagacgcaacaaaccagaatcttctgcggcaaagctttattgcttacatcttcaggagccagagtgcaagaagcaagagagcaaatggcgaaaccccatccctttttaaggagaattatcctccacctaggacgtattactccctgattagctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacactgaagaaagatgctgtacctctaacacacatgtttttgacagtcgaggataggactgttgaaggtaagcttctccaagactgggtcagactgtctttccttgacctcactgaatgctacttaatggaaaaatatgataagggttcaccctatggaatcgttgcttaatattgcagatgactcattggaattagtgagttagaaaatcatttccagatgtgtagcagaaacttttccaaaaggaacaaatcaactctggaaactgggttagttttctttctttaaatgatcttagagccagagttagtcagttcttctcacttgtggttagtcaacatttatttggggttctccatggtaagatcctattcatctacttttagaatgacaagcacaaaataggtcctgtccccaggctatcccgttatccgatgttgccttctccactcttcaagagtcctgatgtattcataatgatgaatgaccttgagtgacccctactcccttgggcactggccttgttctttatcagtgtgcattcctgtgggaaggcttctttctaggtactttgaaggatggcagaaaaccttagtggcagagtaggagcagaatgtgtaacccagaagtgactgagaacggctgctctggagtctgggttgggaaactactttctatctatagcatatgagaaagttaactttagcatccctgtttctttatttctacaacaggagcaatagtaataatattctgaatgaggtcatcccttggaaactctccacatagtccttctctgagttgcctctgtgtagtttggtgtgaaggaggaaagggagatcttacttgcagatggaggctctccaggaagccatcacagtgttagagttttgcaattccacctttaccatacttaactccagtagggaatccacaggcttctcacattcagtcaatttttagttgagctctgtgaaaagaaatactgtgttgtcatctgcttgcaagcaacagacagattttgtacctcgtccaatagtcagaaggaaagtattcgccagtagcacagcctggagctctagcaaaagccaagtccgttctaataaggtgtttttggtaaatataaacttatgttttctgtcttgctcagttttcatgacatatctagtcttacatatatctggacagtttccacttaatgtgtattctctcaggacatctcaaagacagcagcagcaagtgtacttatgtgctagggtatgggcccccaaatttgtgaacttggaaaacatcataaaaggaaaagatgataaacattactgttccatggatttatggatttttttttttctcattgcttctctctctatttctacctctattctcctaccccctgcagctcaggatggaacccaggacctcacaactgctaggcaaatggtgtatcattgagttttatacaccttctctactggttttaaagctttgaaatgtttagaaatttgtaaaagtgctacaaaagtttgtgtagtggttaagagttcaacaccatggttaagcagccctggcttttttctttttaattctatttattcactttacatcctaatcaccgcctccaagcctggtcaccccctcccacaatttcttccccctccccttctactctgagagggtggaagtccctcccttctgggtatcctccccaccctgaaacatcaagtctctgcagggcagaaaaggcagctcagctagaagaacatatcccacagacagcaacagctttagggataataacccctgctccagttgctgggggatgcacaataagaccaagctccacgtctgccacatatgtgtctgacagccctggctttgaatccctaacaaattactttctattactgtatggcaccttaccataagcccagaagcttaaaataatgcacatttactagttcctgtttctctggagcagtaccatgggcagggcactaggggaggtgcttttctgagtccacagatgttggcagcactgtgtgggtgggggtcctcatctggaggctcggagacattttccaagctagttcagggtgggcataatctggttctttgttgttagttgtaggaactggttccatttgctgcctgctggttgtcagcctccatcaactctcaaagaacagtgtcagtcccagcctgccatattacatggcagtctattgatccaaactcaacaggtgactctttcttttcaagatgagcccttcccatctttgagggatcatctgatatggtcaggtctcctttggatgaatttgaggtcaattgtttggtaacctacttgggagagcaatatttcctaatagtcacagttcccatttacatgtaattgaggcagacagaccatagaacagtactagagggtatcatagatctccacttgctctaccaactccaccaatcacttggacaatttgcctaagctctcttcttttgttttcccagtgctaaaatatgagtcatggtagcattctccaccgtatgaggttgttgctgaattgcatgagatgacacacgcaatacatctcagcttagccttggtgctaacagagctttccatagacaccagagtcatagcacagaagtggttccttctttcccaccttgtctttacttacttctacccatgatgaaatggttttgagggcgaagctcatgataacatgcttgaaaaattcagaattttcccctagtgttctggtttgtgttacttcaaagagagatgatacacatttataatcccagtactggggaggctcaagagagtgattatgagttcccaggaagtttaagctatagagtgggaccctgtgtcaaaacaaaaagtagataaggtgaaacatttcccagatgttactctgcttttgaaaactagcttggagccaggtgtggtgcaaacataacagcacacacttttaatcccagcacccaagaggcaaaggcagctatatctgtgtgagtctgaggccagtgagttttagaacagccagaactctacatactgagaccctgtctcaaacaaaacaaaacaacaccccccaaaccaaacccaaacccaatcaacacaaagaaaaccagtttggtaggttactcatctgtaattgacagtactgttttgtggtatgtgctccagcagtgtgtgtgtgtgtgtgctccagcagtgtgtgtgtgtgtgtgtgtgtgtgtgtgtgtgtgtgtgtgtttaaatatgtgtgagtacacatatttgcaggtctatgaaaatatgcacataaggttgatgttaagtatctttcctgatcatgcttagcttagctgtgtttattgaggcagggtttcttgatcaatccagagttggccaattctaactagtacagctagccagcttgtctcaggaatcccctgtgtctggttccctggcttttactaatgtgctgactcctcatgcttatgggatgctgaaaataaggctccatacttgttgtgtgatcctgaagactagatttcagaacctagcacccatgtgacaacccaagcatcctctaaacacttgtaactccagctctgactctctttggcctctgtgcatgtaggtacccatacacacataaatctttttttttttaagatagaaaatttcaaaacctgatgtgtgtttctcacctatagattaaggactttgaagttctagaaatctgcactcagtttattgtgtaaaaattgtaaagatcccatcttctaaaatgaaaaagactggggtttagtggcacacatttgtaatcgtagctcttaggaggtggaaacatttggatcactatctgtgtaaagctagtttggactaactagctggggctacccagcaaaacgctgtttcaaaacaaaactcagcacttggtttgttcacattagagatcaagccacaaaatggttggaaatatttgaaaaatatgtgtatgaagaaggattaatatccagaatatgtgaagaactcccctaactaaaaaatggtggaaaaccttgtttttagattacaacgggaattaaatagatatttctcttaggaatattaaacaaatggccagcaaacacctgaaaagatgctcaaaaattatggcaatatgaagcaaaattatgatcacacatatttgggtgattggtgacactcaaaaatctgatatggtgcaaatggaagcttgtttagtactggcgagagtttaaaaatggtgtttgttacttctgtggaaaataacctagtagtcctcagaaatttaaatatagaattgcctctatatagagttaggaacttctcaccaaagagctgaaacagagactccaaaagatatctgtatattaaggtttagacctgcattactcatagtcaccaaaagttagaaacatcccagatgcccatgggcaggtggaacaaacccaaaatgtatgtatgtgtaagtatgtatgtgtatatacatacatatataccacaataatatatatgtatatgtattcatatatatatatatatatatatatatacacatacatatgtgtgtgtgtataaagagagagagaaagtaatattaatcacaatgtgaaactctaacgtacatgacagaatgggtgaatcttgaaagcatcattcaagtgatacaaaaccagacagaaacagaccaattttgttcagttccaattatatgagatatgttgacaaggcaaatacatagcaacagaaaatagagatcatcagaggttaggaggaacagagagagcagagaggtggtgtctaatgaatatggagtttctgttcgataccatttaccgtttggaaatgagtagtgctgactgcagaacaaagactgtactctattttcaaaatttggtttttgagataaggtgtcaccatgtagcccagggaggcttcaacctcataaatcccctgcctcatattcctgagtgctgatgttagagatgtgcgtcaatgcatatggcattgggactgtacttactgccactgaaatgtacccataaaagagtgaaaatggaagctaaacagtatgtagacattccccacaataataacctgtcctccaatccagtccttgtatgtctttggactatgccagaaatacatagtattagaagtctctgagggaaaaaccagacactgaaagggaaacacacacacacacacacacacacacacacacacacacatcacatcacatccacaactctaaggaaagctgttattttaatttctccatattttacttaaccacttagcctttgtcggttaacagtcattttctaccacttcctgtgcaagtggcatgctgacatctacttagtgagccttcccagtcttcatcccctattagaagaaaaatagaaaaggcctctgagctagggcaaacacagctccacagcaggcattctgtcactaaagctgtcctcagcagcagtggttcttgggctccagccacaccatgggagcagctgcaaggaagagctgagaacctggggtcagcaaggctggctccagctagaatagcatgagcagtatatagcagggtcagggaatctctgactattgtcagaatatacacagggccctgcagctgaggcatacatctttgaagactcttaataatcctttcagctctgagtggttctgctgtgccctcctgtgtttctctctgggccttctagtggacagtttggcaatgggtctctgagccagggaaaattgttgctggagctttagaagtctccttagaaggaggctaattgcctgtggctgattgaaagtgctcactgttcaggtcttggaattcaccagaaagcagggtaagtccctgaactggctgggacctgtggtgcctacactgggtgatgctgggtttcccagagctttagaattctttctgacagagttctggattcttctttagagaaactgctggtgtctaaggaaggaagactaacagtttagcaggggaatgggctgaatatttttgaaaggtatccagcactttcatgagcactgcctgacttttggaaaggactgtctttgccagtcctcttgatagggtatcgagttcgaggctagcctggtctacaaagtgagttccggggagccagggctatacagagaaaccctgtttcgaaaaaccaaaagaaaaaaaaaggaaagaaatagggtattattgggttgtcagtgtggcttgttgatcgacttacccaataagcgcacggtcctgcatttcctcctacaaactggaggggaaggtgatgtgggggcggggggagaaaagagagcaaatctcaactttgacataaatggcaataaatctctcacttactccaagaaaatcaataatcctcttttgccagaattatattgattgtgaaatatgttggtgaactaactgtaccaaatagatatccctaaaagacacccacacaggaggccatacacttactccctaatattactgatggaaataaggggaaatatatactcacaaaatatactgtatgttttatcatgagtgcatttctggagtaaggggaaatgtatcattttaaaacttgacttctatggaccattgagatggcatggcaaggaaagttgctggctgacagcctcaatgacctgagtttgatccctgggactgagaatgtggaaagagagaattaacttgtacaaggtgtcctctgatctccacacatgggccacacacatacacaaataacttgtctctaaaatataggagcattgggtggatgagatgcttaggtagcctgacatcctgtcaccaagcctgacatccctgagaaccagatgttcaaaggaaagaaccagtctctaaccacaagagatggaatcgttctctttcaatagaatcaatcaataaataataaataaaatgaatgtttaatttttttaaacaaaactgacttagtctaattgcttctctccaagtctgtaattggattattgctaccatctgtctctgttttttcccccagttgatgcaagtccagacagtttaagtgaaaatattctatttgataggctggggattcacatagcctactgaaatcctaaaaagtttatttgagacagggatccttaagtgtccctgacaccccttgaacttgtgttgctactggttccaccttccaacggctgaaatcacaggggagcacttacatgcccaccataatgccttgaatttttaaatgtataccctttacttgcctaacatatggcattcacatagtaagtgtgttcgtggatatatcttggaacttagagggagggtttttttttttttgaacattcatccctaattccttttatgctaaaagtttctatttgaaacattgtggctacctgaaagcaacttcacatgcaattggaatccaacttgaaatccaatagaaataaaatggagaaacagcaaactggcagcagtgtgcccacagaggtggagagtttctaagtgagtgagtgacttctattttcttttttcctttttttcttttcttttcttttcttttctttctttcttttttttttttttttggttttttgagacagggtttctctgtgaagccctggctatcctggaactcactttgtagaccagggtgacctcgaactcagaaatctgcctacctatgcctcccaagtgctaggattaaaggcatgtcccggctgacttctattttctaagttgtagttttggattaaaaactcttcagtgaaccaggcagtggtgagccatgcatttaatcccaatgttcaggaggcagaagtaggcagatctctgtgagtttgagaccaggctggtctacagagtgagttccaggacacccagggctacgcaatgaaaccctgtctcaaaaaaaccaaaccaaaccaaaccaaacaaaccaaacaaaaagtccaaacaaaaaattcttcagtgaacgtgtatcacttttacaattatggaaaatcagaaattcacacataatataatgcagcttgtttataagaaagttagcatagtaggggttaacctttcttgggtctcacattcttttgaaattgctgaaagttccagacccttcttgaagagtgttatacacatggtgttgtcagtgaattctctccattcacaaaacctcaagtttcctattcttctagacaactgggctgtcatagctggatcccctagctctttctttcctgttctttttttaggttggtgtcacaggtgcctagagtataggggactttgaaggaattaaagcttgggctaagcttagaactgggatcactgaggaagcctgtgaacaccaagttgagatatccccctaggaatagggcacagcagagaagacagcaggaaggctgatcttggtcttagagcagtgtctacagtagctacagtttaaaaatgacaacagctaaatgagagcactgtcagcctttaggctccagttcaactgataataaaagcaggaccctaatgcacatggaaagcatgacaattatgtcctctagctaaaggatatgtaagagagaaggtgcagagcattctcaaggacagtgtcttgtcattgagatagcatttcagtcaatgctataggcagaggcctctagacatccccagtcctcattgtagaatttgccaggggtggggtgggcactgcaaagggggaatgcttaggtaagggcatgatggagtgtttgttgtagcaaaatccttctttgctttctgaataaatatgactgtcctttagagtgcttttagccggaggaaatcagcgaatgttcttgtgggcatgttcagcacacagactaaatgtgaactcaacatgggggagagagagcaggaggcagaaacatagaaaatgactgacttactgattgattgtttgcttgattgttcaggtggaagaaaggcactacaactgggacttttgctcaaatcatagtctccctctccgttttagttcaaacagacaacatcatttggaactgcccagcatggggtttctttgtgtaggtatgccttgtcctctgagaacttcatatatagtactatgtatgtatcctgagagtaatgggtgaatcatgttcatgctattcagatgggtggggcaggcactaatgaatgtctttcagtgagtgctcatcttgagaagactgcaagagaaggacggttgtactgctgagggttagaaagatgttggcagtgagtctgcagtttgcttattctcccattcaggatataatgtgggggaatttggaacccagcagtgaccaaggccaacaacctaacaatcgcaaagctttctcttggtggggagtgaaagggagaaaattgatgagtactaactgcatcttaacctttgaatggtgggctaggatgggaaaggaagtaaagtacttgttctatgctttaggaggtgtcattggatccagtgagtgtcattggtattagaggctggtcacatgtacctggatacatcagttatctttaccaggtttcccagggtagtgggggagaaaattgaacagaggaatcaggattagccaaaatgagatcctgtgagctactaagagttttgtccactgtagttagagggcttatgctagagaatggggctagaggccagatcatgaagtgtcttagcacacttcttggcagtctgggtcttgttctgtaggttctgggaaggagtgtaaagaaaggaatctgtgaaccaaccttcatctcgggaaaagtttaacagatttgaatcaaattagccaacaaagaggtgctgggaacaaattaagtcacagattggtagttgaacttttcaaaataaaatgtttgggttaatttagtctgtcacaggggagataggtgcaagcactctcttggtgtcctttaaaagaaagaattttcatgcaaagttcctacttgctttccctctagagttgtgtacgcagctctaataaacagtcttccatgattcagtgtattgctcctgaaaaatagagacagtagggcacatgtttaggctatgttgtcattttatggattaatttccattactgtgaactttctggttttccgtgccataaatatgagcaaaacatctgtccgtgtcattctcttgataaaaacaacagcagcagcagcagcaaaacaaacaaacaaaaattaaaaaaaaaaacaaccaatcaaatagaaaactgtttgccgactccccacttctacatgaggaactagtcccagattatgttcttgatgaatgtggctctccataagcagacctctctagctcatctcatccatcttcccctttgccgaacattagcagactcacaaacacagcactctaagctctctgtactcaatgtcattctgtttactgctttccccatgctacctgtattcaccttgcctgctctgggatgatgatctcccatcatccagggatcagctcaactgcttcttttctccctcaccagcagaatgaatctctcccttactactctctgtatatctcgatctgttgaggagccctaccttccaatcataacatggcccttgctgtattaaaatctgaacagctgggattactgccatgacactgtcaggagctaatgttcccttgctgagcggaaggagggctcctgtggctgtacaggagaggctcccaaggccctgctttctgtctccagggtatatataactagttaaacattgccaggaactgggctttttcacccaccttcctgtaggtaactcaaactgatttcatttgattcaccaagcttgaatttagtggtatccgttttctgttctgttattggtgtcctacttgaaataaatacatatttatctccacccaggaaacgttaacatgctaccatcacagcccttgccatgctctctgtgtgaaagcatggctgtctgcccctctagttcatgaggtcactaagagccccggatctgcgtcttgtccatctttcagcactttgtagctcactgcctggcccatggctgatgctcggttagtacatgtgaccgttttgttttatcagtgccctagaagaattctcaggggatgactgaccagggagcctcacttttgtaacaggttggtcaacaaaattttaaatgaggtgtaggatctcctcagacattaaaatctaactgtgctaatgagcaactgggtttctgtacagggaacctatctcttaggagaccctgggtttttccctttctgtatgtacaaggaagtgaaactgggtacgtgatttttttttttttttttttacttttcttttttaagttttgttaatcttggcatacatagtaattgggcttcatcaccccacagtatactttaggtatttaaaaaatgattcataggtcctgactcataatattccaagtctcctttctctgtgtgttggtttagctttgctatctcgacacaagcaagagtcatccgagaagaggggccctcagttgagaactgttcctatcaagatggcttgtaagaaagcctgtggagcattttcttgattaataattgatctagaagggcttggcccattgtgggtggggccaccccaggggaagtggccttggggtgtatgagaaagcaagctgaatgggccatgtgggaagcaagtcactaagcagcgttcctccatggtcctgcttcagtttctgtcttgacttctccatgatgggctataagctgtaagatgaatcaaaccaaacatattagtagggaagtacttaatttaggctaaaacagtgtgggtatgataataaatctgcccagggtgtgtacaggtcaataagttatcgaaatgcagggccaaacggaggcaggtgtgcattttgagttatagtaggagagataggattaacatcgactgggtcactgtgtcctgtaatagtaagaaatagagaagttcccaaatttttacagatgtaaactttgcctttatttctctaagaagcttttactgtgtactatcccatctagtggtacagacttctagtagtgggaggggttcacaaaaaggaagaaggaggaaaataagatccaagatgaccaattatgggaaagactaaaagatttgctacaagatgccgttttctccttttcaagattcattttcaaactgggacctttcagctttctttactcgttgtcagggccaaattaatgaagtggacagatctctggtgcaatctcatgtaggaaatgacatgtggctgcatgctctaaagggttcagatgatgttcaggtgttcactatttcactgacagtaaatctatggaacatttgtacatttggattttttttttctactgaagaatgcaatgtatgccatgactctctttaaaagtaaggggaaggtcagggggaattctattttattgttttggggtttgctttgttttttcagacagggtttctctgtgtagccccagctgttctggaactctgtatgccacactggactccaaatcacagaggtccacctgtctctgtctcccaagtgctaggatcaagggtgtgtaccaccagcacatggctagtgagaacatttttttaaggtcaaaactatccttgaactccagggcttacatagttctgtctcagtttcccaactagtcaggactgttagagatggctccctgctcctagtaactccgtggtgatcacagacatccaggcaggttaaaattagttgataagcactgaataggttgtttgtcacagttgggtatgccttgagagcttgtattttgatttttccggaaagttgttatgtcttgccaaggtgcatttttctcctatcaacaatggtgttaaatcaaaatagtattattcatattgacatcctctccgttccctcagacccttctgttcatttccccgtgttcctgtcttgcttttgagtcatttaaaagttattagcacaaagtgaataccaagtcaggaagaattgaatccaaatcagttcttgcctgagagccagtgggttgagttaaggtataattactggctacagtgaagttttggggtagagagttcattggcattctgcttactcctgtggagagaatatgggctatttgcataatatctgagttggcagtaaagaaagcatttgtaaagcaagctaagcctctcatagagcatgttgtctcattagaataaaatcttttttactttttcagactagttctcaaaacaaatagcaagtagacttggaaagaggaaatactcttgcattaaaaatttcccgtgttaaagttctaaaattgggggaaaatagggagggataggtaagcctatttttcaccagttgtctttatgttcagttttaagtaccttcaaagtctcattttgtggatttttagagttgtaagtagttccttaaagctggaaactgaaaatcagttctgaagactgttggctctcctgtcctcttgggtggcccctctggcttggaaagcttgtaccaaagaccagcctctttgtgttgtgcagctgtctatccccaggaaccacaaaagcctctggctttggagttctcaccactccctgctgggttcctgctaggttccttggaggatattgagatgaattagattcagagattcaggtcccttgacaatatcttacttttttttttttttttttttgtaatttgattcttccccacttgaatctaccagctcctttcctcaaagtaaaagatccaaggtgttaatccctactcattgaagacaaatgctaaattggaagcaacagcctagaaatgcaaaactccttatccaattccaattcaagctctcccagtcagccatgctcagcatcatctgggtcagaagggaagatctcatggtggcacatgcctttaatcccagcactctggagccagacacacacacaggtctttgtaactttgagagaagcctggtctacagagcaagttccaggattgctaaggctacacagatataccctgtctcaaaacaaacaaacaaacaaacataaaatgaaaacaatcccccaaatcccatgcttccaagttttagaaaattataaaatgcaaagttcattgagcgaaacaaagcgtggtaggtaagatcaagaatgaagaaatactaagtatctgttgagtttagagcacacaggcttatgggtacatattatggttaagatcaatattgtactaaacctcactttcctcatatgtaaaatgtacataaaaaagaagaaaagctcctgggatttttttcagggagttaaaagaagagacatatagtgcttaacagtttgcataatggtgccgagtctatgaagcaaagtgcaaggcatcatctctgctgagaagattctgctgagcaaactaaacagcaaagtagttgagtgccaaagtaaagctgtgtctaagtgcattccacaatcaatgggaagagtactgtgggttagagaagacgcaggctaggctcgctcaaaaatagtaaggcctagggagatggctcagtaggtaaagcacttgccacacagccatgaggatttgagttggaatccccagcacccatatataagctaggcagtctagtgacctgtctgttaccccaggcctttcagtaggtcaagacctgggattcccaaggggctagctgttcagactagctgaattggttcaataaataaagtggagaataatcaagaaagacacctgatgtcaacatgggacctctacatgcatgtgcacctgtaccaccacacacaagtgtgtccacacatgtgaacaagcatacacaaatgaatacacatgcataagagtaacaaattgataaaatctgattttctgttgttaggtatttttttccttgtgtatgtgtgtgtgtgtatgtgtgtgtgtgtgtgtgtgtgtgtgtgtgtgtgtgtgtgtgtgtgcacgcacgcacgcacgcattgataaggacttcctgcccggcctcaaatgcatccatcttcttgcctcagcctcctgagtgttaaggcgccaggggtgccattacacctggctttctcctcgagtttatgaacaaaagtagaaatgcaaaaactgatcatatactacatactctcacgcaatgaaggcttttgattgaaataagtggtaatagatggattcccatgtttctgtgtgtaatgtggtttgtggcagcactttgatagaagctacactagacattggaaggtatgcagaaaccaagtgtggctttaagacagcttccaggatcaagtcagatgtctaggtttatctgccttgcaccgtgagttaagaggattctcaagggtaaggtccaattctttctgtgtccacatcaccagcagctagcacagggtctggcccttagtagggacccattaatatgtcacatacttgaacgtgctttgttttctctcctgctggaaggaaattgccttcccccagtggccattttgagtacagagggttattttaagatattctcaagagagaacactagaaactgctgttgagtgcctaaaaggaaggaagagcagaatgacaaaggggagtgtagaaagttccaagtgaaggggatggagggagaatgggatggagtggcttatctccttttgaatatggtgcttcttccttttcactgtcatcatccataagagaatgtgattccagcacttgggagtagtgtcatgaatttggggctggcctgggatacctagtaggtttcaggccaacctggactacagaggaagacccttttctttaaaacaaaagaacaaaacctttcaactcagatgccactgtctcaaaatcacacacacaaaaaaagaaattttggacaaaatcactgtcttaagccagttgttgccgtggtctttattaaactgaaacctagtgtggaacgtggcttgttggtggtgaaggtttgaaattggccccattccaccctcatttctaagctttctgctttccctcccagtgtttgataaagaagggaatctctgcagccagtgctcactttagacttgccgaagacacattctctgaattcttcaagacaactggtttctaaaatagaagatttactggtaaactcatgacctttagtataatacctaagcagaagttaaatctggctgattttgtgatgcatccagagaaacatgacattatttgtttttttaaattttattcttgtctattgtgagtgcatgtgtgtgtgtggccggttgttcatatgtgctatggtgtgcatgcgcaggtcagagaacaaacagctccatagagtaggttttagttgtttccttctgccttgaatgggttcccagatctgaggtggtcaagcttgagtgtcaagtgcttcacttgctgagccatttctgaggccactttattgtatgttaaatgaatggatctgtgcttctgtttcttttttttgggggggggtggtcatgacagggtttctctgtatagccctggctgtcctggaactcactttgtagaccaggcaggcctcgaactcagaaatcagcctgcctctgcctcccgagtgctgggattaaaggcgtgtgccaccacgcccagcttgtgcttctgtttctaatggtaaattatatagacttaactagtcatgtgtattttgggcaacattcagtgagtgagttgtcaatatcaggagtcacagtgtctactataatgctaacgtgtgtatttactcatttggggattacagacttggtattttgcacatgtatagttaaaacgatgaaagaacagcacattggatgtgttagagctgccacaaagaagaatgtccaagttgtgatgctgtagagagaccctcggttggggtccattctttccagtctttttaccaagactgcggctgaatctacactgatgacttccctgtttcccccatactaacaatgataagatggtctcaatttgtagaattgtgcatttcttcctagttttaggatttacacactgaaggccatcaagagttccacttaggcagcttaaatatgcatgtaacccatgaactacatacatctcaagtcatggttccaaaatgattattgaaagtttttttttaaatactagaattaggtaaacaatttattgtctttcacagaagtgtcagaaggctttttagtaaataaatgcatctcaatggagatgttcttagagtggaagttgagcccagggtctcacataataccgtatgatatctgtatatctgtatcacagagctacagttcctgtctcaatgaacatatttgatttgaggattgtatacaaatacatccagtttgtgcaacactgacaagaaaaggaaaacaggatcaggagttagaaggtatggtttggggctgcagtgtagctcagtcctagagcacttccccgccacaaacaaggtcccatttccagcctgacaagaagaaggagtgtgagcttgactggttataatgacgattctgctgatgaatgatgagcctctgagccactcccgtcacatataaagttaaaatgatagtaatttatgtatgtacatgatggacattctgtcaggtcagtggggtgcagattcaagtgctttcttaatgatgcaaagtgatcttcaaatgagcagaaggaaaaccaaaccaaaccaaaccaaacaaaacaaaacaagactactaccaccaagttatttcaagggaacttatggctcagtgaataagggttttgacagacagttcgctttatttttctccggtgaaaactgagtaggttccagatttaggctgcagtttttcttgtcactcctcaggaaggcaagcctgaaacatgtgctcacttcactccagattgtataaataaatgcctttgccttttgtttaacactattacagaactgtagaggagcatgcagtggggccttgctgctatttgaaggattggtgaagttttgttcattataatgcaggtttctggggttataaaaaaagtctttgtaggctaattattatacaaactaaactaaaaggaaaaatcacaaacatgaaagaaaagtacattttcttttcttccttcttttgtttcttttttctttcctccttctccttctccttctcctttttttttttttttgttgttgttgttgttttttttttttttttttgaagacaggagccctggctggcctggaactcatcatggaccaggctggccttaaactcagagatccatttgcctctcccttccaaatgctgggattaagggcctacccagctttcatttttttaaatatttaacttaaaatattttatgaatattcatatatacatacaatgtgttttgatcaaacccacccccatgaaaactctgtaagtgtagttagacgtttttctttgataaccatagaaatctaatgatagaatgattgaaaaaaattgaaaagcaaacttaataaaggttatgatggctggggagaactactactcaacccacaaatccaaccttttccttctctctgatgactgaatccccctggaaagggaaatagagggtttcagttgcctctcctttttttaaaggcccaggtcttcgttagagcactggttctgaaccttcctaacactgcagccctttaatacagttcctcaaatttacggtgacactcaaccgtaaaattatctttcttgctacttcataactgaaattttgctacttttctgaattgtaatgtaaatatctggtatgcaggatatgtaaaacgaccccccaaaggggatgcaacccccaaattgagaaccattgtgttggagtaagcattgtggtactcagaatagttactctaattttcctaatatcctgaatctcgtgacagaggaaatagaaatggcaactcagaaacttaggttgaatcagtttgaaatgaaaagtaaaacctttttttaaaagtgtcctttaaaatgtggggaaactgttgctttcatttctacaaggcatatagtttacatctaaacacatgattcctttttgtcatagggtttttatattaacatgacatgaaaaagccaaaaataatttctttttttttgtcattttgctaagttgcttgaagcaggtgtgtgtgaaattcctatacagagaagttaatagatgttaattcaacaagttacacattgaatttggactggttttaatatattttattttaattaactttgtagtagtaaggattgaatcgagggccatctacatactaggtaaatgctctgtcattgacataatgaaggttgatatcgcaaccttccttttcagtttttttttttcagggtcttagtatatagcctggggtgacctggaattcactctgaagatcaggctggccttgaactcagaattctgcctgattttgccttctgagttctgggattaagggcatgcaccatcacacccagctcacacacaaaaccatggaaattattgtacatactaatgggtacatgtaatattttgaaatgtatatattatatgtgtttcagccatgttaatcatatttatttcttcaaatgtcacttctttgtggtgacgatttaatatatctttaatatttttagatttgttttattattttttttatataagtgctttgcatcacatgcaagtctggtgcctgaagaactggtgagcatctatggaggtgctgggtcctttgcaagacaaatactgtcaaccactgagccaactatctagccttagtttactacatcttaaatctgtattcagtttctattaatacaagttaaataatttcatttaaataaaacatccttagtagaaattattgacaaatattgtttaaacaactaatgtgtaattacttagaatgcatgtcaggacatggttctaagtgggtctgaatatctcaaagctcattatataatgaatgcttggatgtctaccatgcgcagtgaacaaattacagcttttccttggttctggtgctagcacttcacaactgaatcttgctggaagggaaaggtagtccttttccctttactaatcatagagatgaaatttgattcacaggtttaggtcttctattgtaggaggctccctgtctttgaatagtcagagaagtaaaaatagatcatggtatattcagtgaaagaaaatgataggcaggtacatagtggaataatctaagttcaagtcgttcaagtccttgcatattaatatccttttgtatttttgagtgggggaagagactgcatgagagaaaaagaatgagtcttttacaggcacagacctagggttgactttcgactctgaagatttatttaaccttagttaagtcctctttctcaactctaatatgggagaattgattatgcctatttcataggttgttagagcattgcattggaacatatacagaaagtacttagcaaagttgatggctgctgagcaaggaagagttgtttttttttttttcagagacataagccctgagaagccatttcatgcttttagaagatggtcccacacccatgcacatattaggcagtactaagtggacccagtgaaattttaaacaagaagttaagagatgaagtgggggagatgggagaagaattggaaaggagagaatgggagtggacttcatcaaaacaccttatatgcatgaataagtagtaaatatagtactttaaaagaacacgtttgatgctatcattattagtagtattactcctcttcctataccatcttttgatttctcatcttcattggctctgttcctcataaaatgacccttaggctggggcccttctatcaatgatcagctcacttaactgtccaacaggaggccacagagtttacctcctgaaacctcaccctttaatgccatgtcggcagaattcagcatctccaggactcttgcttgtcatagcaaagctggaatgtcataggctttggattgtatatttggcacagggaggacacatgaatgttcatattttctccactttagttacccagcaaatagagcacattcactaaatctctcataggtttttaaatatactgtttttgtttgacttaaaattcagggtattttttttttggaagatataaacaacatggtactctttctttagaattctttttttatgtttttatttttttaatttattttaattttttaatttaattttatttcttaattttttattgggtattttcctcatttacatttccaatgctatcccaaaagtcccccataccccccccccctactcccctatccacccactcccactgtttggtcttggcgttcccctgtactgaggcatataaagtttgcataaacaatgggcctctctttccactgatggccagctaggccatcttctgatacatatgcagctagagacacgagctctagagggtactggttagttcatattgttgttccacctatagggttgcagatccctttagctctttggatactttccctagctcttccattcggggccctgtgatccatccaatagctgactgtgagcatccagttctgtgtttgctaggccccggcatagtctcacaagggacacctatatcagagtcctttcagcaaaatcttgctagtgtatgcaatggtgtttgcatttggcggatgattatgggatggatccctggaaatgatagtctctagatggtccatccttttgtctcagctccaaactttgtctctgtaactccttccatgggtgttttgttcccaattctaagaaggggcaaagtatccacactttgttcttcattcttcttgagtttcatgtgctttgcatcttgtatcttgggtattctaagtttctggactaatatccacttatcagtgagtacatattgtgtgagttcctttgtgattgggttagatcactcagtatgatgccctccaggtcaatccatttgcctaggaatttcataaattcattctttttaatacctgagtagtactccattgtgtaaatgtaccacattttctgtatccattcctctgttgaggggcatctgggttctttccagtttctggctattataagtaaggctgttatgaacatagtggagcatgtgtccttcttaccggttgggacatcttctggatatatacccaggagaggtattgctggatcctccggtagtactatgtccaattttctgaggaaccgccagactgatttccagagtggttgtacaagctcgcaatcccaccagcaatggaggagtgttcctctttctccacatcctcgccagcaactgctgtcacctgaatttttgatcttagccattctgactggtgtgaggtggaatctcagggctcttttgatttgcatttccctgataattaaggatgctgaacagtttttcaggtgcttctcagccattcggtattcctcaggtgagaattccttgtttagctctgagccccatttttaatggggttatttgattttctggagtccaccttcttcagttctttatatatattagatattagtcccctatctgatttaggataggtaaagatactttcccagtctattggtggcctttttgtcttattgacggtgtcctttgccttacagaagctttgcaattttatgaggtcccatttgtcaattctcaatcttacagcacaagccattgctgttctattcaggattttttcccctttgcccatatcttcgaggcttttccctactttctcctctataaatttcaatatctctggttttatgtagagttccttgatccacttagatttgaccttagtacaaggagataggaatggatcaattctcattcttctacatgttaaccgccagttgtgccagcaccatttgttcaaaatattgtcttttttccactggatggttttagctcccttgtcaaagatcaagtgaccataggtgtgtgggttcatttctgggtcttcaattctattccattggtctacttgtctgtcactataccagtaccatgcagtttttatcacaattgctctgtagtacagctttaggtcaggcatggtgattccaccagaggttcttttatccttgagaagagtttttgctatcctaggttttttgttactccagatgaatttgcagattgctctttctaattcgttgaagaaattgagttggaattttgatggggattgcattgaatctgtagattgcttttggcaagatagccatttttactatattgatcctgctaatccatgagcatgggagatctttccatcttctgagatcttctttaatttctttcttcagagacttgaagttcttttcatacagatctttcacttccttagttagagtcacaccaaggtattttatattatttgtgactattgaaaagggtgttgtatccctaatttttttctcagcctgtttattctttgtgtagagaaaggccattgactcgtttgagttaatattatatccagccacttcaccgaagctgtttatcagttttaggagttctctggtggaatttttatggtcacttatatatactatcatatcatctgcaaaaagtgatattttgacttcttcctttccaatttgtatccacttgatctccttttgttgtctaattgctctggctaggacttcaagtacaatgttgaaaaggtagggagaaagtgggcagccttgtctagtccctgattttagtgggattgcttccagcttctcaccatttactttgatgttggctactggtttgctgtagattgcttttatcatgtttcagtatgagccttgaattcctgatctttccaagacttttatgaatgggtgttgtattttgtcaaatgctttctccgcatctaaggagatgatcatgtggtttttgtctttgagtttgtttatatactggattactttgatggatttccatatattgaaccatcctgggtgaggtgggagtgctgtgttctgatgatggtgagtggtcttggcttctgttagtaagattcttatgtgtgcctttcaccatctggtaatatctggagtcagttgttatagttgtctctggttagagcttgttcctcttgtgattctgttagtctctatctgcagacctgggagtctagctctctcttgagtttcagtggtcagagcactctctgcaggcaagctctcctctttcagggaagttgccaagatatctggcgtttgaacctgcttcctggaagaagttgtgttccactcaccagagatcctaagatccggtggagattgctctggcgaccttgggggtgtccaccgactcactttagaattcttatctacagcaaggatgggtttgtcaggttcaagtgcttggtgttcacatgtgtttgatatatgtctggatccatacatatgtatggaaaagttttctcttattaaagcagctgtatgttcttattagttcaacacccccgtttttggttgtgtgcttgtttgtttgtttttgagacagggtttctctgtgcagccctggctgtcttggaactcactctgtagaccaggctgacctctaactcacagagatctgtctgcctctgcctctggagtgcagtgattaaagacatgagccactactgctggaacaattcccattttgtgaaatagtgaaccttcactacacagaatggaattttcttcttctgggagtctgacagtaacatttttttttgtctcttacaaaggaaaaggccaagttagttgaacccctggactatgaaaatgttatcactcaacggaaaacccagatctacagtgatcccctcagagatctgcttatgttccccatggaagacatatctgtgagtgcacgtgtgcttttaaaaggaataagcactttattttccaagcaagttcttagaataagagtatgatttgatttctagatctcagtgattggtcgtcagcgcagaacagtgcagtctactgtaccagaggatgctgaaaagagggcccagagtttatttgtcaaagaggtaaggggctcaacagccagccaaagagcctttttttctatttgttttattattatttttttattagtgtgtgtgtgtgtgtgtgtgtgtgtgtgtgtgtgtgtgtttgagtttatgtgcaccatgtgtgtgcagatgcccacactggccttttttgggttccctgaaactaaagttaaagacagttgtaaaccacctgatattggttctaagacataaacctagatcaaatgcaatagcagtacatgctcctaactgccaagtcatctctccagccacctgccagatgattttggtatatatatcatatatcatctatgaagtttaaattcaaatttagtttttaaatgggaaataaaattactaaacttaacctgtgtaacaaaactgtacgatgtaaggcagaagcttaaacatttataattagtatatggggttttgttgttgttgttgtttgttgtatttttttttttaagatttgagtactttgtcatgtatttgaagaaatagtttttagaaggacatgtgaattagggtctggccttgtcagttgggctagatcacttgttctcaaccttcctaatgctgtgaccttttaatacaattcctcatgttgtggtgatctccaatggcaaaattatttttgttgctactccacaactataatgttgctaccattatgaattataatgtaaacatctgtgttttctgatggttttaggtgacccttgtgagagggccatttgacaccatcatacttgatccccaagtcaagatgcctataccaacatttctcaattaattaaaaaatgctgtgggtatttcaccagaccttggcttatgtgtttgagacttggacttgaggttgcccttaaattcacgctctttctcagctctctaaatgctgggggttacaggtgtgtgccaccctggtcagctctaccggacatttaaaaatatatttctttgttttctttttctatgcttgaaatggattttcctactttcttccagtgtattaagacctacagcacagattggcatgtggtgaactataagtatgaggatttctctggggactttcggatgttgccatggtaagtttagaagggaaataggagaattctattattattgtcatcaccatcatcattattatggttatcacttagctttttagaaaactcttttgaaactcctgttataatttatgagtcagacctcaaacagcagcatatttggctcatgtagtgttttgaccagttgagtatgttttgagtgtgctcattgacactcttcccagtaagtgtgagctcacttagttggacacatccatattgactacagaataatctttagtttattctggaaactatagggacagttttcccagtggtgttggtgaagaacttggaagctgtttaaatcagtttgatacctgctgatatcccttggatgagatttggggataatctcagtgaagttgaagaactgtcatgaggactactgacccagtagtcatggtccaagttgtctttctgctctttcctagctggctaggtttgaaccatccagtcaacctgtttgagctctcctgtcaatcccatttctctactgcatgactgctggtctcccagcatctcatctaggaaatatgggggtggggtggcgggagacatttgtgaagtcctctgtagctttcaaaaacattttcctaggaaagaagctactaacattagcagtctgggctcccaaagcaaacaaaacagaaagccaaaatgacacagtgttgctttctgacccgtggaaaggtaaagttctgccactcctgacagccctggcagaggctccttagcaacttctgctctgcttgactcctatctgctctctgttttatctttgcagctggctgcatatgtgggagtccttctatacaaataaggcagtgttgaggagatagcttagtcaggagtttttgcttagcagaaatcaaacaagcagacagaagaagcttgggtgtttattcaggaataaggcctatgtttgaaaaaaaaagtgtacttttccatctcttgccttgcattttcttgcttttcagagaatgaggttgacttcaggttttgtttgttggtgatgcttataggctatgttcagagtctaaattaattttcttgcactttcagcaagtctttgagacctgaaaagattcctaatcatgtgtttgagattgatgaagattgcgagaaagatgaggtaaggatggggctagctgtctgccattcttaagctgaaagggaattccttaaagggaagatgagtgatgctgaaacaagtggttatgagtacctgtggccacctttctaaccaatgaatgttttttacttaaaaaatgcgattacacttcaataactattgagtgcctactgtgtttataccattgggcctttcattctatatacggtcaatattttaaatatttatgaaaagtgataacttcgtgtttaattaggaaatgggaacaggtctagttctttgtctgctaaatgttaactaaataaatgattggatgattgctattctactgatggtttttattctatttcaggattcatcttctttatgttctcagaagggtggtgtgataaaacaaggttggttgcataaagcaaatgtaaatagcaccatcacagtaaccatgaaggtaggaaatagttatatccatctatcatttgaagtatattgacatatataatgaatctggagaaatgtttgttttctaatgaatcctcaaaaaaatctttttttaagttagaatgtagaataatcggtttcattatggattatttaaacacatatatcataatactttgttctcatttgttcccctaccaaaaagtttttaaatgaaagaatcttaacagatgcatggaattttaaagcttcaacctcagatcaaatttagaaatgttaccttttaaagacagataatgaagctcttaatgtctgacagaagctgccaggttaatgaaggaaatagctttgcaaaaccagccaccagaggttcctatgtggaaatggatttaatgaatgaatttggcgcttattaatactagtgactgtggggaaatatactgacatctgggatggggaagtccgttgtgtccagtagcttcataattatgttagaaacataccacattaagtcctacataaaatagtgccttagggtggccaagcctatttggaaaatgaagcagtttgactagatactgaatttatgtacgggactgtgggagatagaaccaagaacactgaaaggcttttgtttgggaggcagcgaagagccattaaaatctagaggaagaataaatgagctccttgaagattcactgcagagaaattattccttgataccaaatataactgttctttcagatattcactataagatcatgtggcttcctgagtatgattcacagtaccattaagtattgaaggtcattctagctttcacatagcctgaaagcagaaaccatggatgtctaccaaaggaagactcaaattctatcttaatttaatactttgcctgctgcttttccttcagtggccatatcctgttctcactttcattttccagcccctaagataatgaatccaagttgtaggatgtttcctatgtatctgttatatcaaagcatgagatttttacatgtgtgagataataagagaattgtttcaaatccatttgttagggtatcaatgtattctaagcaccataccaagtttattttacatctcatatttatattctgcatttagtctgaatggcagttccatgaagtgagcactgttattattattcctagtttccagatatggtaaaataggcatagagaaatctgatggctaaacagaattccaggacgggggatatggcttagagagtaaggtgcttgctatgcaagcatgggggcctgagtttagatccccaatagccacataaacaaaaccactgggtaacattaccttcatctgtagtcacagcacttggtatgctgagatgggtggatcaaaggggctggcaggccagcaaggtaaatgaaaagggagttccatctttaccaagaggccttgttatggaaagtaaggttgaaaatgatcactgaagacaatgccatcctctaccttgtgcatgtgaatgctcaggtgaatacaccagaacacacattttcacatgcatgtgtgtatacaccacacgcacttatatataaaaactaaataaacagagctctaagtttttcaggagtaggatttgatcctatgcaatctattctcttggccagtacattgtcatccttagtcgctgaatgccacattgcatgtcctgtcttcaggttcagaaacacatgtgtggaggttatagctctatacagatggacagaaaatgagtctgggtttttacactttttaaaagatgcataatgtacatatttatatgttacaatgtaagctctcaatacatatataaagcataataaacaatgaatatattcatgtaattagcatgttcatcaacctaaatatgtatcaccatttcatgaatgcatgtgtatgttcatgcatgagtgtgctcctgcatgtgcttgtggggggaggggggaaacatttgaaataatctttactagatctttggaaataatatgattatgcttgccatctgtactatactaagctgtagaaattattctcaccatctgactatatacccttgtgtgctatagattaaactccattcctttcccctaacattctcaaaatattaagctgttttacctgtaccttaggtttaacacagagctaagtaaatatgctgtaatggcaaactggattcataagatattagtaagaaattaatatttactaagcaattcagaagacttttaaattatttctcaaataacactgaattgccattggctttactaacaacttttcaatttcttaagaagacataattttaggttaaaaatctccagttgcctgtaaaacagttcacggtttatatcttctttcataatttttaaaatacacactgatgtggtagcaagactaatgaatccccaaagatgcccatgtcctaatccctagaacctgtaaatgtttgcttacatgacaaaagggaattcaagttgctaataagccaatagggagacgatttggaattacccaggcaggcccagaataagcacaaagttcctgatacgtggaaggcagagggaggcaggaaaggagagtcagaggaaaagatatgaacagaagcagggtcgcagagagatgctttgtggctaattttggagatggagaaaggagtcacaagcccaaagatgatgggaatcctcttgaagctaaaagaaagcaagggagtagattaaacctgtattttaatctagtaagaccagtcacacttctaacctactgaactataatgtagtaaatctgtgttgttttaagccaccaagtttggagtaatttattatagcactagaaaactaatacggtcagccaaagattgattgttccgcttggctgtaacctatctctgaggttgaaaactcccacacttacagggacaagggaggagccataaattcatggcgtagaagtgtaagtctgaggtaacctggggaccacatgggtgaggtgaagaggccagctgctactttttgtcagctaaccatgaccttgtcccgttgagctaggttctttgctttgtctctttctatttccatctacttgctatgtagctgaggatgaatgtgaacttctggtcctcctgcctctatctccatggatggaacccaggacttcatgcatgccagttatgtactctccccaatgagttgcacccccaaataggttctttcttcttaaagccaccagccaggggacattgccctcacaaccataggtgtcctgtcacagggtgggaagaagctcttctgaagtctacattgcttccagctcaggagggcagccagcccagctcttgcagtcaggaggggcagaggtataactaaagccagaggctcataggattagaggtgtgctgggaggaaagcttctgtttgcttctagtatgtgactcttccaaataaagactactcagtaatcaatctcagtaagcaaatgggaagattattccagtgtacggttaactgagtacatttcccagtactggaggcaggtttatcctgggtgcagccggagtttcctgcatgctgggggcctctttctgtactgatgcaatggaaggtttagcaaccaataccacagaactgacccccagagaatcttcttttatcagaaaatccatgttttgagagtccttgctcagtcccagcaagccaggaaactgctgcagaagggcctaggtattcatcatcactcatgacaaataacagcccacggaagccacgcttctgtctttgtgttctatctgagtctccgtgatgggctggggcctcacaccagcctgcgtagccccttgaggctggcgattgtgcttcttctggaaagttatgtattcaaaagttttcaaattcattttaaaccatacaaacaaaaaattctgaatcttaaaaaatattctgcttgaatagctgggcctggtggcacaggcctataatcccagcacttgtaagatggctgcaggtggacagatctcgaggccagactggaatataaagggaaatgatgtttcatacaatcaaatcaggagcagtgctatgtagaatcagttctttaggatgtttgtaattatacacaacaacttctgcttttttcctgagacaggatttctcagtgtagtcctgtaactcacactgtatgtccggctggcttcaaactcagagatccacttgtctctttgtcccaagccctaggataaaagatcttctaagacctttgagctgtcacaaataagagaatcatgaatgaaggtataagaggaaaatgcgaaaaggtcagaagatacccagcatagttcagttgatttacaaaaggaatcagaaaactagttatttttgtgatcatttgagaaagcaaccatgcagccttatgcaatatcaacaacgcagccaatgcaaattatgcctggactactttcaaaaattaaacctcctgttgtaactgccagaactctgtcacatcgtttaagttgattgtgatggaccctacagaaaagaagggctggcacatagactttgctgagttcttaatgctggaataaaaattattttttccccagtgtattgttcccccgcaccagcccagaacagttaagtttagtcaataccattcactgcaattgtcattatcttccccaaagtgctttctgggtaacctcattatctgccaacaaagtatcacggagacatacaggcagtgaaagagctgctaatgatgtatctagcttcacagtgagacacagtcactctacagagtcacagtgcccaagcatttcctctccttaaggaggatgctggcctcacacagctcttgcaaaggcaaaggcgctgattgttgtctggagacagtgaatttttttttaaatttccagcacttgtaaattgccttgttgtgagcagtcatgttaagacaggacacgctttattacagtgagcaatttcctcagtttgtgctttctagctagtgagaaaccaccccatttcaattcctggaaaagaactggagagaagctgaagataatcatagagaatctatgatcacttaggcagaaactgcagtcccaagagaagcctatttggttggattatctttcttaagtagctgctagagacatctgctttattcaacttgttccctatcactgagtaaaattaatgtggactagatagctgcgctatcgggcatggccttcccctggtatttagaactatttttcctaagaagcataatgatatatggaataaggaaaaaatttgatcttgagggtggtttttagtttaaaagagttgcatattcttggctaagccttgggacacccacctttgtgcattttcttggctcagttttgatcacattccttaggctttctactccccattctcagcaattaaatgttgaagtgccttgctgtgttatcggggttgcaagttcaactgtctgatgtatgactcacttcgggtgcccttccttttttttttttttttccctacaaaagagagccatttgttatacatccagagcccagaagtctttattactctttgactgctgaaggataattctcttcttgctagggagaaagcagcaaatcaaaagaggatttcatccaagaaagcacatccaatatgaaagtaattgctaggagttcaaggtcactgtgtgtattggaacaaaagagggataagatctattactttgatttgctactccatttgaatgctccaatttactagactgcaccttacagtaaacaaaatggattaatacttgtttatcataggcagggggtttctgactaatttgcttttctgtttaatttctactcatttgctgactactgctcaaattccacttatttgatgcttcctgtatgccagacactcttaggaatcatcaaattcatcaccatatatacaaggactactttattatacatcctggaagatagaagcatcacatgtgacccttaaggctaaggacctcgttggagatgtgagacacagcataaaaatagttttttaatgggtgccccaataccaactccatgagcatggggtctgataaaaccaagccttgaaggaagggagtccctaaggagagtaagtgtgggtatggtatataaaaatcatgtgctagatgagcactggtagccatgctaggttaagttgattgattcctgagtatcctcctatgcgccagtttctcttttgctgatgtggagataaagatagtgatgagcacatagcactgtgtgagtggacatgagcagatcactcagagacactaaggcaggaaagcatgccagtcattgttattttatagtacgaggattataagaggccaggatctgacatgtgagcctgatcatgccagaaacatggcaccatcaaaaaaaaaaaaaagttgggtttgtaggctcttgcctgtaggccagtacttgggaaccttagagcaggaatatcaccgtgagattgaggctagtctaggctgtagagggagagtctgtctccaaggaagaaaaggaaggaaggaaggaaggaaggaaagaaggaagggagggagggagggagggagggagggagggagggagggagggagggagggaggaaaggagaaggaggaagaaacaggaggcgaggatagcaagaagttgagcaagaccaccattgaaataagtatgagaaaataatgtgtccacaatgacaagggaggattgtagctgccttctttcatggtttgcttcagattcatcttaaaaatctccagtgctcagctatgatagaattattcaggaaaagagaaaaaattactttattttgaacccagtttcccatagcgtagaattatgaaatctattaaaatgggacaggagtgtatgatgatacggaaagagatgagttatagggtgccagctttctggaagggggtctccagaaagacaatgcttttgccatcctagtttaactaagtgtcagttagttttctcataatgttttggggttttcttctttactgttccttctatctttgcatccttacaccattatacttgtgagacttaccgtgactcatgctccccccttttccttggagacaagagttgcacaatgcaaccccagactggtccttaacttgtaatcctttcacttgtgtctcaccagtactagggtcctgctttctccttttccatgctatcctgccattctgtttagtttaacacagccattaaatagaagcccctgcctcatttctacattgctgctggccctcctactctgtctcttatttttcagatcattccttcttaggacttctgcttgatataatgtagaggaagtacccacactctaggtaacacatataggtgagcacccttgcagtttattatataagatggtaaaaaggttttcctaattggaaagcagggtagtaggcatgggcagtccacctttcctgctcatcttccatctttgatgcaactgagtgacaacctttgttcctggtccagaagaggtctaaaatgttaccttcccaacatttcaggggcttgaaaagacttcgtatgacatgatccctgagataggctagtcttgaggatgcatgcttctcattagctaagatggggaattgtaatctgtgtttactatctaagaaaaataataaagccaaggagatgagaaggatgtgagcattacagagaagtagcattctatttcatgaaagtgttgataatatgctagaggatgaattaccatgtttttttctttttgaaaaacatgtatgcgctataagcattattgtggattctaaacaaaagttgaccttaacagtgtggaaagaaacagtaaaatttaagagatagataaatggaggtatatttggatagggttcacactgcaaaagagtgctacattgtttacaggtacttatagaaaaaccagtcaagtacggtcctgaaagaaagtggaaaggagattctgtgactattcaggcaagagaattccaggctaagggcaagaagagaaatgatttaaaggagtccctttggggttcttgactaatgacacataaagcagtgtagctggagtagtgtgattagatgcacaggcacaggctcaggagatggcttagttggtaaactgcttgccctccaagcatgaggagcttcatctggtcccccagaagtaatatataaaaaccaagtgctggcctgcttgtaatccccatgccaggaaggcagagatagaaggatcatggtgcttgctggtcagctagtctacccagctctgaggtccactgagagaccctgcttcaaaaaggatggagaaggctggagagatggctcagcgattaagaacactgactgctcttccagaggtcctgagttcaattcccagcacccacatggtggctcacaaccaactgcaatgggttctgatgccctcttctggtgtgtgtgaagacagtgaccgtgtactcacatttataaaataaataaattgtttaaaaataaagatggagagcaatcgaacacacacatatacacacagacacagacacacagtgacctgcggacatatgtaccatgttctaagctatggtaaagatgttatttatttaaaatctgttattattgttgttgtttttgttgttgttttgctgggtctttttgagtcagggtctcaaggagccaggattggtatcaagctcttgatcctccagcctccacatcccaagtgctagaattacagttatgtggcaaaatatctagcaattttatctatttcgtacaaacatgttacatgttaatgaggtaacatgagttttggaaacagatatacattttatcatgtttaaatttgattgagcacatattctcattattgtgaagactttcagtccttacttttttgaagtgtgcaggacatttcataatcacatgattatgtaatagcaccccagagctgcttcttcctctctggctgtcactgatgacccctcccccactgcctttcctctgcaccttccacagcttggattttgctctaacattagtgggaagccattgcaaagtttgagaaacactctttgtggatgtcacaggattctgacttcaatttaagtagtaaccactgtgaacttaaatatgttcttagtccctctgttaggcaaggtgggtggatatatatatatcctgtaaaataattatctattgctatccaaggactagaggcctttgaatgaaagctgtgatgtagaattattattttaacatctatcttctttctgaaatgtacaaaagtatttacctgtaaactaaatatttacatcttggaaaattttaagatattgtgcttctgatttcttcttgtttctgtaggttagagttaggatgttcctttcttcttcgaaaaaaatggaattccaaactttatagaagttaaaaccctaacatatagcagttctagagagatgcctcaggggttaagagcacttgctaatcttgcagaggactcaggtttcattctcggcatccacgtggcagcttataaccatcggcaactatggttgcaggggagctgatgccctctttggcctccattggcagtggtcatgcaagtgctgcacgtacatacatacatacatggaggcaaaacacccacacacataaaatgatttaaataattatttttcaaaaacaggtacatcatttgaatttgaattttagaatgagaagagatcagagccatctcccaatctgttgttcactcacaaactgttgtctacacaaggatggcttaaaaacaatcctaatccacatctgtgtagtcattgctactctggtatccgagacaagaggatcagttgacccaggagtaaaaggttatcctgagcaatgcagtgagacctccatttcaaaaaaagcaaactaaataattccttgctgtgcaaatattgtgcttctaacgtgtgggctcacgagtgtttgtgtgtattggcggtgtatctgtcagcccaggaaagttaatatgtaacttgttcagtgaactttttttaatgctgtggagcatctcacctgctagtgtatgtttgtgttagggggacataactgtcactaggaaagctaatgtgtaacttattcacgttcagtgaaatgattgtggagtctgacaaaatgattttcaaaatcatctgatctggtccaaccatgttacaagccaggagactaaaagaaaaacattgtcatgggaggccctgaatgatgggcaagatcctaagactctgacagatctgtttcttccaactgctcttttaggcagatgctctctctgacttgggaactacctccagcattactgtgaggggtaattgctaagttgcagggagtcatttcctacaatttcatatcctgttgctaatcttggaaggtggtggctgctgcagaatgtctttgcttggtgacacagctgtatgtgaaagcatttgtgcagactgtaatttgactctaggctacacatagtttgctctttgttcttccttctctggcctctctatgggccctgcaagcagatttggccagctgcatctctaaatctataaactttgagttttacatttggtaacatttaaaattttaattaggttgcaagtttttttaatcatattaattttgcccagaaatattctgatttttttttgtcatgagatcaatgtcataactttttttaaaaagtcatatttgcaccagatctcactgcttagtaaattattcactacaaacaagctcggtatataattttagggttttctggttctatcattttattaagaaatgtgaaccggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaagaaatgtgaaccattgtcagaaaaatccataaatggaaagaatatcatcaccagttttgttgtttttgagacaggatatcatattgcccagactggctttgaactcaccgtgtagccaaggaaggccttaaactcctgatccttcagcttcctgagagtttatgggcatgtgccaatctgcccagctatagtagccatttttgtttagtttaacaattttcatatatatatatatacacactatgtgtgtgtgtgtgtataatgttacatgtataatggtataatcattacttgttaaatatgcattcatatataatgaaatacttgagtacctcccatctaaaaaatcccatattcactgatttcagatttttggattaaggatgtattcttttaaaatgcttctctggccccaagcactttagttaaaggctattcgacttgtatataagcgtatgaaaaacataagtgcacatacaagcatattttctgtatttctgagtctcaataaagtaacatttatttgaagcactaaaaaacaagctggtgttttctgctttgtctcccttctgttgataaaatatattccatatggctactacctgaaatagaagctgccacatttatccatctaatttggtaaggggttcttaatactggtttatttatgtattcattcacaagtagatggcacttaagtccaaaatgtctttaagcattattattatcctactgctttttatttctaaaatgaaacagcccataacaaatctgtataattttactggttcatgctatagagaaataaatagttggtgttttgaaattctttgccaaaagcttacgtagttggcaggaattatccggccaaatgatgttcttttcataattaaagtcctttaaataccagaccacagatcatagtggatcatccgcaaatggcaagcttaagtcttaaggccagcttttgtgagtaagacattacacataggcatgtatttcctctgtgattacttggagtctgtttttttctgtctctgttaccattctcgttctgcagtggttttagacacactatcctgggaaattatgactggagtaagttttcctttcactatgataaatgcttgacacagcctgttgtttttgacctattgagagaaaaaacaaaaaacaaaaaaaaacaaaaaaaacaacaacatacaaatctcaaagtgttcctaaatgccctttgctctcccctttcattgtgttctatgggagtgttttgagggagaaagaaagggacagcatgaaggaattcaggcagtcttcctctttttcctcattcctgtgggctttgctgtgagttgtagcaaaagactactcccacctctgatctcatagcacagtcctctttggcatattgatttagacttcagcatgcaggcatccagcaactggtctgacagctcgtggttctctctgcttccctgggaggaatctgtatgtagggttttggagagcaagagccctgatccactataagtgtcatatgaggtaaaggtgatgtaaatgtatattcctttatatgcttggattgatggagataaaacaaagttggaaatgatccaattgtagcttgtaattagattaaaagggatgctgggtaaagaggccagtgattcatatgtaaaagtacttcatacatattaaggtgttagatactcaccatttcttatatgtttccttatctgagggtaaattacatactacctttaaagaaacaagaaacaaaaataaaaattaaacttatttatttatttggagggtgtgtgtgcataaatgtgcttgggtgtatgtatgagtacaggcttgcaacagcatatgtgtggatgtcagaggactatgtacaggagttggttctctccttccaccacttgagtcctgggtatcaaaatctgttcaacaagcttggtgtcaagtcccttaacctgagccttctcaccagctcagaaacctgattcttaaacatttctggagattgtctgactgttgttcagatatggtagctggcaagacgtttaaaatttttagttcaaataaacatccctactgttaatagtttatgttacaagtggatctttgctgcatttctcattataggtgttcaagagacggtatttttatttgactcaacttcctgatggttcatatattctcaattcttataaagatgagaaaaattccaaagagtctaaaggttgcatctacttggatgcctgcattgatgttgttcaggtaaggctattgcagtaatcattctttctctttcgctaagcaggttgttgatgaacaattaaaaatctaagcattctttccttcttggttgatgctatccccatgcccaaacacctatattaaaaatttccaaatcttctaagtacaccactttcattcagtgccaatatttaaaggtctatcaaacccatttgagtctgactccaaagtacttcttgatgcatattatcttttaattctgggctttttctctgagtatcccttgtattgcctgtcctagagttctgccttcttttttgttttgagattcctattattatcattatttttattatgagtacttgttgtgaatgtgggtatgtgcacatgagtgcaggtacccgtggaagcaagaagagggcattggattcccctgaagctggagttacaggcacttataccccgcttaaggtaggtactgagaactggactcaggccctatgaatgaactactaaacactgagccatctctctacccctaagtcttgccttcccaccttccaatttgctgttttatgtgagtccatcttccttcctgagacatacagtggatcattcagttgtattttcaaaacctttggatcttgatttcctgtcccacaatgaaagatttaaagaattcaaggcccatgggggttttcctttagcctatagtctaatttcatcccttttcattcctatataaatccatgttctgatcacaacacacagtatattccgtagagttaaggcatgtatatggcttccttatttattatttatttttgtgatgattagaattgaatttagttttgtgcatgctaagcaatatttgtagccaatgtttactgttgacacaaaaccttgctaaattgcccttatcttttaaaacttggtttacattccatttcaaccttaaagtgctttctgtttccttcctcgctttcatatccacaggtcaaatccagttccatgtcccctgggctatcatttggctcttacctttatcaaaaaccatactttaaattgtgttttgttctcttttggagttgtgttgcaaaacccgtctcactcattcctgtatctcctacaataattaataaggctgtgcacaccctagggagtagcaaatgtttattgatttggattactggagctatagacaaaggtcaggtgggaaagagatgtgcagaggaaatatttgaatgtaagtcaattgacagagggaaggagccttgagctgctgaagagggagtgctgattagttcaataactttagtttatctgaatccttattttcaaaactgtagtgttagattaatgagctccacgtactctatccaatactattccatgaggtgcaaatgcaaagaaattaaaccgtgagcatctgtgtaaattcaacatgttttttatctagttttgtttagtgtgcatggtgccaaggctggaacttcaggtcttaagtaaacttagcatcagccccagtccaaaggtgctttttaaatacaaaataatcacacctttgaattttactcaaaagaaaagacaggcacacatgatttctagattttctcaattagccctgatctagttccctttctttgtattgttcccacagacatccatttatgattccctcttcctagtattttccaatgcataaacctttacaacttgctacgctggcttaatttcatcctttcctatgccttgaagacagaaaaggaggaccttccttggtttcttcttgaataatgaccatgcagtagagaattattgatctatgggcctatgagtcttgacatgattgctgaggctctggaggggatactatgccacttcgtttgtcatgacagagaaggtggtaaaagaaaaaaatgtgttattgggtttgaaaacaggatgggtttttttcccttctattctaatatgtagtgtagaccactccacatattttaattagagtcacagtttaatgtgaaaccgttatgcccttcttttaccctagtgatgtatttgatactgttcattttgaaataaattgcatatgtgtaataatgagaaaatataaaggaagcattgtatttgtttcaggtcatattttcacttgcttctatcaccgagttttgaaaatctataaggaaagcacgaaaaaaattttgagtgaagatagcaaaatgcattcttgtttgaatggtggtggtttgcttttctaaatgtgaaagatcccaaagaccctaaatgattgatgccaacttcacccttactccattttgttccaaactgggaggagcatcaaagataggtttaacgtggtctgggagtttgtataccttattgaaagaagcaatgattttgtgaaagaattggtatacatataggctgagctgaggtaaaagtaacgtgcaaatgaatgcatttaatattaaagagggcagcttatctaattgaccaagtgtttccctttctccctttctctagtgccccaaaatgcgccgtcatgcttttgaactcaagatgttagataagtatagccattatctggcagctgaaacggagcaggaaatggaggaatggttgataatgttgaaaaagattattcagatcaatactgacagtttagtgcaagagaaaaaggacacagtcgaggcaatacaaggtaaggattttgaaatgatttgcgcttgaggtaaagccctcattttcaatccatagaaacatcctttgtgttaggtgaagatagaaccttaatattgaaggctaacctgcttctttatgaagagtggcttcagaagaggcttttcaaagagttggtactgcacaggacctgccatttaaaacacactcggaagaaatttgcaccagattttcaaaagtccattgaagcttttcctgtgctttcataatcccaattctttgtcataaatctagtaggaaaggatggagtgggagcaaggagagtcctcttaggttattagtaacgctctgtatggtttggaacatctgcttttaatgaatttgcagaggaggaaactagcagccaaggaaaagccgagaacatcatggccagtttggaaaggagcatgcatccggaactgatgaaggtatatctttcttatggcagcttgccttcccctgacacaaggcagggcaagatagtaaggttttagtgctagatttcatttggaaatgtcactttcaagttcaaaaccccaccaaacttgttaaacaggtagagagaaaagatacagtctaaatgatgcactgaaagtgtccactctcagtgtggaaaatctttttttctcctttctttctttctttctttctttctttctttctttctttctttctttctttctttctctctctctctctctctctctctttttatagacacaagagaaaagaagaaaaaaacattctaagcttttgtaacacctattttgtctatttttattcaatttgatttgatatataattaaataaatattcttctttcaatgggctaatgatgcagttcatgcaaatgatattcagcccaaagacacatggtaatttcttttgtaaattatgcaaataacttattcagataaagacttcggtgagcagctattgtttgtattgttttacccttctttgtggagtttgaaatgaacaaattttgaaagtagacagttattaccatgtgtatcttactctgtgttctatattataattaattgaaagtgacaaaactacttatttgtttcaatcgttgctgagtctacgtacatttttactttattcatttccctggcctggtgatacaaacttatttctgttttttctcttttcaatttagctctctctttaaaaatttaaaacgtctttaaattactgcactgtactcatgacctcattgctgtctatgatttagtggattttagtcgaatcctttttatatttttcagtcataatagactgtgcagttccttatcttccctaagactatagactcagcactgtatatgataacaggtgaaaagcactatggagatgtcagacatggtattggtctcttttatttcttgtttgcatccaaagtcttttagacttacatttttacactgagtactacatgtagaatattttagatcttatggaaatatataaagatcagatttgtttcttattatgagtctcaataatgtgatacagcggtgatgaagttgtataaatgacatggctaactggtatttagcattgttttgaaggaaatgtagcaacattatggctttttacattttagtatggcagagaaacagaacaactgaacaaactcagtagaggagacggaagacagaatctcttttctttcgactcagaggttcaggtattgatctatttctaattcaaacttgatcgagattgttttagatttgtcttattcacgttgaacatgtgtgttaactgaatcttcatttcataagactgttaatagcatggggctgagtgtatatatcttttcctcagtcctttcatcttgctgttcaccatggataaattagataatacctagcaataatttcagtattctctggatccattaagtacacctgtgatctagtgctagtgaatattcacaatataaagagtgctgaatgtaatgaactaaggcttttctccatttgatattggtatcaagaacaggaaaaatgtgtagtgtatggctctcagaatttccctcataaagaatatttcacaaaattatttggaggagtgaattctttgttttctttcccccttttctatatgaaaccctgttgaacagtttattattgttgctgttgttattgcgcgcgcgcctgtgtgtgtgtgtgtgtgtgtgtgtgtgtgtgtatgtgtgttatttgtatcccgtggcacacatgtggacgtcagaagacaacttggtggatttggtcctttaccccttaatgagccctggggattgaacttagaatttctaccatgtacggtagtgcctttagctgctgagtcatcttgattttgttttaaatataaaaaatatattatatgagcacagcaggatttagctcagtaaaagcatattaagagaatataaaataatttgagaaaaagatgattttgttatttctttttatgcttcatagagtactctaattgagtatgtataatgcatactttgataaaattaccatgtaaagttgatatcatgtgtggttcttgcatgtgtatttggggagggtatgtgcatacctttctgtgcacctgtgaagtccagaacttgacttgaaatattgtttcctatcactctccttataccttaaaatggatttctcactgagcctggagcccactgttttagctagacttgtcagcaaacccctgagatccatctgtctcttgtcatgttctccagctctgggcttacaggggtaccgtgttatgccaggatttcctgtggatatggaggctcccaatgaggtcttcatacttgcacagtaagcacttcagccagtgaccttaatgccagcgaattattttttttaaaaaacaacttctattttgccatagcaattctatatattgttttaatgtcaattatgtgatacatacatatagatgttggtgagatggtctagttagtaaagatgccaatgacttaaattcctagaaccccctttaaaggtggaaggagatgattctagaaaattgtcgtctgacccttgtgcatgtgctattgtatacataccaacacacacacatacacacacacacacacacactaacggacccgcacacacactaagtaagtaaatgtaataaaacatagatcagtgagtttcagagatggtagctctgagatactcattcagaaaactacttgttgcaagcatgacttagcctttgattgccctcagtgaatgggctgtaattggacatgtcaggctctttgacggagtacaaaggaggcaattgatggtggttgaaactaaatctagtatctttaaaaacttatgatgtagtgtttttgtggtcatgaaactgaactgatttttttatcagtgagctccagtgagagaaaacccacaaatgaatgaatgaatctttaaggaccatctttaagaatgtagtgttgattgtggaaggtcatctcaccacggagtaatgttgtgttaagaagaaaaggtgaaatgctatcccctaatttcaacttccttttctggtcacatttcaatgtagagagagaagatttttgcctgtgaccttaagggaataatgaaatgctattttgactgaagggatgtggatcaaactttaaactgtggggaaggccatatagctcaacgtttatacttggggcccatagaaagagaaggatttgggggaagaggtgctttgggccaattactcttcacattccaatgtccacattctgaagacagaaaatagagcagataaatgggcagaaattagaattgatctccatggcaatggcttgcctctgctggccccatagataagtgtttaaaagggctctgcctagtcccacacttgaattatttttgtagatagagtcagagtgaggaaaccatacattcagatacaaattttacacattagactctttacatagggcttttattatcgacacaggctgggtcaaaacagctataattatttagattcttcaggtataatacttgttttgatgaagtaactgaggaaaaaaatcttatagttcttggcttgattgttccttcttgtgaacagtctttggtcaaattcattttgagtcatttctcccctaccatgctatggcattaatgaaagtgtaagttgttccatagtctacacttggctttctgtttgcaactagaatggacaaaggtacttagactatgtgagccttgggaactggaagctttctctgaggaaacacagattcctaccctactcagaactgattcccagtatcttttgtttaaaaattgtatttatcttgaaatgcaagtactttttttttaaagaactgtatcctttatggtaattaaggcacattcctcagttctattataagctgagctcaagtttatctatcttctaggcagaaacctctctctctccctttccttctccccctccccctcccctggctccccccctccatcatttaaatgtaggtggttaccctgggtttcagccttggctgcctctcaccctagataccaatgactttccaatccttaccaacaacccagacctctcagttttccagccatgtaattacctcaaactcaaaacatccctaactgaattgctcatttctattcacctttacccccaaatctatcattcatttgtatgacacaatgaagtttttgacttcagtgtctctgagatctcctgggtctgacaccactttgttgttcttgttgccttttaaacctattcttgttagtctgacctcctaaagagcttgtgaaggaaacaaatcttactggctttgaggatatattttatgaataagaagaggaggaggaggaggcaggaggtagaggagcaggaggagcaggagaagaagaaccaattaaataatactaaaaaataatgttagataaatctaagaaaggacatatagactgtccggatgtatgcattttttttttacagggagttggggatgtgttcattgctttaggtcaggttctcatcatctccttccaagagttctctgtcagctctcaaaagttgctataaagtcttctgacaaatcttgttgaatgaaggcattaaagggggtggggttcaaatggacagagctattggattctgctgccaattctaatatgctgatctgaatctgtatctatcagtgttattatgaatactgtcttcttaaacaactcatactatctgtttttgcagagattagacttttcaggaattgagcctgatgtaaagccatttgaagaaaagtgcaacaagcgtttcatggtgaattgccatgatttaactttcaatatcttgggtcacattggagacaatgcaaaaggaccacccacaaatgtatgtatgaccctttcttctactgtgctggacccagcatattaaagaaatacctttcttttttataagtaagaactaattggcaggatgaaaattccagtgttaaatattatgataaatttggcatgaagaatttcatctttttcttttggccaaaatacaaaggtgttctcatcttgagagaattcctgcaaatcttacctcctcagagtagcacatagagaatgtgctctcttcaggacaggcatgtccctagaagctggaaaaaaatctgccctcacactggatttgactaaggaataggatttcttttagaaaattggttcatagaaattaattagtttccccaagccttagtgagacatagatgctgtttagtctgctaggctcactcattatcctatagaatgaaattcattcttggtctgtgtaaatattaggtatcatgagttgacgtggtctgaaatacttgccactgtaaatttcaaatattcagagagactatataatgttcatctttattttgggtttctagtttcaaaaatatcaagtaaagatattctttcacaaagtacctaaaacacatcagagcactttcctgcctgcaaagggttaatctttatgccatctggcatgaaatttctctttgtgagcagctttcaaatgccatctgtaaggaggaatcatgtcttccaaatttgctgatggggcagagcattttttgagtagttcactgttgactgatgctggcttttatgaattgtatagtctagtacattgcagtataccagaaagtaattgttttctaatctataagttagcaatttttggagtcatatcagtaaatgtatagagatataagttttatttgtagatcaatttttctttaggtgaaacttttgaatcctgttcatctttttaaaactataacttgttaatttttgtgaattcataccttggaaatttatacctgacaaaattaactttttatcttaatttaaaaattaaaattaaaattaaaagtcttatttctgaatgcctctcctgttattcgatgcataacaagcataatgcacttttaattaactaaatactaaactcagaagataacacaataaactcaaacttgaagggaaaaaaaacccgcattatgcaacttttctccaaaagtcttagttttaaaatgccaactgtcttcattcctaggttgagccctttttcatcaacctcgccttatttgatgtaaagaacaattgtaaaatttcagcagactttcatgtagatttgaacccaccctctgtccgtgaaatgctgtggggtacctcgacccaactgtccaatgatgggaatgcaaagggcttttcacctgagtctctcatccatggaattgctgagtctcagttatgctacataaagcaggtgagtgttgatcagtttgcagcaacttcagaacaagagagagaagcgcctttccttattttctcgtttcaggcaattgtcttatagcattccaccttttagaaggtctgtctacaaatggtcttttgctgactgaggttggcaatgggaaatgaaaagcgatgaacatgttagtcacattttggcagagtgacatttttaggtagaaccatggtaggaaatccaatgggaatattttgggaagtccaatgcaaatgtagcgccagatatacacatgtgaatacatgtacacatgtacacacacacatacctcctctgcataagtgccaaaacattgggaattttagggtcagatattatgttcattgctataggttttttaaggactctgggtctgtgatagcttttccatagattaaaatccatgtagcctctttgcttgttctttagataatagttgccagatacaggaacattcaccaacaatgggaaaagctcacaaaagagaagttgacaaagtacagcattcttaattagtatatgagaacccgatattgaattctatgtttctagtttccaacataatgtcgaataagtattcttaagtctgtttattgtattatttcaaaatattggatgttgagataggaacttcagtggatcaggtgattgatcgggtggcattcagtaatctacatcaagaagaaagttatcattgttgttattttggtattgagatgaagttgtattgatccaggctggtctggaatgcctggactaaagatattctcctgccttagccttctgagtagctggacctacaggtttaggccaccatacctaatctcaacacttaaaaaaaatgtcctttctgtgctaacatttccactggggtcttgcataatcaaaatagttttgtggcatgacataagtgttattccttcacaggcaagcaaattgacgattgggggttgggtaagctgtccatcatgacatagctaagagtgctaaagataggatttgaacctatatctgaaagatctcaagcaacagtattagaaagaatgccatgtaactaagttgtatgacatgtaccatcaccacaagcactgctggatcctgggaattgtattaggagtggagtgaggatgttgatatattctttagaagaaggtggcagtgaaatggctaggagtcaccccggtgaaaaagaattaaaccagagcctttggcacagaggaccaaagtctcagccaacaacgggctttctttagtaactttctacatcaagggacagggagatgctagacagttatggggtcacatgcagaaccccaaagggtgtgccctacccctgcattgtagcccttgtcagtaaaaacaaaatggacttctaggagctggggagatggctcaccgtgtaagtacctgctgctcaagtgtgaggaccagaacagatctctaaatatgcatataagccaggaaggcttagtggtctttctataatcccagcacacagacaaaggatctcagagacagagataggatattctggagcaagatgactatccaggctagtcaacatggtaagctctaggttcacttagagacccttcctcagtgtttaaaatggaaagccactgaggaaggcaactggtgtcaaccttgggttcccacatgcacacacataacacatgtgtatcgtacattctaaggaacacatacatcttcacacaccacatacatacatatagataataaatgaacctctgtgtgcctcactaccctctcctctaaagtgagagcagtgacactcctacttcccatggccataatgggggttagacaagatgtactatccctagaaagcactctgcaacaggcacacccaccttgttccatgcaacaccttttctcaactcagtgtgcctgttatgggtatctaagtgagcttagataaaggagggaaaacatgtgcttttatcaattgccaagaattattaaaatataacattcattgctggctttagtgtggataaattccaaggtggctggaatgggaaataataggtactcagagaaaggtagcaataccaatggtcagtttgactattctaacctgtccacatcatgtgacatactggtgcatggaccatttggaagccgaggatgcaatcttcttcactgtccccttactatataagtatctctgagcctctgtttctgaatcctttaaatgtgtacataactagtggcttcactactactcagtagggagaagaaaataatctatgagaagtagagggagagagggatttgggagggagagaggagggagagggaaagagtagctagttcagatatgggagaaaatgggggaggaagtacagagggtcaggaatttgaaaataggtgtgtagcagtgggggagggggaactggggggtagccactagaaagtcccagatgcaagggacccaagaggttctcaggacccaacagggaggactttagcctaaatacccaacaaaggggagatagaacctgtagagatcatatctagtggataggtacagcccccagttgagggatggagccacccacccaactcaaaaatattaatccagaattcctgctgtcaaaagaaaatgcagggacaaagagtggagcggagactgaaggaaaggccatccagaaactgctccacctagggatccatcccatctgcagataccaaatggggaaccccttggtcctgtggaggcttgatgacccagaataagggaactctaggcctctgaggcaggagtggttgggtgggtgagagagcaccctcgtagaggcagggggagggagggggcttgtggatgggaaactgagaagggagataacatttgaaatgtaaataaataaaataaccaattaaaacatgttgaaaatgaaagtgcagtaagataaagcatacagttaggcatagttatgcataaattatttgacatgaattagacttaattgggcatgatagtatataccagctgcttgagcctgggaactccaggccagcttagccaacatagcaagatgggtatgtggcgagaagagagggaggaaggaagaattggaaggagggagggagggagggaggaagggagggagggaggaagggaggaaagaattggtcaagtcaggtaagaagaaagagatggtaaggaagagaaatggagaagggaagggaaggagaaaaattggaaggagaggaaatgttaaaaatgggaagggaagaaaaactgaaaatgaagcatttaggaaatccaagaaattaaactggacaaataaattcaaatgggaagccactataaacgcctaagacttgaatgttgcaggtgtagctttttggaatgtattaacagactactatttccatcagccagaaggctaaggaatgtcatcagatagcacctgaagcctctacagagctttctttcaagtaatctacctagctgatgactttacggatggatttgaaaagtgccttgatttataaattcctttgttctatatctgtaaaaatttctcaacacagttaccacattggaacatgggattttgggtaacgtgaatctgtgttagcaggccatgattgcccatgtttggctccagaatcaactgtctcttatgcccctaaaataaaaacaataatcaaaatagaaaggactgaatgcaagtttcagttctgagcacacaccttctgcagttgcagcatgtcaatctattagcccagctaaagagcaaatgtctttccagcaataccagaaaccaggttctgtgactatggtatagtttgataggccaccctagtgataatcagacacctaatatgtgttattgcatcaccccatgtaagaaacttctgataacaatattattctcagtcccatcacttcataggacctgagatgtagaaacccgagatgtaggaatggccaagccagaaatgaacccaagcagtctaactcctcaaccatatttttaccttgttccatgtttgtttgtgcttgttgcttggtaatccatcatccagacttgccataaattctttgaattggctggggaggagacactgctaacccctcacactgttttatgctgtgctttgtcaaattttgaagcttcagtttagaactcatgaggtaatatgtctgcaatgctttgaaaactagaaagcaatattaacaaagttggtaatacaccaagtaggaaaagaaaacttggtaaagacccactgatgggttattttatacaaattcatttgatgttccttcaagtatgcgacaaaaaccactgacacaatatttagagaatttctctctctctctctctctctctctctctctctctctctctctttctctttttggaaagacaaaagatggtatggttattctacacacattcaaataaaatgatgtcactttggctgtatccacatgggtgcccttaaagagaggatggagacactaggcaagttctagagcctctgctgcttctttttactttgacagcaccaaagcttttaaactgcagagttttccataagatggtttgtgtgtgtgtgtgtgtgtgtgtgtgtgtgtgtgtgtgtattgcctgtatgggtccatgtgagtatatgtatataaatgtgcatgcaggtgtggagggcagagttcaacaatagtatcttcctcagtcactctttaccttcttttttcttttttttttttttgaagaaatttaatttttcatttatttatttacttggctttaatcatgtgtatgtcaaagtatgcatatatggacaaatgtgtgtgaatgtctacagaggccagaagactgttaggctcctagacctggagatacaggtgtttgttagccccacccccaacatgggggctgggaactgagaactgaactcttggcctttgcaaaaggcaactttctagtttcctccactttttaaattttatttattttatttatttttgagccagcatctctcggtgaatctggatctcttgcatccagctggactggttgaccagtaaactccagggatttacccgttttctccctagcactgggattacaggccgactgctggctttctgtgactgccaaactcaggtgctcacgcttgtgtgtcaaatgcttgatcaccccgccaattttctcagccccagatggtgagtttttgtgttagggaagcagtggaagtgtgttcttccttcttcactgtattcagtatgaattgtgagcgaattgcttggtagatctagctacttgggagacacggtatctttagtatataccaattaaaccaaacgatgtctattgtgttcattaggtctaagaactcaccttgcaaaacagccacggagaaggagcttggatgcatagggtgacactaatgacgaaataggaactgcatttggaagctttggaatctgtagcaaaagcagccagcactaccctgtggatagggtggggcgcaccgagggtaccagtgcttcagcattcaggtggcaggggcaggacggttgcttcaacttctaacctagcatgggctatgtatagctagactgtctcaaaagcagaaagcaccccaaacaacaaaaatgttctacctcttcctggaatcctggacatgatcctatgttgaatatcaacattctgtactctccacactacaagatatcagttgccaaacagccatatgtatgttacataaaaatatctaacagaagtcattttccccctagggaatcttctcagtgacgaacccacatcctgaaattttcctagttgtgagaattgaaaaggtgctgcagggaaacatcacacactgtgcagaaccctacatcaaaaactcagatccgataaaggtaattgaaaattggtacatattcctgctcaatagagaactcacccttttctggtattttaaaatagcattgtcagagacctttgtgatgaaaaatgatcttctctgaggactttttacattgtctactatggaaaactgtacctatatccactccaaggagtttattatcaatgtattgacttcaaagggctgctgttcactgtggtccatctcactctttatactatttcagtgtgatttctttcatgatgtgttcacatagtacatggtagggattttccattttctttttcctgaatgttcttaaatggcaaaattaaaagtttgccatttttatcattatcaaaatccttaaatcatgacatctgactggttagaaactgaatcctgtcctctcgtgtaataaatgagaaatctgagacctagggaagggaaggatttgtggagcaattaattcatacaaccatagttattgtgcaatttaagagtcatcaatctattgaatgttagattttactgtgctcacgtaatatttattaagaggaagatgctgaggaggcatgactaataggtgggggactttatttgcagtgtacacaaaagcctttagcattttgtatccccagggataagcatccagccagtgcttcgacgcctatttaggccttataggcagcttatcctctttgtcatctctcattgcctgttcaaacagcagctgctgcccacatgagactaattgcattgactcttgtcacttgtgccttatcttgggagtagaaggtcaactgtatctagaacaaacttcccctgtgaataatgagtatctgccagcagcgtggaaggaaatacacgttaacactactcaaagtgttcctagcagaagtctgtggtacaaaggagtccaatatctcattagtctgtcttctgaaatgaagaaaagagttgttagggagaaaacaacatacctttaagaattacttttttggctagggatatggctcagtggtagagtataaggctgttgctttgatctccagcataaaatacatacgcgcacacacacacacacacacacagagacagagacagacagagagactgagagacagagacagacagagagatagaatctaaaaagaaatgctttagttttagccttgaaaatgggtagcaaagatatattttaatatttatttatagctgtttccttccaggatttttggtgtgttataatgatgaattggggggaggtttaaagatgaatccatggcatatcgaacaaatctaaactcatctttttttctgaccatagacagcccagaaggtacacaggacagctaaacaagtgtgtagtcgccttggacaatacagaatgccatttgcttgggcagccaggttcgtgtaaatgcaatcctgacccttctatttttagttctcttaaattggggaccaatgtccttaccagcaattcagtggtccatttctggcaggctattagttgtgtcttgggacacttgggatggaaagcttcttcagactttgctatgcatctaagacctacttccaaaactctgcctgtgtgatgggaaatttcttttggtttgggttaatctgatggacactatttaatcttttattttaacacagctcattgctaaagtgatagaattttccctaaagaactagattatacaacaaattatgtacaatatgtccagtttttcagagttggctgaatttatggctttaaaacctatcggctgggcagtggtggcacacgcctttaatcccatcacttgggaggcagaggcaggcagatttctgagttcaaggatagcctggtctacagagtaagttccaggatagtctgggctatacagagaaaccctgtcttgaaaatcaaaccaaaacaaaaatatatcagaatcattctgggaaaaatgtactaaaaattttgatggcaaagaatacagtcatgaagtgcaaacttataattaatagattttctggtgaatcctgtgggaatcatgcttttggaaacatacattttctatgattcttatgttatagtagcttatgacagtgttttatccaaatcttgcaaatctacaggcaatgaggatttgaagcctgtttcttgtttatccccactttgaagtgtaaattcatcagctggtttgtggtacagcctgtacaactgactggaagttcttgggaaagggcatcatgttctgaataattcaatcaactatgttctctgggtgctagggaatagcacagggtaggagagttgaagtgaatcaacccttctgtcactatagccatttcatttggggtaaggatctcaaaatatatcatgtgctaataaatgacaaggcactattttccttgtttctcatactagtaaaacaaatgattgcctaggataggtgactggcaaaaactaatgcaggctggtattctagaagggaaattgtggcttataaaatatacacatatacttaattgtatctaccttaaaagtccatttctgctgctactactctttattattaataataataaagtttaactctgtccagaacactcacttatctaagtacttaatgcatattttgtttacatattttttaatacatttttttgccttgtaactccacttactctagagctcactattatgtcgaccaggctgtctttgaacttgcagcaatttcatgcccttgtcttgagaatgctgttatcacagccattcactcctatgctgggcctaatatataaatatatatttaagagatgggtaccactgccccatctttgagatgaggaaatggagacacagacggaaaggataaagaaaatgaaacccacatctaaactttagaccatgtagcagagtggatatcagcatatgggctatcccacattagcactgattctagaccactgtggcagtctcctgctcttaggcagttacagacactgcctgttgctcttttgccaggtgagttaattcattctgaaaacttcagagagaaactctgatccccccagttctagtgaggcattatgctgctttctcctgcctggattttttttcccatcagctgcagtatcgggatttactaagtcttgtccaggacatttaaaaagcgtatgataagcccctgttactagaaataaatattttaaagcaggagcaatgggctttgctgaggagtgtcgggtttctggctattgctacttccagtgcattaggggctcctatattactttccattttagcagcaaaatagctgcttaaaatggtagaagaggctgggtgtggtggtgcacacatctttaataccagcacttaggaagtagagggaggaggcagacagatctttaagttcaaggccagcctgtttcagaccagccaaggctaccaagtgaaaccctgtctcaaaaaaaaaaaaaaaaaaaaaaaagagttggggaaagcctctcaaaatcatatgattatatatgtagtaaactttatataaaattatgtttaggagccaatgtaatttttaatttttatcagttttatggagataaaatgaattatatatatatccacattaataaattttcacaaatacaacgaccactttaacaatgactggtacaatatagacagaaaggttcctcatggccctgtctaggcacccaggcaaccatccatctgattatcattggataaaattttgtctctcctgaactcatcattaaagtggaatcctgcagcatatgttcctgggattggttatgtgtactcagtatgcttttgagattcgttcctgttgtgtagaattccttttgggtggcattccactgcataatatgccagtttgttcattcatttactggatcaacttctgatgtattaccagtttggagtaaattttctgtgagcatccaggtagcatgtggaaccatgcccagaactacaatggcattgctgtagggtaggtggtgtgtgcttcactttgtgagaccccaccagagcactgtcatgcatgtttacagtttcgcattcacacaggtacaagttgagtttattggtacttcaaattttgtcttaaaagcctttctgttgctgttctagacccattttcaaagatgttcagggctctctggatctggatgggagattttcccctttgtataaacaagacagtagcaagctttcaaatgaagatattctcaagttgctctcagaatacaaaaagtaagtgtgtgacattgttatactaaatgaaaggaatggataaattaatgaatttctaaagtactaaatatgagttatatatgggcaaaattgaatacttaaaaatttgagattggaattcaggtaaccaatgcatgtaacagtcatcatactttacctctaaactattattgatttctacctaggccagagaagacaaaattgcagattatccctggacagctgagtatcacagtggaatgtgttcctgtagatttaccaagtaaggatgtattacatacaatacaattgacaattgtaatcagaacttgagtatctatcaacagtttactgcaggtttgcacagagttttaatttcctagggctttgcggaccagcaagggaaggagctagctagcaaaggatgtttggggtcatatgttgcagactgaggacatcctatatattgtaaaaaccttgagatagaagcattcttaatttgtatgaatagagaggaagttggtgtggctccgtggtaggatgtggtgggaacaatggaacaggaaatggtagtagaaaaagaatatacagaattatatagagtggtaaccccttagatctgtattttattttaagtacactgagaaatcactaaaggattgcacccagggaacaatacccaatgtgcatttaaaaatatataagagtgaaatagatattttttccataaaaagaatcattgaagggaatagagaaatggcccagtagttactgctcttccagaggacccaaatttaggtcccgccacctatatttggctgctcacaaccacttgtaactccagctttaggaaatctgacaacctagcctctgcaggcacctaaacacatgaatacgtgcacgcgcacgcacacacacacacacacacacagtcaaggaaatctttaataagataattgaaatataggcaggagttgatgcatatgcacacagattttttttttacaatgttctttaacttagagggaacttggaagctaacagaatcaagactgtcagtgtgcttcgaggacttattgcacagcattaccataaaactggatgcaatgattgaaattggtgtttataatttgttcaatgagatatcagataaactatcaagattgagttgtgtacacaccctgagactttaactttgctgtgtaaaaatgtgcatagagaggagactagaagacaacacaggcaaatatccatgctagttatctgtggtagtacaatgcaatgactgattgccattgtaaatctttaatttgtgcctccagaggttctattattagcatgcattgttttagtaatcagaaaaaaaaacccaactataacaaaaatgctgtgtccttaggctcagtttagcctgggtcttccttccacccacatgactggacaataaagaaagggtcgtatggctcttgacctctcctacaatggcagcttcagaaacacatatggttcaattgctcagacattttgtgtgttttattttattatggtaacacatcataaggtctataatttcaaaagaaacttccattattttgtagtgaaaatttgcacctgcaccaagttacctttttaaaagtgattcgccatgagctaattggaagcataaattttctctcattgctttcccggataccaataaaaacttgcagcgaaagctaaaattgcagccacaggagggaaaatgcagtgggtttcttcgcagagtttgaatttgtccaaattatgatgtgttatatttggcaaatcattcagtgttgagaatgaaatcacaacccatgtctggtgtaaagggtaaaatcagcactcactatgtccttttagggttcttaaagttgtttaactttttgtcaccaactaagaattctgttttgaaatcattctttgcaaacacagcccgtgtatttctagaaatgcaggaacgtgttaatgactgttaagttacatgcttatttgtgtcctaccatagattgtattacctcttcatatgtgcccctgaagccttttgaaaagaattgtcagaatattactgtggaggttgaagagtttgttccagaaatgacaaaatattgttatccattcactatttacaaaaatcatctgtatgtatatcccttgcaattaaaatatgacagccagaaatcgtttgccaaggtaagaaaagtatacattcttggagcgtgccatattattgatcatctgctcactgcgtgactcactttggctgattaatgattttaggctaggaacattgctgtctgtgtggaattccgggattcggatgaaagtgacgcgtctgcgctaaaggtttgtttatggtggtgatctgtgtgtctttttggaaaagattgtggagatgaaaatttagtacttgatggtgtcatgctgtaagcttaatgtctttgtatttcaacaagaaaatatgctggagtggcaaagataatatttcatttcctactattacatgtgaactaaagggtttgtttaaatgatctatagtcaaaggtagtgtagatatgagctgagaagatgggcaaatgtgggctggggatgtttatctatatgatggtcctgctctgtagtatttgcctagcatgtacaaggccctgggttccatcttgaacatgagaaagtggatgaggttcccttattcccttttgacatttattccacttgaatttgcattgcttagaggtccaatcacaaggtcatttttttaaatgactaaatagtttataatgtttccttcaggaggccttatagtgttactattaggagaccttcaactcctttctctttgaaacctgaacaggcttgttgagctacaggagcacagcatgatggctttgatctgagctaggacttttgctccacaactggccaaacagtgcctccaaacttggcactgtgatctctccaaggcagagtctcagtagcatgcagtgcagccatgaatacccattatgatgcagtgcctttatggttttactataaacttcttcttcttcttgagcccagtgatcagaaacctgagacagaagccccaaacaatgcagccatcacaaagtgtgtatatggttccgtgcttctagcttgaatctaaagcagtcatactgtaacccactagagaaagataccccagcactcccaactaaatggtcgaatattgtactgcccctgtgtttgaaaggcgctccctctctcccaaagagaacattaaattcaattaaggattagctggctcaaatgcagtggaatttttcctccctctgcttgtctcttcagtagggatgagaacaaccagttccctttcctccttaaaatatcctttgagtatcatgtagaaacccttaggttacttctcagcagttctt

SEQ ID NO: 391 - DNA, 187898 bp, mus musculus
cttaggccactcaggtcggggcccttggtgagagggagcagccgccgccgcccggcaggacccagagcctgcaaaagctagagcaaaaaggagggaaagagggaggagcggcgcgcgggaggaggagccgcgggagctgggcgcggggcggcgagctgagatgtggccggcccgtcggcgtgtaaacacaggcagcagcagcagcagcggccgcccgggcccggggcactgagcgctcccgccgagacctgcccgccacctctgccatggccgaagtgcgcaaattcaccaagcggctgagcaagccaggcacggcagccgagctccgccagagcgtgtcggaggccgtgcggggctccgtggtgctggtgagtggtcgagcgacggggagtcccgggggggggggggttcgctcacaccgggagcagcgcggtggcttcccgcgcgcgcgctggagaccacgggcaggatgggcgcagctgcggtcgagcgctaggagctctctttttcctctgttctacttaagttttcgctctggcaaccggctgcctgggggtgggagtctcaggcgccacgggacagcgctctggctaccccaccagcttgcgctgggctggaagctgaatggcacagcgggtttcacagagctgcggccggagagtgggtctccaccccagcgggggcggctgaaagcttcagatcgcacctcccgctcccccggacccccgcacaaagagctggagattagggcacgaggagatccggatccctttaagagggcacctggggcagcctaggcggaaggatgcgatgagcacagatatacttgagtgcggatacacatcgggtacacgcgcgcacacacacacactcacttacacacacaaaaaaccccacccaaaagcccagggcgcccaagctctggcgggcgatgtggacagaggaagcatagcgacttcctcctgctactggggagagggagggtggtgatgggtgttgaggggtactgccaactaagacagagggagaggattggaaacaacgggggtgggtctgcgcctgagtgggttttgagtctgtatcctctgggagaggatggttcttaagacttgtgagcgattggaggcaagaggatgtgggaaggactggatgttgctgtgtaaggatgaagaccctagaaccagacgcctacgtagactattggggatgtcttggcggcgggtagagctgggggatggggattggagagtgttctgacacccccctcggggaaccacccctcccccgcacgccagcgcaccctcatcagtcctgttcagatggtctaaatctggagggaagccttggatggtaaggggcacttgctcctttgcttttaaaggctcccattgccaattttttggactagggaccaaaccttaaataagcagtgggactaaatcattagcgtgcttttttgttactttgttttgcaggagatttgctggcttttgtctctttccactcctatattatttcatgtcattcgctgtgtttaaatctccgcacttaagagagagctttttgttagcacaacttatcctgggaagggaacctcgcagcttttccctgtaatttttatgttgatcttgtagaatcggcaataaaaccaacattaaagcaaggcaaggggcctgatcctaacagtggggaaagttgacattagtgggaattctggaagaggatcaaaggtaaaatatgtacctttgagataaaaatcggatttctaatagctgcaactgtgcagagccaagggactttaaagaaatgtctttatcatggctggacccttgaagtttaatcctgctgcttggtgaggctaaacccagacctttaatgttgtcttaatggatttggcttattgtatatttcacccagatttggagccagaacctgttgaggtcagatcagaacctcacttgtcatcagggccatttgagagaggaccacaagctgtgtgcaaggcattttataccaggttgtcatcttcagtggttattagcaagtgatccagacagcctagcacaaggatggcttttctaaaatcataaagcaaaccttctctgaggagtggctggccacctaccatagcatgtgaagagagagggaagatggacagatggtatcaagaaaatatatgaggcacagacaacctctgctgggatttgaccagcatttgacctgcctccctcaacagtaaaaagttattattctttctgaagttttaggctttgaaaagatcagttttgagacatggtctcactctgtagcccaggctagaactttggttttgtacttggtgttagtcctcctgcttcagcttactggatgctaggactacagacatgtgccacctataatttttgtgcagcacaggtgcagtggcttctttctacctcttcattcttggcagtgctggaaaaaaaaaatctattaatagagaaagactcttggagctacagcccgtggccggggtttcctggttagctgaccttacttaggttctttttttttttttttttttttttttttttttagcttttatgcaagggaatgtagaggagtgaaatctactcatttctgtggtatgtgatgtgtattaagacttgaggggagggcgagttgaatgagaagtttcttgtgctctaaatcaatccattgagcccttacactgtgtaagacatgatgttaggtgctttaggaccttttattcatttatttagttccaatctaaggggtgtgtgtgtgtgtgtgtgtgtgtgtgtgagagagagagagagagagagagagagaaactaatcgatatcagggtcttcaataatgctatttgtcaattaagagataaataactctaaacagtatattcactctcatatattactttccctcctgtttgttgttgttgttgtttggttggttggttgttgttgtttacttcataggcctgttaaccagaggtaggaaagcagggggtgactggagagcaaaacaaccacgctgcagctgctgtcagcttctggttcagttctgatgtaagccccaagtgtttattgagggacagctgaggtgggatttacacttgctgccataaacccaagatagtattagagtttcagcataagttggagtcattagcacagcagggcacacttttcttcccatgtaattcttgacagaacttggaaaccctaccaagctgaacaaatatacactatttccggtttagttttttttttcttttttacagttacacccttattggcatgcccataacgtcattcagttttgctcactgttcaaaaaaatgcacaaggcttgggccctggctatatatagcatgtcattattagtatttccatgaatctattaactatgtaatgaaacgagcagagaaagagaggctgcttcacggctgcatgttctagtgagttcagcatttttatgaagatcagttttaaaccagggaaaggaataattatcaaatcgccattgactaggataccttaagagagccttgggaagtggcaagataagccaccagtgagcacagaggctaatggaaaatgttcacatacatgcatttttaaagtgcagagttatgtggtttttgttatacttcaggttatagttcttggtgcctggtgcggatcaaaaacatgtgagaaacctgctgtatctcctagtaggggtttaagtagtgcttgctacgtatgatcaccaaaaagttgttagatattattacttgaggcaaggtaatttggatacgtcctttggctggtgtcaagggatttcaaattagagtagctagctctctagaattgagaaaggctgacaagggtcagcagctgttcacttcctccatccgccattcacaactcctttgagcagagtggctgtcttgcttgcctttaggcgagagctggaaaactcagcagctagcttctgttccttcttcccaggggggttgtggaaagtacttaatgtaggacaaaatctacagcttcatttggaaggacgtgacatttccactgtggaataaagtgagattcaacttggactttcccctctctgatgttggggacagaactcatggctctgaagtgtgctagatgttaatctactacttagccacactcttagcaacttggctgtgcttgtttacttacttgactcataatgttcctaactcagcctcctgaatgctaggggcttacaggtatgtacctccatacctggcttcaattttggcttcttgagcatgcctttccagttcaaagatttagttgggttcttattgagctgagagtgagatagttagccacagccttggcacctgaacataagaatcccttattattccttttggtagcttctcttgttagaaggctttggggtgacacactcctctaaagtttgtccaaaggaccaactcagttttttaggaaaccaaagaccatttcactgagccttcactgaagcagcaaatagaatctttatactctctttttggtgcaagtgtgtgtgtgtgtgtgtgtgtgtacacatgcagaaatcagagaacactggtgtcctgttctgtcacttgacaactaattcccttgaatcaaggcctctcagtcaccagaactagccattctttggctagactgatctatcttcttgtctctggacccatttccactatgcccacagccacacctagcttttaaacgaggtgttggggacataaatttaaatactcatactggaacagcaagtattcttatacacttttctttcttcccagtcctagaatttgttttctaagtttagcatgttaaggccatcctccagattgagactttccatattctgattaccagtgatctttctttaaacatttattgctttgccacttaaaaatacttattcattaaagaaatcttagaagagaaaaaatgaaagtgtcactatgtcagaaggaactcaatattctaatgtatgtattttgacttttatatataaatatttaaatgtttttatattgtggtcatgcaaaacctctagccagcccttaagtaacttttctcttatctatatctcatttatatttgctcatagtagccaacctactcttgcataagcatatttaatagaattgtcaacaatcttattaggagtttttatagataaagcatccttcattggtttattctttatagtttttagatatattttgtgtgtgtgtgtgtgtgtgtgtgtgtgtgtgtgtgtgtgtgtgtgcatgcatgtattgtttgtgtgtatacgtgcccatgtgtgcatctaggcattttcatcacagtgcctatgtggaggtcagaggacacttttcaggagttgcttctctgctgctttgttaaggcggggcctctcttggttttggtgagctgtatactccaggctagttggcccagaagctcctaggcaattctcttgtctcaacctcacatctctcagcgggagggggcctggaaggacaggcccctacacctgaaggacaggcccctacacctggctttttatgtgtgttccagggactaaactcaggtcatcaggcttgctttgctagcccttttacctgagctgtctccctggcccagtagtttctagtttcatgctgctgtaaacaggagttgtgtagtgtcatggatacgtagattttcactttattttgtatattgacatagtgtctttctctgtagccaaagctgactttgaatttgtaatccttgtgcctcagcctcctggaatctcaggcattcctattgtgcctgacactttaaaggaattaaaatcacttcctaaattgcccttgccttacttcagcttcttagtagccatatgtggttggtgactagcttattagatgctgctgaaatactccattccaccattgcagttctgttaacactgagtcaaacagctttgagagggtgttttcagatttgctagagtttgcccgtagaataaatttttggctatggaattccctgttcaaagcccatatgcatttttaggattgaaaatgtctcttaggggtagagatgtaactcattatgccaggccttgagctccatcttcagcaccacaaacaattccctattaaaaatccaagccaaaccaaaccaaaccaattctgttaaattgttctgcagaaagttgttccaatgtactccaccaatagagcacgagagcatacatttctcctctcctgtcctgacactggttaagagtcttcatctttgtaatctggtaaattataaagagtacaacgatgttgtaatgcatatttctttgattattgttgaaattgaataatgtttcctttgttgatggcccatacatataacttaaggactgggatccttgactcagacttgtttccttgttttggattcttggaatactcatctcaacccttcacaattctgtttggctaagtcaagggtggggccacacatccatgttctttaaagtcacccccaggctgatctgggccactcatactccaggcgaaaatatcccctagatacatctgaaaaaggattcgtttagattctccttaaagccctcttcaggttaggaggctctgttgggaaacttgggttgaaatttactatgctaagttctgtgctgatctgcaacaaaccctcctgactggaaccacatggaatgcttgcttcctctttcatctgacaacccttgaaacatgtggagatcaccaccaggccatttaaattttcattcttcaccaggtcagagagcctttgtttcattccttcattttacacatgacttggttttaagagtctccacaccatgatcattgtgtttgacttgtgttcagtttcctacggaacagaagaggcagagcctgggcctggagtgagccctggtgtgaagtccaacttctgctgctacttgcactgtgaacaaaggcaggtaaccttgtctgtggaatggggacagacataagtagcaccctcgtgaggagtaaagtatgaagactggtggacaggtagttcgtatagtattaaaatgaaggtccagagagagacagttttcctggtactacattgaccatgctgcagtgcaagaccacagattcaagaacatttgggcaacacgaagtggtcttaattggtttaaaatgcaaaagacacaaagttgagtgtgctgggaagattgtggtggacatgatcagaacaccaaaatacgttgtgagagagagagagagagagagagagagagagagagagagagagagaaaatttgaaaaaaatcagtagagtgttaaacaacagcaatgaaacaaaacacctcagtattattccctagtccttggaggtatgagcacatcatagggtgcctggaatgcagtaggtgcacagtttgcattttgtacatagctgtgggatagtcttacgtcttgggagaagagcctaaaggcaggaatctagtgaaaatatatagtccaggagaatgataacagaggccttaactgaaaaagtgagaatggagataagagccagttccgtgattaaatctaaagcacgtggtgaatgttgaaggggtagtgggaacatggggaagagaaacaacagggaggaagagggaggtggagtcaagctaattttgagtttttacagcttaggtgaatcggaggaaggtgatagagaaaggaggagaaaatgagcatgctctatttgaaagaattgtgagggtcaggccaggtttcaatgagaaccttctaaaaggaggccgggcatgtagggttgtattttggcagatgcctgaggttcttgagggcagagaggaaagtgttccaagtggaatcaggaaagggaggaaggaccaggagaagagcagggctgagctgaactgacaaagataagattgtagggggtgattagctgatggaggaggcttgcaccttttgggggaagattaggaaggaggagtcagggtagggaagaataatctagaggctagccctagactacccattagaatgatagtagaagttatcacacaatagacacacacactcacatactcatatacatactcatgggtgcgggtggggagctcttgctctggcagttggctttagtagatcttgggaatgagaagctagtgagattcctttgggtgcccagaaagaataatataatagtttctacccttaagggactcctgattcagacatgaagatgggatgcacagtaataactgatgtagagaagatggaaaatagatatgagggtataattttgtcttctgtcttcagttggttaatcctgttacccttgtcccagatccctgacactttctgaggtttttttattttattttatatttgtttagactttaatctcttctggccttaacaagactgaataggccttcactaaggaacactgggaatctgtgtgacttttcctatggagttcccctcccccatgttttataggaatggtgagagctagcagtgacatggaatggtgagaaatttgtagtatatgtgtgttgctcacgttgtcattccctttcttgacctctgtggactctaatcagtggttgttaccttccaaaattccacacacacacacacacacacacacacacacacacaagtatggcacaatgtgcttgtgaaggtctcctttcaccatgtaggtgtctgggattgaactcaggtcaggaagctttggtgatttatcttaacctggtgagccatcttactagtcccacccttgctttaaaaaaatctgtggtttttaaatgttttgagaacttcatacttgagcagtgcattaccataactcttacctcctctcactttcgaagtcctccctcccatctcctccaaaattcttgacctcttctttaattattacacacacacacacacacacacacacacacacacacacacacacttgcacaggcatgcacacacggagatgctcaacctactgactccatttagtgttacaactcagttcagaagattaattcacccaactgacgtttttctatttttctcctaagatacagtcattgagaagatgtgttgaaaactgtattttttttttttttttttttttaccactgaaccggaagccgcgggagggagtgggagctcaagcagttcctcctttcttatggtttttgtttgcttctgttttgttttacaatgtacaaaccaaacgaggacttttagaatacatttcttcttgggattgtgatttcctgatttcctatagatttttgccagcaaggcgcaagaattcctggctaacattggtctgccatttgtatcagtctggagccagatgcctttttgattctttgcacagccccaccctagaggcttcctgagcagaaactggagtggggcaagggggcagtctcaccaagctgctgttgcccctaagctcatgcttgctagagcaatgggtaagaaaagccaactgctttcgagcaggatgacaccaggccagtacatcaagaaacacattagaacatatgatccacatgagtgttgtgctaggggagacagattggttggtaaaacgcttcgatgaagacaagtgtggtcttgagctccagaacacatgggagatatgccaggtgtggtggtacacccttgtaatcccagttcagaggaggtggagcccagtggagccctgggctcaatgctcagccagtctagcgtactctgtgagagatagttggttggggtgaggagagagagagagagagagagagagagagagagagagagagagagagagactatgaaactgaaaatgaacctgagaaagcacacagcacacacttgttctctggcctccatttgcatgcgcacgcataccttcctgagtatacctgtgctctcaagtgcatggtaacacacactcactcacacacacacacacacacacacacacacaaatacaaacaatgccttgttgcttctcagtatcattccaaggctttatgtcctttctttgtgttattgggataaaaccccagggcctcacagatgctaaccatgcatgctactactgagctacacccatagtcccagtgtccttttgtattctgccattcaggttttgtaataacaagctagattctgttaagggtggcgtatccagctccccagtcaagtctgtcgggaaacactgctacacgtggtttctctattgttcatgcaaaaccttgcacaatcacacctaaattttgctcttaatgatttcctgtgattctttgccactttatttttattgcctacagagtttatcatccacaggaaggctcttcctgctttcttgacagcttgtgttggactgcctatatttcaagttgctgggaagcattagaaggtgttcagagttttttagttcccccaccccacccccaccccatggtgctttctctaatgacagaggtattttaccaagtgagatacaactggagatactttgccagtgtgctttgatgtccttgagacacaatatctttatttgaagctttttggtgcattgtgatggaaggccagctagtttatttgtgtggaatatttttcagatgatgccaagtccttatatttccataaccccaatttttgtttttgggattttctttatgttactatatgcatatagatatttcatttgcattcatatacatatctcctagaattggagttacagacaattgtgagctgctaggttggtgctggggaatagaacccaggtcctctaaaggagtagccagttcttttaactgcggaaccatctctccactcctgttatagccaggatttgaaggagagttaaaagggctgctaggtctctgatgtcatatggctgtgggtcagtgttaaacatatattacattgctatcactcctatgctataaatggagaaacagaggtgtgggttctagtgaggcaggccataggtcatccatcactttcaaatgataggaccggtaatgaactccagctgtctcttctccttcagagtagacatgtgaaaaaacaacactggtgtgcctcccaggatccacaagtaatcaggggaaggaacttcctgtgtagcttggtgatgtatataggaagccatgtctacttctaaacaagcttggtttctatagtgggaaagtagaagttacggacaagattattattttatgatttgagaactggttactgtcagctggtcttcctttctttactatttgaataaatatacagaaaaagaacatttcagaactttagctctgcagaggtacctaggatcattttcctggaacttcttttaggatttttattttttctttttcaagttggttagttctctccaaaaacaacatttatatttctttccatgccttttatattagtagttaagttttctcaattgaaatttggctgactttctgacttatagggcctcttgtcacagtgctcatgagtacatggaacagtgctgttggcgcagccagtttattttcacaggctaacaagttctgagtgcttcagtgcaccatatggcttcagagagacctgaaggaaggaatatcaccatccacggtgtctacttaccaccaagaaatgactgatgtccaaagagacttggcatcaactcttgcataaactaaacagaatcattatttagtgtgtgtgtgtgggggggctgtggctctcatttgtgtccgtcggagtgtttatggcatgctctattgctccggaagcaaagaatgctctcctttcaaacatgttccacagtgacttgttccttcacttctagtgacttctagtgaacctgactgctcacagagaaaattggtgtctatctgtccctaccaaatagtctgtcagaattcaagacgccactgtaaattacataattggttctggagaaattagggtctggatgtatattagatgacaatattgtaaaattgtaacaatcatgatgtgtttgtatagaatgttcctgtccttcgggacacacactgaagtaaaatgtagtgatgtctatggccaatttttaaatggttcaattgaaaaaaaaatcagtatatgtatatatgtacacgaatagaatgcatgtgtgtgtatttctgtatctatatacagagagcataccactgatgagtctagatgaaatgtaaatggacatttattttcctatttgtgaacattttatatagatttgagttttcatattaaaacattaataaaacaaaaaacaaaaacaaaaacaaaaagagcgccaaagtgatgccaaaaagaattcgataaggctccttgcttcaattttctaataactcactagctttctccttgcctcccaccctctttactttctctacttagagtgcagtcctgctccagtttaggaagcatcaagagcttcttacattcagtgtataaactgttggttgtaccctgtatgcttatatttatttacttgcttatatttattcattcattcattcacttacatcgagatgcagtcttatacagccaggctgtcttcaaacttaacatatataaagattttatattgtatatgatatatttatactttaatataaattctatatattatgtcataaatcacatatcatttcatgttatatgctatatgttatattaaatatttatgatgtatattgttgcctgatgtggtggcacgtgcgtttattcccagtactcatgaggctgagatagatagatctctataagttcaaggccagccttgtctatatagtgagttccaggtcaggtaggactgcacaatgtgaccttgtctgaaaaacaatacaaaaatatgtgtttgtgtctgtgtgtgtgtgtgtgtgtgtgttagatggaaccaatagactcccatacactgagcaggtaatataccatgtattacatttccagctcctatgtccctaatctgatctcttgcctatccatatctgagcccctacttggtttcctggcaggataccagctcctctgcaagtgacttcttgtcatactgttagttctcctgagcagggatgctgtgcctttaccatgactctacagctgctcagcttagcctctattcagctgaacagtatactgagagagggaggggctgcttagcaaactcataggagactgagtgcccaggtaagaaggtctagcaggtagacagcatggaaagttggactagcgagacatatggtgcatcagtttcccactccttacttaacacaaacttagtgtcttcaaaggacacagacttttatttatttacttattttattgaaaatgatttttttcatgcaatatattctgattatggttccctcccccaaatcctttctttttctcttgctcattagaaaacaaataggcataaagtaataataataataataataataatccctaaaataaaagtaaacaaaccagaataataagacaatataactagtaagaaaaaattgccacagaaaaagcacccatgaaacataaagatgcagagacacgttcattcacatacatagaaattctataaaaacaaacaacccaaaatccagtaagcaaaggacctgtaaggttaaaccaacaaacaacacccagacaaattattaggagacaaaaaatcctccaaaaatactcttgagttcattttgtattgggcatctactgtttagtatggtacctacctgtatactccctgtttggaaaaaacggatttttttcctttgcaagtgattgtcaattagagataacttctgggttggggatgctggcttgtatccactccctgtctcagtgctgacttcccatctggcttacacctgtgcaggtcctgtgcatgctgccactgtctctgtgagttcacatgtttgtcagtcatgtgtttagaagtagaaagccttgatttcttggtgtcttccatctcctctggctgagcctgaggggagggatttgttggagagatccaagttaggattgagtgtcccagatctttcactctccgtacattgtctggctctaggtctctaattttgttcgaatctactgtagggggaagtgtcctgatggttgctgagcagggcactgatctatgagtatagcagaatgtcattaggaatcattttattgctgcatccctttagcatagtggttctcaaccttcctaatggtgtgaccctttaatacagttcctcatgttgtgttgacctcaaaccataaaattattttcattgctatttcataattgtaattttgttactgttatgaattataatgtaaatatctactttgtaggatatctgaaatgtgacccccatgggggtcaccaaccacaagttaagaactgctgctttaacaggacaatagtatctgcttttcccctggatggatagcctagccagtcccagaaaggacaaagaaagttttggttctagaggttataagtctgacacaggtttcactgggatgaaaccaaggtttggcaaacctatactcccttcaggagctctagaggagaatcctctgtgttgccatcttctccagtttccagagggttcctacattctttggtacctctatctccatcttcaacccagcagtggctggccatgttccacatcatagcatactgcctctgcttctggcctcaatactcaatactcaatactcaatactcaatactcaatactcaatactgcctctgattagcctgcctccttccatctctcaattataagatcccttgttttgttttgttttgttttgttttgtttttgtggtatttgtgattgaaatcatggccctgcacatgttggacaactgctccatcactatgctatgctcccagccacatataagaacttttgtgatgactttggtcccacctgcataatgcagtgtggtcttcccatctcaaaaacaaaacaaaacaaaacaaaacaaaacaaaacaaaagaaccaaaaacctttttaaaaaaaagccttaatttaatcacatttgtgatttcctgtaatgagtaaagtaaattcttagggactgagctgaagccatgtttgggaaaccttttttgtacgtaaaatccatgaagagtggctaaaggtccatgagttggtgggcaggtcccgaggttagatgggttcctgactttataatgaaatagaagaggaacgggatctcccagcattgtagtaaagaagcatggccccttttgaggacttcagcttcaagaaagcaacgcaggcttgtcatctgtgatgttcattcgcttgttttctgaaatgctttataattaattattttccccaacagaggactccgttggtctggatttcttatagagagggtgctgctttcagacttaaggtgtttgaggatacaagttggccagacacatgcaggcacctagccagtccaggcctatggaattttccactctcagctaaggaaaaggggaaaacagtaagtgtatgcaggtgtatgttgtggggcactgtagatagatgtagataaagggaaagggatgatttcacattgccgaagaactctggctcacaagtcccaagatgcctctcacatgtcctttgtaatagatacttcacctaggctgaaggtcaagttagatggggcagcgcccttcagaactttcaaggaaattgcaggaccccttgccaggtaaagtgtccaaaacacacggttgtagaaggcagaggaaaagacagggaactttctgagttcctttttgacgtcatgatgattttaactgagagataaatcgaaacttcctctctccgtagaaggcagtccctgacattttagagagccacaccatcgacacttttctttctggctgcttttgtttcaacctcctcatgctgaccagtataatacccacggtggtctgatggcaaagctccttgcaacactgaagaagcactctatcatagtggactgtgtttgctatttttaagcagttccaattggccgcagctacgcttctccctggcttaacctatccttttacaggtcctcgggtaactgatctggctgtgcattgaaaatccttatgaaaaggtccaggaaaatcacagattttgtttcaaaatctggagctacaaaatgtccagcaactctcttcactttcttctatttcatgttcttttcttttactctccaattgggaaaataatttcctttcttttgctaagctaacttaagataaatcttctgatattttcagttgggttgtattaagtgttctgctgttatatacactaatttttaattatgcaagtttattaactatagtcctgttcgagatttctttagagagacttctaagatggcatttattttctccaagttatgggttcttttccttcatactggcggcctttaatttttagtttgttttcccaatttgctgatctctgctttggggcctcctcctttctgcttgccttccactgagctccatgacttactggtagtgtacactacattgataaatttcgggacagacatgatgccttagatgcctggaatgtcttggcctgttgtagatagcagaagaaagtagaaagtaatgtattgttggagagggtgctaactggtgagaaaggtatgttgtgatgtggttgatagctgctttggctgatgatcaatacagatactttcattcagttgatgctaaaatcccaagggacatgcttttagaactgttgcttgaactgagcagaagcagaggctcattttctgctgatttccttataatggattaagtctatttagagcaaacttgtaagcataagagaaggcaataggatataatctgagagaattgaagggtgtgtgtgtgtgtgtgtgtgtgtgtgtgtgtggttacaatagtcgaaaagaccagaggttaaaatactaacagtattcaaaatcagtgtgggggcagggaggttagcagcctatatttagagaactagagaggaagaaatcaaaagctttaaatcttgtgctaggtaagtagaatggctttgtgagcagacaaatgcctgaagacagtgaaagagtcaagaccccaaatcaagtagctgaggaatttcaaatggaaaaccaactgtccaaatccaattgaggtccccgtttactgaccacctgacaccaacaggtgttttgggaccccagggtagaggggggatttgggtaccagacatgcctaccctgttttcctttcatcctagcttttcttagccctgaatagcaatacctcacacctgttccaaacctgtatttcttgaggcagcaaacccggctggacaggaatggcagcaaatgaagactgcctccgaaccactgtaactctgcaagagcagctcccaccaggtctggcttcctcttactatttcctttcttttctcagcacttttttttctttttctcttttctaacttctactcaacactaactgatctctcctcagagctcctcttgctcggcaggcactctaccactgagttatactcccagccctttctctgcatgcatactccccatgatttctgttcctagtatttatatccctgcactgccacattttaggcaaatccatgaccctagatcctccgtgctccacttcatggcctccctacttcactttccaccatgctaactaacatcccagtgtggacacatgcctactttatttcctttcttccttctctctctgtctctctgtctctgtctctgtctgtctctctctgtgtctctctgtgtctctctctccatcttctctcctttcctaatgctagaatggcaggtgggcaccatcacatccagttcccacttctctctgctcatcttttctccccgagtcttttctcctatttgactacaaagtgctcaccatggggcagagacattactttgtttatttttttaacctttttttaaagccaagggtggaaaattccaaaggcctgagttagtgatggctaggtgccttttctggaaacctagtaactggactgccaagggaatgtcatgggacagcacatctggaaaagccgttccccaaaatgtcctggttttgaatttaggtccatgtgaaagaagaggaggtttttagccttgatgaaatcaatcattacaactgaacatccgagtttacatcactttctttttctgtgctgctgggcttcattgggaaatcatagcctttggctttttaggaccttctagagtccaaccttttgcataagaaacaaatacatctctcacagctcagcttaattgatgatttcactttgttggagtcattgtttggcagaggccagctccatttcagagcaactggagtgggtctcctggggcaggggagcatcctcccagatgttactaggtggagctgagtagatgaaccccaccctcatgtgtcttgcttcgtccctgaagaaataacctgggcagggttttgcttgcatatccctgagggctgtaacaaattaaaggtgactatcttgacaattcgccaaaaagcaatcttcttttttttttttaaaatatttatttatttatttatttattatatgtaagtacactgtagctgtcctgagacactccagaagagagagtcagatctcgttatggatggttgtgagccaccatgtggttgctgggatttgaactcctgaccttcggaagagcagtcgggtgctcttacccgctgagccatctcaccagcccaaaagcaatcttcttgaaatgcatagaaagtagttcatcattctgctgcttctcaggaaggtaaggggaaacaaaatccctaagaccagaaaaatgccaactccatttgcattggtttcataaggaagcacttagaatttcttcaagtcacccagtatataggcttacctttgtcccatcttcccccaccacagcctcacctatagattgaaccccagcctctctgagctatcactgcttccaaaaaagacactatctgttctccccttccagcctttctaaacctccctcttaaactgaaatgaccctccacccttctcttatcaaagggaaacctgtccatcctacagggctcataccaaatggccatcttcaacactaccacttcactgagtagcatattttttgttttgttttgttttgtttttgttttgtttttgttttgttttgtttttttctctctgaaggtatgtagcatccatccaaaaacatgctgtagactaagtggaatgaaacaatacatttattccttcatagttttggaggtcagaggtccaaaaatcagaatgacagggccaccttccatcagaagacttcagaaaggtgtctgttgctttccctaccagctttgttagctcccagcttcctgggtccaaggctggatgactctggtctttgcctctgaaggtctgctacacattatctttgaatcaagacaaattacctctgctcttttcttatattaaagaacacttgaaatagcatttagagcctggccttataaaccacagtgatctcctcatttcaaaatctttaactcaaccacatctctatgtgcctttttgccataatgtcacattagaaggttccaagctttagacaggggtacgtgtttcagaggccattcttcagatcatcttactagtgttaggttttagagtgtattgatttcattctgtctcatcagtgtaaactgttgataactttttcttccattagaatattgatgccttaagggactgcaggagagtagcaaaagctaatgtgcagtaagtagtccatgtgccagaggactcagcatagcacttttagtttgtattaacactggggacttccatgcagtcatttgtaaaagggaaagaataacattgtctttgggacttggcagaactgttaagaccaaaagaaacacaaattcaagtgttcaaaaataaggggtagggacttgagagatggctcggtggttaataatgaatgctacacttgcaaaggatccatgcaggaagacttaaaaccacctgaaactccagctcctggggaatccagtgcctctggtctctgcatatacaccctcacgcgcgcacacacacacacacacacacacacacacacacgctcaaatataataatgaaccttttaaagtaaggggctaggcaaattaacacccatacacaagaaaacaatgcaggcattgacatgacttctcactatatgattcacattaaggaaaagtttcacttattgaactgcatattaagtatcatcctatctctgtagactaatacacatctggtaggtgtaaatttagctatttaactactccccaactttgtttcctcatttgcaatatgggtataatgctggtgtagactacaacaggaatgttgtgacacttaattaaaacagtaaaattcttataactgcatagcacagaagaagtactgaattaatatagacattggatttactgatattctcaaagaaagtgtctgtgggacatttgtgtgtttgtaagcagcatctccctttccctctgcacttgtgtgccattttccttactagcgtgcacatctttgaatgtgtttctttcttcttgtctttgtctagcttctttccactgcactgcccatcccagccttttcaagtaatacactcattatgtataagatggacatgtaaaaatatatttgtatttatattgagttttgaatacttccccataacttaaaaataaagagggataaggtaatagtcagaacataggatgtttagtctagagactaatggttgttctatagtagaggtagtacaggtttgtactcatagaatatttaatatgaagagtaatctctaatatacactgtagactttggttgtcacatcagtttggctttatttctttcttgttgttcttttgttttgtattttcagacagagttcaactaggtagtctaactcttactccttactatgtagaccaggcaggtgttcactttgtggtgatcctcctggctctgccttctgagagctaagataacaggcatgaaccaacactcatggcatgctttctgtttttaaaacctttatttttttacattaatcacagtaatttttaaaagcagaaaagtagatttcaggacaagaactgtacctttgaatgattatgtttatatgacagacacttatatagcactatctgtaatttactatatgtttaatatttttagacagggttttcctatgtacctctctacctaacctggtactggctatgtaacctgatctggcctagaactcctggcaattctcctgtaccaggcttccacatgcaggaattataggcatactctaccatctccaatttactatttatttagttgtacatacatgtgtgtttgtgtgtggtgtgtgtctatgtgtgtgaatgtctgccatgtttgtacatgagagtgttcatggaggctgtaaagagggtgttcgatcctctggagcctacgttacaggcagttgtaagttgctgggcatcggagccaggaaactgaactcagggcctttagaagaccagtaagttctctaaatcactgagccatttccagtcccatttattattattattattattattattattattattattattttcttatgtagctctgtctgttctagaacactatatatagaccagctgtcctcaactcacagacattcacctagctcttgagtgctgggattaaaggcatgtgatatcacatccagcttcaagtattattattaagacaatttcttctacagaccttcagacccttgcccagtgatttgtacatctcaagttctctgttcaatgaagacaattttccgtggtctggaagttacagactttggttcctattccctttcagtcctgcttgctcagttttttcaagctttcatcataatatgctttacttcctttgcctccttcttcccattctgtgtctcaaaagcagagtgtctcaactttcctagtgctgcgaccctttaatacagttcttcatattgtggtggtctccagccataacgttattttcacaaatacttcgtaactgtaattttgctactgtcatgaattgtaatgtaaatatctgtgttttctgacggtcttaggcgacccctgtgaaagacttggtcaacccccaaaggggtcttgacccacaggttaagaactagagtctgcctttcttggcaaatctcactatgtagttcaggctggccttggacttgtgaccctccagtctcagtcttacatttgcagagattacaggttgtgtcagcacatctcattttataatgtgggtttgttgttgttttttttttttttttttttttttcagagagagacaggattttattctgtagcacaggttagccaggcactcatatagaccaggctggcctttaatttgaaatcttcctgtctcttcctttcaggcactcatatctgtgagccaccatatatggtgggggcttaaaattcaaataaaattcattagtagtttacaggcattatggttagaaggacttaaggcagagatttttcttttcttttcttttcttttttttaactaggcttgtgtcttggttcttttatttaaaaactttttttttttgatcttttgacataggattgtcctgtgttagaaattacatgtgactttgcaaagcatgtcaatagagtttatttaaaacaaaaagaataagtgtatgcttaaatgatataatttccctcaaatttaacttcactacagtctgcattgtgcaaacacagctgtaccaaagctggaacagtgattggcagctatctatgtgctatgactctgggctgttcacaaacccattttatggacacactaccacccaggtcacacagggaagagtataagttataatttctaatacataatccctcacattaataataaaattgcttggcttttacctattagctttcattcaaaaccttcaaagtgttcaatccacatttgcttccctaaaattctaccaaatgagtcagcaagagaactaggaaagcaaccttccaaactatcagcaacagaagaaactagttctctgctatgtcctctgacaacaggaaatacagcagaaattcataacagttggtttatcttcagagagataaatataatattttatgtatattttaggaactatttttagagtaagtgtaaagtctgaggcaaagcagaacagcaagcatggagttcacttctcatgcactacacagcctctgttcattagcaccctgcaccaaagtggtgtgttacaacaagaacaacaaaacctacattgagtggtgaagtgtgctgacacaggcctgctgtaatcccacacttggtaggttgagatctgaggatagtgaatttgagggcaatctgggctatacattgagagagcttgtcttaaaaatagatatctatagcagactagagagttggctcagtggttaaaggactgctgtgtaaacatgagggtctgagttcagatcctccacactaagtgaaagccaggcatgtttatgcactggcctgtaacctcaactcgtgggggcagagacaagcagatctttagttcctgtactaggcacagtgagaggtttgtctcaaaatcaaggtggaaatggatagaggaagacagccaaagtcaacctttagtctctacacatgtacacacaattgagtgcacccacaaaaatacatgagtacacatacaggcaccacacacacacacacacactcacaaaaacacaaagttttatgcttactaaatggactcagatgtcagatttatatatttatgcatatatatgtatattaaaagaagccatcaatttgagagggaatgggaggagaagagaggttggaaggaggaaaagaaagatgatgtgctgtaatattaaaagactttaattttaaaaatggctaggtataatcccagcatttgggagactttggcagaaagatgactagttcaaggccatgctatgctacaaatgaatgttaactccaaaaagaacaagaaagaaataaagccaaactgatgtgacaaccaaagtctacagtgtatattagagattactcttcatattaaatattctatgagtacaaacctgtactacctttactatagaacaaccattagtctctagactaaacatcctatgatctgactattaccttatccctctttatttttaagatatggggaagtattcaaaactcaatataaatacaaatatatttttatatatccatcttatatcataatgggtgtattgcttgaaaaggctgggatgggcagtgcagtgtaaagaagctagacaaagacaagaagaaagaaacacattcaaagatgtgcacgctagtaaggaaaatggcacacaaaagcagagggaaaaggagatgctgcttacagaggcaagcgccaccatgatccaagtgtcctaaatgtcagagacaagcctttccaaagctcccacttcagcagtccacctttccattcctgttgtgttgcgattgtttttgaggttctcactacataaccatgccaggaagagaattcactgtgtagactatactggcttcaaactcacagacatcctcctgtacctccttcctgaatgctgggattaaaggctcccatacattcacttttcagttcttgagaattataagaatttttcttctttcttttatttttgagactataatataattacaccactaccccattcttttcctccctctaagtcctcccataagcccccttgttctctttcacatcaatggcctctttttcattaactattgttatatacatatatgtatgtgtatacacagacacacatgtatgctatacgttttattgttattaaataactgattggtgtgctcttccccggggaaggctattcctcccactcttggaattcattagttgtctgtggttctttgtgtagggttgaggccttgttggcatttccctgtccattttatcatgtctattgttgtttttctagttcagttcatgtctaggcagtcatgttgctaaaactttatgggtgtagcttctgacattcctaggagtcataatctcacagcaaactccccagttctttgtctcttacactcgttccaccccatctcccaaaatgtcctttgagctttaggtgtaggaattgttttgtgggtattatcagttgtacaatactgcacaattctgcattttgattggttgtagggtttgtagttatctctgcctcttgcaacacaaaggttccttgatgaggagtaaggactacacttacccgttggtactagtacacatgtttagagggtaggtagggattatgctgatttaggtaagatgtgtttctaggttctcctaaaatgagatttggtgttaaggaaatataatcaattgtcatttgtggtttcttctgagaattaagtaatgtagcccctcctttttttcttttatttctttcattgaaaataaattctcctctcgttcaatatatccgtgccagagtttccccgccctccactcctcccaggtccttccacctctcctctatacaaggttggcattgaatccttatcctcctgccttcaacctcccaagtggtgaaattacaaggtatgcaccaccatacctgactcctaactgcctgccagtcctacgagcacatgatttattccttcattgaaacctgaaagaaatccagggacaagaagacaccatagaaaggatttacattttgcttctaaatataaatgctggaagtcttaaatagtaggaagctcatgtgatatgggtaaaaactaagtggttggagccactatattaatgatgtggctgaaaagagctaggggtgtactggcagccatttgcagattgttcctttgggggattctttctggcagcctcatggatcttgagccctagtgagattgtgtactgggccctgctttcctcttttgtgtatggagcccaacctatcctggaccgcatgcattttggagtgtccttgtgtttccatgcccccatagtgagattctgctagctttgtgtctgcataattgttttctctctcaagaagtcttttgatgcaacttttgtgtgtgactagtgtaaaggaagtaggagtatcagtgtgtcttgcattagggcctgaagtgttattagacacgttctcacgaccggccaggaaagacgcaacaaaccagaatcttctgcggcaaagctttattgcttacatcttcaggagccagagtgcaagagagcaagccaacaaatggcgaaaccccatccctttttaaggagaattatcctccacctaggacgtattactccctgattagctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacagatcccccttttcttttaataagagcaataggccacccatattaatgagagtggagatagaggtcaaatccccagtgtgcaggtaaaggagccgtacacataacctcctcccaggctcatcacccagaggggtcctggtctggtcccgtgttgtttttcctgggggaaggacacttgaacactcaaccttcttgaaagatgacatgtctccctagaataggctcatatgtgccgcagagcctttctactgcagtgcttagccttgcaactctctcgggctgctgaagcacactcactctatcccgtgcaatgagactagcctcatgggaatataagagctgagtggccagcgacctattgcctaagcatagatatatcagggggagcaccatgttctagagctgcaagcgcctgggcaataaccaccttgtctctcctagtttgggccttaagcttacagaccaaccaaagaagcaacactaatccacagcaaagtgtatctccacataatcccacccccatccattctttaaagaaggaaaatgctgaggagatccaattgggtaatcctttgatcagggacaggtccaagcgcttggagttgacctgaatgatggcaagtctcaattcccgaagggtctattcaaattcagccatccaattctgtaacatatactgaaaaagactttttgacaaattagctgccctagtaaatttaacatactgaatggaaataacacacaatcccggaaacttttgttcacatccctgctgagttatttgtcataatacatctagttgtatctggacaagatctatgagttgattaaccagcatgagacctctctgtactgggccaaataagttcatttgctcattaatggctctgaggtcatggagcagtctccactttcctgactttttcttaattacaaaaattggagtattccaaggtgaggtagagggttcaatatggcctaattttaattgttcctctaccagttgaatcacagcttctagtttttcagaggataggtgccattgaggaacccacactgggtcccctgttttccatggtatgggtcgtgctgccccaatggccactaaggaaaaacccagaccctgtctgtcttggtttccattaggtaagataggctctatccttccctgttcttgatgtcctaacccttttccttctttataacccatctttgccatgatattttttgctttagttgaataccctcctgatggggcgttttcattggacaaaataaggcccaaatgctgcataatatcccttccccagaggttaaccgggagtgggagcacataaggtatgaatttcccttgctgtccttcagaggattcccacgtcaaggcaacggagcttatagtgggacatgattgataacctaggccctgtaatgaatgagatgactctgtggtgggccatgctttgggccaccaatgtgtagaaattatacttttatctgctccggtatcaaggatgccttcaaactcttttccgttgatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttggggcttgagcacaggacctgtatttcaggggaatgttgacaatccataactccagggtggactactaagccctgcaaggtgagtgaaccccggccgagaataaggcccatggttcccgggggcaaggatggtataggctccactggcaccggctgaatactcatttgaggcattaataggaaatcggaggcggcacgcaggtccacccttgtgggtcttcctgggtcgcctctctgactgcttcctgggtcctgacaaaccggttcccatatctttgagggccctgggaccgagggcccgatgacccgttttttggcacataagctgattgactatcaggtgggggaaggactctgccctttatatccctcacagagcgacactggtcagctctatgataacccttgccacacttagagcaaagagtgagggtccccccctgtttacctggagctctgcaatctttcttaagatgcccaggcttcctgcagttaaaacatgtcctccgattatttctgcccatggagcggttttgggattgaaggatggcagccgctaaacctgcattgctgagaggtcccccaagctctcgacagaccctgagccagtcttgtaagcctttgttctttcttggggctatggccgctcggcactcctttgtggcttgctcatagattagctgttttatcagaggcgcagcttgctctgactctccaaaaatacgctctgctgcctctgtcattctggccacaaaatctgagaaggattcctgaggtccctggacaacttttgttaattgaccagtggtttcacctgctcgggagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcttgtgcagtttcgtgccaaagcgctctccattccatatatttgcccatactagggagagcggcttttacaaccgtttgccaatcaccaggagtcatagcgtgattcgcaagcctttccacttgtgctatagtgaaattagcactgactccatagttacggaccgactcggcaagctctttaatctgtatatacgctaccggagcgtggacacgcccaccctcggctccttcaaagaccggaaatgcctgttgtattttcctttgttcctcctttggaatgaacgagtctgtgcattgcctctctgtccattgcctctctgcgcagggctgatgcactacgcagggcgggggctcagcatagggtggaggtgcactatgaccttgaagccgactgccaagaggccaagcagcaagctggcctttgccagccgcttttggctttttccttaactgattagctagcactttacctggctggtacccttttttctcataatgagctgcttcttcctcccagtctgtttcttcagaggagaattcttcatctgcttcagaactactaagagctggctccccgagcccatccagcgatgagcacaggctccttttcctagagacctccgctaattgatctttcttcttttccctttttcctctttttcttctaatctctctccaggtattcctacctaaccttaacttttcctcgggttcaagacccgtggaaaggcctgtacgcttattttgtgcaccatgtttcctctttgctcctactctctctccccgctttacttctgatagattgtcctgaatttcctctagaatccgccctgccttaaccacttgataacatgtgaaaaggaacaaaagggcttttaacactagaaaaaattcaaggccaaacattttccactttacttctgatagactgtcttgaatttccttagaaagttcaaggccaggcttacctcgtaaagctatactcactggtactctcgttccccagctgaaaagttctgaattcatacagttgaatccttctcaacagtctgttttacgggaaccttcattaccgtgacccgcagttctggttctggaatgagggatcttccttgcgccagtcccgagttttttctcgtcccggaattcggcaccaattgttattagacgcgttctcacgaccggccaggaaagacgcaacaaaccagaatcttctgcggcaaagctttattgcttacatcttcaggagccagagtgcaagaagcaagagagcaaatggcgaaaccccatccctttttaaggagaattatcctccacctaggacgtattactccctgattagctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacactgaagaaagatgctgtacctctaacacacatgtttttgacagtcgaggataggactgttgaaggtaagcttctccaagactgggtcagactgtctttccttgacctcactgaatgctacttaatggaaaaatatgataagggttcaccctatggaatcgttgcttaatattgcagatgactcattggaattagtgagttagaaaatcatttccagatgtgtagcagaaacttttccaaaaggaacaaatcaactctggaaactgggttagttttctttctttaaatgatcttagagccagagttagtcagttcttctcacttgtggttagtcaacatttatttggggttctccatggtaagatcctattcatctacttttagaatgacaagcacaaaataggtcctgtccccaggctatcccgttatccgatgttgccttctccactcttcaagagtcctgatgtattcataatgatgaatgaccttgagtgacccctactcccttgggcactggccttgttctttatcagtgtgcattcctgtgggaaggcttctttctaggtactttgaaggatggcagaaaaccttagtggcagagtaggagcagaatgtgtaacccagaagtgactgagaacggctgctctggagtctgggttgggaaactactttctatctatagcatatgagaaagttaactttagcatccctgtttctttatttctacaacaggagcaatagtaataatattctgaatgaggtcatcccttggaaactctccacatagtccttctctgagttgcctctgtgtagtttggtgtgaaggaggaaagggagatcttacttgcagatggaggctctccaggaagccatcacagtgttagagttttgcaattccacctttaccatacttaactccagtagggaatccacaggcttctcacattcagtcaatttttagttgagctctgtgaaaagaaatactgtgttgtcatctgcttgcaagcaacagacagattttgtacctcgtccaatagtcagaaggaaagtattcgccagtagcacagcctggagctctagcaaaagccaagtccgttctaataaggtgtttttggtaaatataaacttatgttttctgtcttgctcagttttcatgacatatctagtcttacatatatctggacagtttccacttaatgtgtattctctcaggacatctcaaagacagcagcagcaagtgtacttatgtgctagggtatgggcccccaaatttgtgaacttggaaaacatcataaaaggaaaagatgataaacattactgttccatggatttatggatttttttttttctcattgcttctctctctatttctacctctattctcctaccccctgcagctcaggatggaacccaggacctcacaactgctaggcaaatggtgtatcattgagttttatacaccttctctactggttttaaagctttgaaatgtttagaaatttgtaaaagtgctacaaaagtttgtgtagtggttaagagttcaacaccatggttaagcagccctggcttttttctttttaattctatttattcactttacatcctaatcaccgcctccaagcctggtcaccccctcccacaatttcttccccctccccttctactctgagagggtggaagtccctcccttctgggtatcctccccaccctgaaacatcaagtctctgcagggcagaaaaggcagctcagctagaagaacatatcccacagacagcaacagctttagggataataacccctgctccagttgctgggggatgcacaataagaccaagctccacgtctgccacatatgtgtctgacagccctggctttgaatccctaacaaattactttctattactgtatggcaccttaccataagcccagaagcttaaaataatgcacatttactagttcctgtttctctggagcagtaccatgggcagggcactaggggaggtgcttttctgagtccacagatgttggcagcactgtgtgggtgggggtcctcatctggaggctcggagacattttccaagctagttcagggtgggcataatctggttctttgttgttagttgtaggaactggttccatttgctgcctgctggttgtcagcctccatcaactctcaaagaacagtgtcagtcccagcctgccatattacatggcagtctattgatccaaactcaacaggtgactctttcttttcaagatgagcccttcccatctttgagggatcatctgatatggtcaggtctcctttggatgaatttgaggtcaattgtttggtaacctacttgggagagcaatatttcctaatagtcacagttcccatttacatgtaattgaggcagacagaccatagaacagtactagagggtatcatagatctccacttgctctaccaactccaccaatcacttggacaatttgcctaagctctcttcttttgttttcccagtgctaaaatatgagtcatggtagcattctccaccgtatgaggttgttgctgaattgcatgagatgacacacgcaatacatctcagcttagccttggtgctaacagagctttccatagacaccagagtcatagcacagaagtggttccttctttcccaccttgtctttacttacttctacccatgatgaaatggttttgagggcgaagctcatgataacatgcttgaaaaattcagaattttcccctagtgttctggtttgtgttacttcaaagagagatgatacacatttataatcccagtactggggaggctcaagagagtgattatgagttcccaggaagtttaagctatagagtgggaccctgtgtcaaaacaaaaagtagataaggtgaaacatttcccagatgttactctgcttttgaaaactagcttggagccaggtgtggtgcaaacataacagcacacacttttaatcccagcacccaagaggcaaaggcagctatatctgtgtgagtctgaggccagtgagttttagaacagccagaactctacatactgagaccctgtctcaaacaaaacaaaacaacaccccccaaaccaaacccaaacccaatcaacacaaagaaaaccagtttggtaggttactcatctgtaattgacagtactgttttgtggtatgtgctccagcagtgtgtgtgtgtgtgtgctccagcagtgtgtgtgtgtgtgtgtgtgtgtgtgtgtgtgtgtgtgtgtttaaatatgtgtgagtacacatatttgcaggtctatgaaaatatgcacataaggttgatgttaagtatctttcctgatcatgcttagcttagctgtgtttattgaggcagggtttcttgatcaatccagagttggccaattctaactagtacagctagccagcttgtctcaggaatcccctgtgtctggttccctggcttttactaatgtgctgactcctcatgcttatgggatgctgaaaataaggctccatacttgttgtgtgatcctgaagactagatttcagaacctagcacccatgtgacaacccaagcatcctctaaacacttgtaactccagctctgactctctttggcctctgtgcatgtaggtacccatacacacataaatctttttttttttaagatagaaaatttcaaaacctgatgtgtgtttctcacctatagattaaggactttgaagttctagaaatctgcactcagtttattgtgtaaaaattgtaaagatcccatcttctaaaatgaaaaagactggggtttagtggcacacatttgtaatcgtagctcttaggaggtggaaacatttggatcactatctgtgtaaagctagtttggactaactagctggggctacccagcaaaacgctgtttcaaaacaaaactcagcacttggtttgttcacattagagatcaagccacaaaatggttggaaatatttgaaaaatatgtgtatgaagaaggattaatatccagaatatgtgaagaactcccctaactaaaaaatggtggaaaaccttgtttttagattacaacgggaattaaatagatatttctcttaggaatattaaacaaatggccagcaaacacctgaaaagatgctcaaaaattatggcaatatgaagcaaaattatgatcacacatatttgggtgattggtgacactcaaaaatctgatatggtgcaaatggaagcttgtttagtactggcgagagtttaaaaatggtgtttgttacttctgtggaaaataacctagtagtcctcagaaatttaaatatagaattgcctctatatagagttaggaacttctcaccaaagagctgaaacagagactccaaaagatatctgtatattaaggtttagacctgcattactcatagtcaccaaaagttagaaacatcccagatgcccatgggcaggtggaacaaacccaaaatgtatgtatgtgtaagtatgtatgtgtatatacatacatatataccacaataatatatatgtatatgtattcatatatatatatatatatatatatatacacatacatatgtgtgtgtgtataaagagagagagaaagtaatattaatcacaatgtgaaactctaacgtacatgacagaatgggtgaatcttgaaagcatcattcaagtgatacaaaaccagacagaaacagaccaattttgttcagttccaattatatgagatatgttgacaaggcaaatacatagcaacagaaaatagagatcatcagaggttaggaggaacagagagagcagagaggtggtgtctaatgaatatggagtttctgttcgataccatttaccgtttggaaatgagtagtgctgactgcagaacaaagactgtactctattttcaaaatttggtttttgagataaggtgtcaccatgtagcccagggaggcttcaacctcataaatcccctgcctcatattcctgagtgctgatgttagagatgtgcgtcaatgcatatggcattgggactgtacttactgccactgaaatgtacccataaaagagtgaaaatggaagctaaacagtatgtagacattccccacaataataacctgtcctccaatccagtccttgtatgtctttggactatgccagaaatacatagtattagaagtctctgagggaaaaaccagacactgaaagggaaacacacacacacacacacacacacacacacacacacacatcacatcacatccacaactctaaggaaagctgttattttaatttctccatattttacttaaccacttagcctttgtcggttaacagtcattttctaccacttcctgtgcaagtggcatgctgacatctacttagtgagccttcccagtcttcatcccctattagaagaaaaatagaaaaggcctctgagctagggcaaacacagctccacagcaggcattctgtcactaaagctgtcctcagcagcagtggttcttgggctccagccacaccatgggagcagctgcaaggaagagctgagaacctggggtcagcaaggctggctccagctagaatagcatgagcagtatatagcagggtcagggaatctctgactattgtcagaatatacacagggccctgcagctgaggcatacatctttgaagactcttaataatcctttcagctctgagtggttctgctgtgccctcctgtgtttctctctgggccttctagtggacagtttggcaatgggtctctgagccagggaaaattgttgctggagctttagaagtctccttagaaggaggctaattgcctgtggctgattgaaagtgctcactgttcaggtcttggaattcaccagaaagcagggtaagtccctgaactggctgggacctgtggtgcctacactgggtgatgctgggtttcccagagctttagaattctttctgacagagttctggattcttctttagagaaactgctggtgtctaaggaaggaagactaacagtttagcaggggaatgggctgaatatttttgaaaggtatccagcactttcatgagcactgcctgacttttggaaaggactgtctttgccagtcctcttgatagggtatcgagttcgaggctagcctggtctacaaagtgagttccggggagccagggctatacagagaaaccctgtttcgaaaaaccaaaagaaaaaaaaaggaaagaaatagggtattattgggttgtcagtgtggcttgttgatcgacttacccaataagcgcacggtcctgcatttcctcctacaaactggaggggaaggtgatgtgggggcggggggagaaaagagagcaaatctcaactttgacataaatggcaataaatctctcacttactccaagaaaatcaataatcctcttttgccagaattatattgattgtgaaatatgttggtgaactaactgtaccaaatagatatccctaaaagacacccacacaggaggccatacacttactccctaatattactgatggaaataaggggaaatatatactcacaaaatatactgtatgttttatcatgagtgcatttctggagtaaggggaaatgtatcattttaaaacttgacttctatggaccattgagatggcatggcaaggaaagttgctggctgacagcctcaatgacctgagtttgatccctgggactgagaatgtggaaagagagaattaacttgtacaaggtgtcctctgatctccacacatgggccacacacatacacaaataacttgtctctaaaatataggagcattgggtggatgagatgcttaggtagcctgacatcctgtcaccaagcctgacatccctgagaaccagatgttcaaaggaaagaaccagtctctaaccacaagagatggaatcgttctctttcaatagaatcaatcaataaataataaataaaatgaatgtttaatttttttaaacaaaactgacttagtctaattgcttctctccaagtctgtaattggattattgctaccatctgtctctgttttttcccccagttgatgcaagtccagacagtttaagtgaaaatattctatttgataggctggggattcacatagcctactgaaatcctaaaaagtttatttgagacagggatccttaagtgtccctgacaccccttgaacttgtgttgctactggttccaccttccaacggctgaaatcacaggggagcacttacatgcccaccataatgccttgaatttttaaatgtataccctttacttgcctaacatatggcattcacatagtaagtgtgttcgtggatatatcttggaacttagagggagggtttttttttttttgaacattcatccctaattccttttatgctaaaagtttctatttgaaacattgtggctacctgaaagcaacttcacatgcaattggaatccaacttgaaatccaatagaaataaaatggagaaacagcaaactggcagcagtgtgcccacagaggtggagagtttctaagtgagtgagtgacttctattttcttttttcctttttttcttttcttttcttttcttttctttctttcttttttttttttttttggttttttgagacagggtttctctgtgaagccctggctatcctggaactcactttgtagaccagggtgacctcgaactcagaaatctgcctacctatgcctcccaagtgctaggattaaaggcatgtcccggctgacttctattttctaagttgtagttttggattaaaaactcttcagtgaaccaggcagtggtgagccatgcatttaatcccaatgttcaggaggcagaagtaggcagatctctgtgagtttgagaccaggctggtctacagagtgagttccaggacacccagggctacgcaatgaaaccctgtctcaaaaaaaccaaaccaaaccaaaccaaacaaaccaaacaaaaagtccaaacaaaaaattcttcagtgaacgtgtatcacttttacaattatggaaaatcagaaattcacacataatataatgcagcttgtttataagaaagttagcatagtaggggttaacctttcttgggtctcacattcttttgaaattgctgaaagttccagacccttcttgaagagtgttatacacatggtgttgtcagtgaattctctccattcacaaaacctcaagtttcctattcttctagacaactgggctgtcatagctggatcccctagctctttctttcctgttctttttttaggttggtgtcacaggtgcctagagtataggggactttgaaggaattaaagcttgggctaagcttagaactgggatcactgaggaagcctgtgaacaccaagttgagatatccccctaggaatagggcacagcagagaagacagcaggaaggctgatcttggtcttagagcagtgtctacagtagctacagtttaaaaatgacaacagctaaatgagagcactgtcagcctttaggctccagttcaactgataataaaagcaggaccctaatgcacatggaaagcatgacaattatgtcctctagctaaaggatatgtaagagagaaggtgcagagcattctcaaggacagtgtcttgtcattgagatagcatttcagtcaatgctataggcagaggcctctagacatccccagtcctcattgtagaatttgccaggggtggggtgggcactgcaaagggggaatgcttaggtaagggcatgatggagtgtttgttgtagcaaaatccttctttgctttctgaataaatatgactgtcctttagagtgcttttagccggaggaaatcagcgaatgttcttgtgggcatgttcagcacacagactaaatgtgaactcaacatgggggagagagagcaggaggcagaaacatagaaaatgactgacttactgattgattgtttgcttgattgttcaggtggaagaaaggcactacaactgggacttttgctcaaatcatagtctccctctccgttttagttcaaacagacaacatcatttggaactgcccagcatggggtttctttgtgtaggtatgccttgtcctctgagaacttcatatatagtactatgtatgtatcctgagagtaatgggtgaatcatgttcatgctattcagatgggtggggcaggcactaatgaatgtctttcagtgagtgctcatcttgagaagactgcaagagaaggacggttgtactgctgagggttagaaagatgttggcagtgagtctgcagtttgcttattctcccattcaggatataatgtgggggaatttggaacccagcagtgaccaaggccaacaacctaacaatcgcaaagctttctcttggtggggagtgaaagggagaaaattgatgagtactaactgcatcttaacctttgaatggtgggctaggatgggaaaggaagtaaagtacttgttctatgctttaggaggtgtcattggatccagtgagtgtcattggtattagaggctggtcacatgtacctggatacatcagttatctttaccaggtttcccagggtagtgggggagaaaattgaacagaggaatcaggattagccaaaatgagatcctgtgagctactaagagttttgtccactgtagttagagggcttatgctagagaatggggctagaggccagatcatgaagtgtcttagcacacttcttggcagtctgggtcttgttctgtaggttctgggaaggagtgtaaagaaaggaatctgtgaaccaaccttcatctcgggaaaagtttaacagatttgaatcaaattagccaacaaagaggtgctgggaacaaattaagtcacagattggtagttgaacttttcaaaataaaatgtttgggttaatttagtctgtcacaggggagataggtgcaagcactctcttggtgtcctttaaaagaaagaattttcatgcaaagttcctacttgctttccctctagagttgtgtacgcagctctaataaacagtcttccatgattcagtgtattgctcctgaaaaatagagacagtagggcacatgtttaggctatgttgtcattttatggattaatttccattactgtgaactttctggttttccgtgccataaatatgagcaaaacatctgtccgtgtcattctcttgataaaaacaacagcagcagcagcagcaaaacaaacaaacaaaaattaaaaaaaaaaacaaccaatcaaatagaaaactgtttgccgactccccacttctacatgaggaactagtcccagattatgttcttgatgaatgtggctctccataagcagacctctctagctcatctcatccatcttcccctttgccgaacattagcagactcacaaacacagcactctaagctctctgtactcaatgtcattctgtttactgctttccccatgctacctgtattcaccttgcctgctctgggatgatgatctcccatcatccagggatcagctcaactgcttcttttctccctcaccagcagaatgaatctctcccttactactctctgtatatctcgatctgttgaggagccctaccttccaatcataacatggcccttgctgtattaaaatctgaacagctgggattactgccatgacactgtcaggagctaatgttcccttgctgagcggaaggagggctcctgtggctgtacaggagaggctcccaaggccctgctttctgtctccagggtatatataactagttaaacattgccaggaactgggctttttcacccaccttcctgtaggtaactcaaactgatttcatttgattcaccaagcttgaatttagtggtatccgttttctgttctgttattggtgtcctacttgaaataaatacatatttatctccacccaggaaacgttaacatgctaccatcacagcccttgccatgctctctgtgtgaaagcatggctgtctgcccctctagttcatgaggtcactaagagccccggatctgcgtcttgtccatctttcagcactttgtagctcactgcctggcccatggctgatgctcggttagtacatgtgaccgttttgttttatcagtgccctagaagaattctcaggggatgactgaccagggagcctcacttttgtaacaggttggtcaacaaaattttaaatgaggtgtaggatctcctcagacattaaaatctaactgtgctaatgagcaactgggtttctgtacagggaacctatctcttaggagaccctgggtttttccctttctgtatgtacaaggaagtgaaactgggtacgtgatttttttttttttttttttacttttcttttttaagttttgttaatcttggcatacatagtaattgggcttcatcaccccacagtatactttaggtatttaaaaaatgattcataggtcctgactcataatattccaagtctcctttctctgtgtgttggtttagctttgctatctcgacacaagcaagagtcatccgagaagaggggccctcagttgagaactgttcctatcaagatggcttgtaagaaagcctgtggagcattttcttgattaataattgatctagaagggcttggcccattgtgggtggggccaccccaggggaagtggccttggggtgtatgagaaagcaagctgaatgggccatgtgggaagcaagtcactaagcagcgttcctccatggtcctgcttcagtttctgtcttgacttctccatgatgggctataagctgtaagatgaatcaaaccaaacatattagtagggaagtacttaatttaggctaaaacagtgtgggtatgataataaatctgcccagggtgtgtacaggtcaataagttatcgaaatgcagggccaaacggaggcaggtgtgcattttgagttatagtaggagagataggattaacatcgactgggtcactgtgtcctgtaatagtaagaaatagagaagttcccaaatttttacagatgtaaactttgcctttatttctctaagaagcttttactgtgtactatcccatctagtggtacagacttctagtagtgggaggggttcacaaaaaggaagaaggaggaaaataagatccaagatgaccaattatgggaaagactaaaagatttgctacaagatgccgttttctccttttcaagattcattttcaaactgggacctttcagctttctttactcgttgtcagggccaaattaatgaagtggacagatctctggtgcaatctcatgtaggaaatgacatgtggctgcatgctctaaagggttcagatgatgttcaggtgttcactatttcactgacagtaaatctatggaacatttgtacatttggattttttttttctactgaagaatgcaatgtatgccatgactctctttaaaagtaaggggaaggtcagggggaattctattttattgttttggggtttgctttgttttttcagacagggtttctctgtgtagccccagctgttctggaactctgtatgccacactggactccaaatcacagaggtccacctgtctctgtctcccaagtgctaggatcaagggtgtgtaccaccagcacatggctagtgagaacatttttttaaggtcaaaactatccttgaactccagggcttacatagttctgtctcagtttcccaactagtcaggactgttagagatggctccctgctcctagtaactccgtggtgatcacagacatccaggcaggttaaaattagttgataagcactgaataggttgtttgtcacagttgggtatgccttgagagcttgtattttgatttttccggaaagttgttatgtcttgccaaggtgcatttttctcctatcaacaatggtgttaaatcaaaatagtattattcatattgacatcctctccgttccctcagacccttctgttcatttccccgtgttcctgtcttgcttttgagtcatttaaaagttattagcacaaagtgaataccaagtcaggaagaattgaatccaaatcagttcttgcctgagagccagtgggttgagttaaggtataattactggctacagtgaagttttggggtagagagttcattggcattctgcttactcctgtggagagaatatgggctatttgcataatatctgagttggcagtaaagaaagcatttgtaaagcaagctaagcctctcatagagcatgttgtctcattagaataaaatcttttttactttttcagactagttctcaaaacaaatagcaagtagacttggaaagaggaaatactcttgcattaaaaatttcccgtgttaaagttctaaaattgggggaaaatagggagggataggtaagcctatttttcaccagttgtctttatgttcagttttaagtaccttcaaagtctcattttgtggatttttagagttgtaagtagttccttaaagctggaaactgaaaatcagttctgaagactgttggctctcctgtcctcttgggtggcccctctggcttggaaagcttgtaccaaagaccagcctctttgtgttgtgcagctgtctatccccaggaaccacaaaagcctctggctttggagttctcaccactccctgctgggttcctgctaggttccttggaggatattgagatgaattagattcagagattcaggtcccttgacaatatcttacttttttttttttttttttttgtaatttgattcttccccacttgaatctaccagctcctttcctcaaagtaaaagatccaaggtgttaatccctactcattgaagacaaatgctaaattggaagcaacagcctagaaatgcaaaactccttatccaattccaattcaagctctcccagtcagccatgctcagcatcatctgggtcagaagggaagatctcatggtggcacatgcctttaatcccagcactctggagccagacacacacacaggtctttgtaactttgagagaagcctggtctacagagcaagttccaggattgctaaggctacacagatataccctgtctcaaaacaaacaaacaaacaaacataaaatgaaaacaatcccccaaatcccatgcttccaagttttagaaaattataaaatgcaaagttcattgagcgaaacaaagcgtggtaggtaagatcaagaatgaagaaatactaagtatctgttgagtttagagcacacaggcttatgggtacatattatggttaagatcaatattgtactaaacctcactttcctcatatgtaaaatgtacataaaaaagaagaaaagctcctgggatttttttcagggagttaaaagaagagacatatagtgcttaacagtttgcataatggtgccgagtctatgaagcaaagtgcaaggcatcatctctgctgagaagattctgctgagcaaactaaacagcaaagtagttgagtgccaaagtaaagctgtgtctaagtgcattccacaatcaatgggaagagtactgtgggttagagaagacgcaggctaggctcgctcaaaaatagtaaggcctagggagatggctcagtaggtaaagcacttgccacacagccatgaggatttgagttggaatccccagcacccatatataagctaggcagtctagtgacctgtctgttaccccaggcctttcagtaggtcaagacctgggattcccaaggggctagctgttcagactagctgaattggttcaataaataaagtggagaataatcaagaaagacacctgatgtcaacatgggacctctacatgcatgtgcacctgtaccaccacacacaagtgtgtccacacatgtgaacaagcatacacaaatgaatacacatgcataagagtaacaaattgataaaatctgattttctgttgttaggtatttttttccttgtgtatgtgtgtgtgtgtatgtgtgtgtgtgtgtgtgtgtgtgtgtgtgtgtgtgtgtgtgtgtgcacgcacgcacgcacgcattgataaggacttcctgcccggcctcaaatgcatccatcttcttgcctcagcctcctgagtgttaaggcgccaggggtgccattacacctggctttctcctcgagtttatgaacaaaagtagaaatgcaaaaactgatcatatactacatactctcacgcaatgaaggcttttgattgaaataagtggtaatagatggattcccatgtttctgtgtgtaatgtggtttgtggcagcactttgatagaagctacactagacattggaaggtatgcagaaaccaagtgtggctttaagacagcttccaggatcaagtcagatgtctaggtttatctgccttgcaccgtgagttaagaggattctcaagggtaaggtccaattctttctgtgtccacatcaccagcagctagcacagggtctggcccttagtagggacccattaatatgtcacatacttgaacgtgctttgttttctctcctgctggaaggaaattgccttcccccagtggccattttgagtacagagggttattttaagatattctcaagagagaacactagaaactgctgttgagtgcctaaaaggaaggaagagcagaatgacaaaggggagtgtagaaagttccaagtgaaggggatggagggagaatgggatggagtggcttatctccttttgaatatggtgcttcttccttttcactgtcatcatccataagagaatgtgattccagcacttgggagtagtgtcatgaatttggggctggcctgggatacctagtaggtttcaggccaacctggactacagaggaagacccttttctttaaaacaaaagaacaaaacctttcaactcagatgccactgtctcaaaatcacacacacaaaaaaagaaattttggacaaaatcactgtcttaagccagttgttgccgtggtctttattaaactgaaacctagtgtggaacgtggcttgttggtggtgaaggtttgaaattggccccattccaccctcatttctaagctttctgctttccctcccagtgtttgataaagaagggaatctctgcagccagtgctcactttagacttgccgaagacacattctctgaattcttcaagacaactggtttctaaaatagaagatttactggtaaactcatgacctttagtataatacctaagcagaagttaaatctggctgattttgtgatgcatccagagaaacatgacattatttgtttttttaaattttattcttgtctattgtgagtgcatgtgtgtgtgtggccggttgttcatatgtgctatggtgtgcatgcgcaggtcagagaacaaacagctccatagagtaggttttagttgtttccttctgccttgaatgggttcccagatctgaggtggtcaagcttgagtgtcaagtgcttcacttgctgagccatttctgaggccactttattgtatgttaaatgaatggatctgtgcttctgtttcttttttttgggggggggtggtcatgacagggtttctctgtatagccctggctgtcctggaactcactttgtagaccaggcaggcctcgaactcagaaatcagcctgcctctgcctcccgagtgctgggattaaaggcgtgtgccaccacgcccagcttgtgcttctgtttctaatggtaaattatatagacttaactagtcatgtgtattttgggcaacattcagtgagtgagttgtcaatatcaggagtcacagtgtctactataatgctaacgtgtgtatttactcatttggggattacagacttggtattttgcacatgtatagttaaaacgatgaaagaacagcacattggatgtgttagagctgccacaaagaagaatgtccaagttgtgatgctgtagagagaccctcggttggggtccattctttccagtctttttaccaagactgcggctgaatctacactgatgacttccctgtttcccccatactaacaatgataagatggtctcaatttgtagaattgtgcatttcttcctagttttaggatttacacactgaaggccatcaagagttccacttaggcagcttaaatatgcatgtaacccatgaactacatacatctcaagtcatggttccaaaatgattattgaaagtttttttttaaatactagaattaggtaaacaatttattgtctttcacagaagtgtcagaaggctttttagtaaataaatgcatctcaatggagatgttcttagagtggaagttgagcccagggtctcacataataccgtatgatatctgtatatctgtatcacagagctacagttcctgtctcaatgaacatatttgatttgaggattgtatacaaatacatccagtttgtgcaacactgacaagaaaaggaaaacaggatcaggagttagaaggtatggtttggggctgcagtgtagctcagtcctagagcacttccccgccacaaacaaggtcccatttccagcctgacaagaagaaggagtgtgagcttgactggttataatgacgattctgctgatgaatgatgagcctctgagccactcccgtcacatataaagttaaaatgatagtaatttatgtatgtacatgatggacattctgtcaggtcagtggggtgcagattcaagtgctttcttaatgatgcaaagtgatcttcaaatgagcagaaggaaaaccaaaccaaaccaaaccaaacaaaacaaaacaagactactaccaccaagttatttcaagggaacttatggctcagtgaataagggttttgacagacagttcgctttatttttctccggtgaaaactgagtaggttccagatttaggctgcagtttttcttgtcactcctcaggaaggcaagcctgaaacatgtgctcacttcactccagattgtataaataaatgcctttgccttttgtttaacactattacagaactgtagaggagcatgcagtggggccttgctgctatttgaaggattggtgaagttttgttcattataatgcaggtttctggggttataaaaaaagtctttgtaggctaattattatacaaactaaactaaaaggaaaaatcacaaacatgaaagaaaagtacattttcttttcttccttcttttgtttcttttttctttcctccttctccttctccttctcctttttttttttttttgttgttgttgttgttttttttttttttttttgaagacaggagccctggctggcctggaactcatcatggaccaggctggccttaaactcagagatccatttgcctctcccttccaaatgctgggattaagggcctacccagctttcatttttttaaatatttaacttaaaatattttatgaatattcatatatacatacaatgtgttttgatcaaacccacccccatgaaaactctgtaagtgtagttagacgtttttctttgataaccatagaaatctaatgatagaatgattgaaaaaaattgaaaagcaaacttaataaaggttatgatggctggggagaactactactcaacccacaaatccaaccttttccttctctctgatgactgaatccccctggaaagggaaatagagggtttcagttgcctctcctttttttaaaggcccaggtcttcgttagagcactggttctgaaccttcctaacactgcagccctttaatacagttcctcaaatttacggtgacactcaaccgtaaaattatctttcttgctacttcataactgaaattttgctacttttctgaattgtaatgtaaatatctggtatgcaggatatgtaaaacgaccccccaaaggggatgcaacccccaaattgagaaccattgtgttggagtaagcattgtggtactcagaatagttactctaattttcctaatatcctgaatctcgtgacagaggaaatagaaatggcaactcagaaacttaggttgaatcagtttgaaatgaaaagtaaaacctttttttaaaagtgtcctttaaaatgtggggaaactgttgctttcatttctacaaggcatatagtttacatctaaacacatgattcctttttgtcatagggtttttatattaacatgacatgaaaaagccaaaaataatttctttttttttgtcattttgctaagttgcttgaagcaggtgtgtgtgaaattcctatacagagaagttaatagatgttaattcaacaagttacacattgaatttggactggttttaatatattttattttaattaactttgtagtagtaaggattgaatcgagggccatctacatactaggtaaatgctctgtcattgacataatgaaggttgatatcgcaaccttccttttcagtttttttttttcagggtcttagtatatagcctggggtgacctggaattcactctgaagatcaggctggccttgaactcagaattctgcctgattttgccttctgagttctgggattaagggcatgcaccatcacacccagctcacacacaaaaccatggaaattattgtacatactaatgggtacatgtaatattttgaaatgtatatattatatgtgtttcagccatgttaatcatatttatttcttcaaatgtcacttctttgtggtgacgatttaatatatctttaatatttttagatttgttttattattttttttatataagtgctttgcatcacatgcaagtctggtgcctgaagaactggtgagcatctatggaggtgctgggtcctttgcaagacaaatactgtcaaccactgagccaactatctagccttagtttactacatcttaaatctgtattcagtttctattaatacaagttaaataatttcatttaaataaaacatccttagtagaaattattgacaaatattgtttaaacaactaatgtgtaattacttagaatgcatgtcaggacatggttctaagtgggtctgaatatctcaaagctcattatataatgaatgcttggatgtctaccatgcgcagtgaacaaattacagcttttccttggttctggtgctagcacttcacaactgaatcttgctggaagggaaaggtagtccttttccctttactaatcatagagatgaaatttgattcacaggtttaggtcttctattgtaggaggctccctgtctttgaatagtcagagaagtaaaaatagatcatggtatattcagtgaaagaaaatgataggcaggtacatagtggaataatctaagttcaagtcgttcaagtccttgcatattaatatccttttgtatttttgagtgggggaagagactgcatgagagaaaaagaatgagtcttttacaggcacagacctagggttgactttcgactctgaagatttatttaaccttagttaagtcctctttctcaactctaatatgggagaattgattatgcctatttcataggttgttagagcattgcattggaacatatacagaaagtacttagcaaagttgatggctgctgagcaaggaagagttgtttttttttttttcagagacataagccctgagaagccatttcatgcttttagaagatggtcccacacccatgcacatattaggcagtactaagtggacccagtgaaattttaaacaagaagttaagagatgaagtgggggagatgggagaagaattggaaaggagagaatgggagtggacttcatcaaaacaccttatatgcatgaataagtagtaaatatagtactttaaaagaacacgtttgatgctatcattattagtagtattactcctcttcctataccatcttttgatttctcatcttcattggctctgttcctcataaaatgacccttaggctggggcccttctatcaatgatcagctcacttaactgtccaacaggaggccacagagtttacctcctgaaacctcaccctttaatgccatgtcggcagaattcagcatctccaggactcttgcttgtcatagcaaagctggaatgtcataggctttggattgtatatttggcacagggaggacacatgaatgttcatattttctccactttagttacccagcaaatagagcacattcactaaatctctcataggtttttaaatatactgtttttgtttgacttaaaattcagggtattttttttttggaagatataaacaacatggtactctttctttagaattctttttttatgtttttatttttttaatttattttaattttttaatttaattttatttcttaattttttattgggtattttcctcatttacatttccaatgctatcccaaaagtcccccataccccccccccctactcccctatccacccactcccactgtttggtcttggcgttcccctgtactgaggcatataaagtttgcataaacaatgggcctctctttccactgatggccagctaggccatcttctgatacatatgcagctagagacacgagctctagagggtactggttagttcatattgttgttccacctatagggttgcagatccctttagctctttggatactttccctagctcttccattcggggccctgtgatccatccaatagctgactgtgagcatccagttctgtgtttgctaggccccggcatagtctcacaagggacacctatatcagagtcctttcagcaaaatcttgctagtgtatgcaatggtgtttgcatttggcggatgattatgggatggatccctggaaatgatagtctctagatggtccatccttttgtctcagctccaaactttgtctctgtaactccttccatgggtgttttgttcccaattctaagaaggggcaaagtatccacactttgttcttcattcttcttgagtttcatgtgctttgcatcttgtatcttgggtattctaagtttctggactaatatccacttatcagtgagtacatattgtgtgagttcctttgtgattgggttagatcactcagtatgatgccctccaggtcaatccatttgcctaggaatttcataaattcattctttttaatacctgagtagtactccattgtgtaaatgtaccacattttctgtatccattcctctgttgaggggcatctgggttctttccagtttctggctattataagtaaggctgttatgaacatagtggagcatgtgtccttcttaccggttgggacatcttctggatatatacccaggagaggtattgctggatcctccggtagtactatgtccaattttctgaggaaccgccagactgatttccagagtggttgtacaagctcgcaatcccaccagcaatggaggagtgttcctctttctccacatcctcgccagcaactgctgtcacctgaatttttgatcttagccattctgactggtgtgaggtggaatctcagggctcttttgatttgcatttccctgataattaaggatgctgaacagtttttcaggtgcttctcagccattcggtattcctcaggtgagaattccttgtttagctctgagccccatttttaatggggttatttgattttctggagtccaccttcttcagttctttatatatattagatattagtcccctatctgatttaggataggtaaagatactttcccagtctattggtggcctttttgtcttattgacggtgtcctttgccttacagaagctttgcaattttatgaggtcccatttgtcaattctcaatcttacagcacaagccattgctgttctattcaggattttttcccctttgcccatatcttcgaggcttttccctactttctcctctataaatttcaatatctctggttttatgtagagttccttgatccacttagatttgaccttagtacaaggagataggaatggatcaattctcattcttctacatgttaaccgccagttgtgccagcaccatttgttcaaaatattgtcttttttccactggatggttttagctcccttgtcaaagatcaagtgaccataggtgtgtgggttcatttctgggtcttcaattctattccattggtctacttgtctgtcactataccagtaccatgcagtttttatcacaattgctctgtagtacagctttaggtcaggcatggtgattccaccagaggttcttttatccttgagaagagtttttgctatcctaggttttttgttactccagatgaatttgcagattgctctttctaattcgttgaagaaattgagttggaattttgatggggattgcattgaatctgtagattgcttttggcaagatagccatttttactatattgatcctgctaatccatgagcatgggagatctttccatcttctgagatcttctttaatttctttcttcagagacttgaagttcttttcatacagatctttcacttccttagttagagtcacaccaaggtattttatattatttgtgactattgaaaagggtgttgtatccctaatttttttctcagcctgtttattctttgtgtagagaaaggccattgactcgtttgagttaatattatatccagccacttcaccgaagctgtttatcagttttaggagttctctggtggaatttttatggtcacttatatatactatcatatcatctgcaaaaagtgatattttgacttcttcctttccaatttgtatccacttgatctccttttgttgtctaattgctctggctaggacttcaagtacaatgttgaaaaggtagggagaaagtgggcagccttgtctagtccctgattttagtgggattgcttccagcttctcaccatttactttgatgttggctactggtttgctgtagattgcttttatcatgtttcagtatgagccttgaattcctgatctttccaagacttttatgaatgggtgttgtattttgtcaaatgctttctccgcatctaaggagatgatcatgtggtttttgtctttgagtttgtttatatactggattactttgatggatttccatatattgaaccatcctgggtgaggtgggagtgctgtgttctgatgatggtgagtggtcttggcttctgttagtaagattcttatgtgtgcctttcaccatctggtaatatctggagtcagttgttatagttgtctctggttagagcttgttcctcttgtgattctgttagtctctatctgcagacctgggagtctagctctctcttgagtttcagtggtcagagcactctctgcaggcaagctctcctctttcagggaagttgccaagatatctggcgtttgaacctgcttcctggaagaagttgtgttccactcaccagagatcctaagatccggtggagattgctctggcgaccttgggggtgtccaccgactcactttagaattcttatctacagcaaggatgggtttgtcaggttcaagtgcttggtgttcacatgtgtttgatatatgtctggatccatacatatgtatggaaaagttttctcttattaaagcagctgtatgttcttattagttcaacacccccgtttttggttgtgtgcttgtttgtttgtttttgagacagggtttctctgtgcagccctggctgtcttggaactcactctgtagaccaggctgacctctaactcacagagatctgtctgcctctgcctctggagtgcagtgattaaagacatgagccactactgctggaacaattcccattttgtgaaatagtgaaccttcactacacagaatggaattttcttcttctgggagtctgacagtaacatttttttttgtctcttacaaaggaaaaggccaagttagttgaacccctggactatgaaaatgttatcactcaacggaaaacccagatctacagtgatcccctcagagatctgcttatgttccccatggaagacatatctgtgagtgcacgtgtgcttttaaaaggaataagcactttattttccaagcaagttcttagaataagagtatgatttgatttctagatctcagtgattggtcgtcagcgcagaacagtgcagtctactgtaccagaggatgctgaaaagagggcccagagtttatttgtcaaagaggtaaggggctcaacagccagccaaagagcctttttttctatttgttttattattatttttttattagtgtgtgtgtgtgtgtgtgtgtgtgtgtgtgtgtgtgtgtttgagtttatgtgcaccatgtgtgtgcagatgcccacactggccttttttgggttccctgaaactaaagttaaagacagttgtaaaccacctgatattggttctaagacataaacctagatcaaatgcaatagcagtacatgctcctaactgccaagtcatctctccagccacctgccagatgattttggtatatatatcatatatcatctatgaagtttaaattcaaatttagtttttaaatgggaaataaaattactaaacttaacctgtgtaacaaaactgtacgatgtaaggcagaagcttaaacatttataattagtatatggggttttgttgttgttgttgtttgttgtatttttttttttaagatttgagtactttgtcatgtatttgaagaaatagtttttagaaggacatgtgaattagggtctggccttgtcagttgggctagatcacttgttctcaaccttcctaatgctgtgaccttttaatacaattcctcatgttgtggtgatctccaatggcaaaattatttttgttgctactccacaactataatgttgctaccattatgaattataatgtaaacatctgtgttttctgatggttttaggtgacccttgtgagagggccatttgacaccatcatacttgatccccaagtcaagatgcctataccaacatttctcaattaattaaaaaatgctgtgggtatttcaccagaccttggcttatgtgtttgagacttggacttgaggttgcccttaaattcacgctctttctcagctctctaaatgctgggggttacaggtgtgtgccaccctggtcagctctaccggacatttaaaaatatatttctttgttttctttttctatgcttgaaatggattttcctactttcttccagtgtattaagacctacagcacagattggcatgtggtgaactataagtatgaggatttctctggggactttcggatgttgccatggtaagtttagaagggaaataggagaattctattattattgtcatcaccatcatcattattatggttatcacttagctttttagaaaactcttttgaaactcctgttataatttatgagtcagacctcaaacagcagcatatttggctcatgtagtgttttgaccagttgagtatgttttgagtgtgctcattgacactcttcccagtaagtgtgagctcacttagttggacacatccatattgactacagaataatctttagtttattctggaaactatagggacagttttcccagtggtgttggtgaagaacttggaagctgtttaaatcagtttgatacctgctgatatcccttggatgagatttggggataatctcagtgaagttgaagaactgtcatgaggactactgacccagtagtcatggtccaagttgtctttctgctctttcctagctggctaggtttgaaccatccagtcaacctgtttgagctctcctgtcaatcccatttctctactgcatgactgctggtctcccagcatctcatctaggaaatatgggggtggggtggcgggagacatttgtgaagtcctctgtagctttcaaaaacattttcctaggaaagaagctactaacattagcagtctgggctcccaaagcaaacaaaacagaaagccaaaatgacacagtgttgctttctgacccgtggaaaggtaaagttctgccactcctgacagccctggcagaggctccttagcaacttctgctctgcttgactcctatctgctctctgttttatctttgcagctggctgcatatgtgggagtccttctatacaaataaggcagtgttgaggagatagcttagtcaggagtttttgcttagcagaaatcaaacaagcagacagaagaagcttgggtgtttattcaggaataaggcctatgtttgaaaaaaaaagtgtacttttccatctcttgccttgcattttcttgcttttcagagaatgaggttgacttcaggttttgtttgttggtgatgcttataggctatgttcagagtctaaattaattttcttgcactttcagcaagtctttgagacctgaaaagattcctaatcatgtgtttgagattgatgaagattgcgagaaagatgaggtaaggatggggctagctgtctgccattcttaagctgaaagggaattccttaaagggaagatgagtgatgctgaaacaagtggttatgagtacctgtggccacctttctaaccaatgaatgttttttacttaaaaaatgcgattacacttcaataactattgagtgcctactgtgtttataccattgggcctttcattctatatacggtcaatattttaaatatttatgaaaagtgataacttcgtgtttaattaggaaatgggaacaggtctagttctttgtctgctaaatgttaactaaataaatgattggatgattgctattctactgatggtttttattctatttcaggattcatcttctttatgttctcagaagggtggtgtgataaaacaaggttggttgcataaagcaaatgtaaatagcaccatcacagtaaccatgaaggtaggaaatagttatatccatctatcatttgaagtatattgacatatataatgaatctggagaaatgtttgttttctaatgaatcctcaaaaaaatctttttttaagttagaatgtagaataatcggtttcattatggattatttaaacacatatatcataatactttgttctcatttgttcccctaccaaaaagtttttaaatgaaagaatcttaacagatgcatggaattttaaagcttcaacctcagatcaaatttagaaatgttaccttttaaagacagataatgaagctcttaatgtctgacagaagctgccaggttaatgaaggaaatagctttgcaaaaccagccaccagaggttcctatgtggaaatggatttaatgaatgaatttggcgcttattaatactagtgactgtggggaaatatactgacatctgggatggggaagtccgttgtgtccagtagcttcataattatgttagaaacataccacattaagtcctacataaaatagtgccttagggtggccaagcctatttggaaaatgaagcagtttgactagatactgaatttatgtacgggactgtgggagatagaaccaagaacactgaaaggcttttgtttgggaggcagcgaagagccattaaaatctagaggaagaataaatgagctccttgaagattcactgcagagaaattattccttgataccaaatataactgttctttcagatattcactataagatcatgtggcttcctgagtatgattcacagtaccattaagtattgaaggtcattctagctttcacatagcctgaaagcagaaaccatggatgtctaccaaaggaagactcaaattctatcttaatttaatactttgcctgctgcttttccttcagtggccatatcctgttctcactttcattttccagcccctaagataatgaatccaagttgtaggatgtttcctatgtatctgttatatcaaagcatgagatttttacatgtgtgagataataagagaattgtttcaaatccatttgttagggtatcaatgtattctaagcaccataccaagtttattttacatctcatatttatattctgcatttagtctgaatggcagttccatgaagtgagcactgttattattattcctagtttccagatatggtaaaataggcatagagaaatctgatggctaaacagaattccaggacgggggatatggcttagagagtaaggtgcttgctatgcaagcatgggggcctgagtttagatccccaatagccacataaacaaaaccactgggtaacattaccttcatctgtagtcacagcacttggtatgctgagatgggtggatcaaaggggctggcaggccagcaaggtaaatgaaaagggagttccatctttaccaagaggccttgttatggaaagtaaggttgaaaatgatcactgaagacaatgccatcctctaccttgtgcatgtgaatgctcaggtgaatacaccagaacacacattttcacatgcatgtgtgtatacaccacacgcacttatatataaaaactaaataaacagagctctaagtttttcaggagtaggatttgatcctatgcaatctattctcttggccagtacattgtcatccttagtcgctgaatgccacattgcatgtcctgtcttcaggttcagaaacacatgtgtggaggttatagctctatacagatggacagaaaatgagtctgggtttttacactttttaaaagatgcataatgtacatatttatatgttacaatgtaagctctcaatacatatataaagcataataaacaatgaatatattcatgtaattagcatgttcatcaacctaaatatgtatcaccatttcatgaatgcatgtgtatgttcatgcatgagtgtgctcctgcatgtgcttgtggggggaggggggaaacatttgaaataatctttactagatctttggaaataatatgattatgcttgccatctgtactatactaagctgtagaaattattctcaccatctgactatatacccttgtgtgctatagattaaactccattcctttcccctaacattctcaaaatattaagctgttttacctgtaccttaggtttaacacagagctaagtaaatatgctgtaatggcaaactggattcataagatattagtaagaaattaatatttactaagcaattcagaagacttttaaattatttctcaaataacactgaattgccattggctttactaacaacttttcaatttcttaagaagacataattttaggttaaaaatctccagttgcctgtaaaacagttcacggtttatatcttctttcataatttttaaaatacacactgatgtggtagcaagactaatgaatccccaaagatgcccatgtcctaatccctagaacctgtaaatgtttgcttacatgacaaaagggaattcaagttgctaataagccaatagggagacgatttggaattacccaggcaggcccagaataagcacaaagttcctgatacgtggaaggcagagggaggcaggaaaggagagtcagaggaaaagatatgaacagaagcagggtcgcagagagatgctttgtggctaattttggagatggagaaaggagtcacaagcccaaagatgatgggaatcctcttgaagctaaaagaaagcaagggagtagattaaacctgtattttaatctagtaagaccagtcacacttctaacctactgaactataatgtagtaaatctgtgttgttttaagccaccaagtttggagtaatttattatagcactagaaaactaatacggtcagccaaagattgattgttccgcttggctgtaacctatctctgaggttgaaaactcccacacttacagggacaagggaggagccataaattcatggcgtagaagtgtaagtctgaggtaacctggggaccacatgggtgaggtgaagaggccagctgctactttttgtcagctaaccatgaccttgtcccgttgagctaggttctttgctttgtctctttctatttccatctacttgctatgtagctgaggatgaatgtgaacttctggtcctcctgcctctatctccatggatggaacccaggacttcatgcatgccagttatgtactctccccaatgagttgcacccccaaataggttctttcttcttaaagccaccagccaggggacattgccctcacaaccataggtgtcctgtcacagggtgggaagaagctcttctgaagtctacattgcttccagctcaggagggcagccagcccagctcttgcagtcaggaggggcagaggtataactaaagccagaggctcataggattagaggtgtgctgggaggaaagcttctgtttgcttctagtatgtgactcttccaaataaagactactcagtaatcaatctcagtaagcaaatgggaagattattccagtgtacggttaactgagtacatttcccagtactggaggcaggtttatcctgggtgcagccggagtttcctgcatgctgggggcctctttctgtactgatgcaatggaaggtttagcaaccaataccacagaactgacccccagagaatcttcttttatcagaaaatccatgttttgagagtccttgctcagtcccagcaagccaggaaactgctgcagaagggcctaggtattcatcatcactcatgacaaataacagcccacggaagccacgcttctgtctttgtgttctatctgagtctccgtgatgggctggggcctcacaccagcctgcgtagccccttgaggctggcgattgtgcttcttctggaaagttatgtattcaaaagttttcaaattcattttaaaccatacaaacaaaaaattctgaatcttaaaaaatattctgcttgaatagctgggcctggtggcacaggcctataatcccagcacttgtaagatggctgcaggtggacagatctcgaggccagactggaatataaagggaaatgatgtttcatacaatcaaatcaggagcagtgctatgtagaatcagttctttaggatgtttgtaattatacacaacaacttctgcttttttcctgagacaggatttctcagtgtagtcctgtaactcacactgtatgtccggctggcttcaaactcagagatccacttgtctctttgtcccaagccctaggataaaagatcttctaagacctttgagctgtcacaaataagagaatcatgaatgaaggtataagaggaaaatgcgaaaaggtcagaagatacccagcatagttcagttgatttacaaaaggaatcagaaaactagttatttttgtgatcatttgagaaagcaaccatgcagccttatgcaatatcaacaacgcagccaatgcaaattatgcctggactactttcaaaaattaaacctcctgttgtaactgccagaactctgtcacatcgtttaagttgattgtgatggaccctacagaaaagaagggctggcacatagactttgctgagttcttaatgctggaataaaaattattttttccccagtgtattgttcccccgcaccagcccagaacagttaagtttagtcaataccattcactgcaattgtcattatcttccccaaagtgctttctgggtaacctcattatctgccaacaaagtatcacggagacatacaggcagtgaaagagctgctaatgatgtatctagcttcacagtgagacacagtcactctacagagtcacagtgcccaagcatttcctctccttaaggaggatgctggcctcacacagctcttgcaaaggcaaaggcgctgattgttgtctggagacagtgaatttttttttaaatttccagcacttgtaaattgccttgttgtgagcagtcatgttaagacaggacacgctttattacagtgagcaatttcctcagtttgtgctttctagctagtgagaaaccaccccatttcaattcctggaaaagaactggagagaagctgaagataatcatagagaatctatgatcacttaggcagaaactgcagtcccaagagaagcctatttggttggattatctttcttaagtagctgctagagacatctgctttattcaacttgttccctatcactgagtaaaattaatgtggactagatagctgcgctatcgggcatggccttcccctggtatttagaactatttttcctaagaagcataatgatatatggaataaggaaaaaatttgatcttgagggtggtttttagtttaaaagagttgcatattcttggctaagccttgggacacccacctttgtgcattttcttggctcagttttgatcacattccttaggctttctactccccattctcagcaattaaatgttgaagtgccttgctgtgttatcggggttgcaagttcaactgtctgatgtatgactcacttcgggtgcccttccttttttttttttttttccctacaaaagagagccatttgttatacatccagagcccagaagtctttattactctttgactgctgaaggataattctcttcttgctagggagaaagcagcaaatcaaaagaggatttcatccaagaaagcacatccaatatgaaagtaattgctaggagttcaaggtcactgtgtgtattggaacaaaagagggataagatctattactttgatttgctactccatttgaatgctccaatttactagactgcaccttacagtaaacaaaatggattaatacttgtttatcataggcagggggtttctgactaatttgcttttctgtttaatttctactcatttgctgactactgctcaaattccacttatttgatgcttcctgtatgccagacactcttaggaatcatcaaattcatcaccatatatacaaggactactttattatacatcctggaagatagaagcatcacatgtgacccttaaggctaaggacctcgttggagatgtgagacacagcataaaaatagttttttaatgggtgccccaataccaactccatgagcatggggtctgataaaaccaagccttgaaggaagggagtccctaaggagagtaagtgtgggtatggtatataaaaatcatgtgctagatgagcactggtagccatgctaggttaagttgattgattcctgagtatcctcctatgcgccagtttctcttttgctgatgtggagataaagatagtgatgagcacatagcactgtgtgagtggacatgagcagatcactcagagacactaaggcaggaaagcatgccagtcattgttattttatagtacgaggattataagaggccaggatctgacatgtgagcctgatcatgccagaaacatggcaccatcaaaaaaaaaaaaaagttgggtttgtaggctcttgcctgtaggccagtacttgggaaccttagagcaggaatatcaccgtgagattgaggctagtctaggctgtagagggagagtctgtctccaaggaagaaaaggaaggaaggaaggaaggaaggaaagaaggaagggagggagggagggagggagggagggagggagggagggagggagggagggaggaaaggagaaggaggaagaaacaggaggcgaggatagcaagaagttgagcaagaccaccattgaaataagtatgagaaaataatgtgtccacaatgacaagggaggattgtagctgccttctttcatggtttgcttcagattcatcttaaaaatctccagtgctcagctatgatagaattattcaggaaaagagaaaaaattactttattttgaacccagtttcccatagcgtagaattatgaaatctattaaaatgggacaggagtgtatgatgatacggaaagagatgagttatagggtgccagctttctggaagggggtctccagaaagacaatgcttttgccatcctagtttaactaagtgtcagttagttttctcataatgttttggggttttcttctttactgttccttctatctttgcatccttacaccattatacttgtgagacttaccgtgactcatgctccccccttttccttggagacaagagttgcacaatgcaaccccagactggtccttaacttgtaatcctttcacttgtgtctcaccagtactagggtcctgctttctccttttccatgctatcctgccattctgtttagtttaacacagccattaaatagaagcccctgcctcatttctacattgctgctggccctcctactctgtctcttatttttcagatcattccttcttaggacttctgcttgatataatgtagaggaagtacccacactctaggtaacacatataggtgagcacccttgcagtttattatataagatggtaaaaaggttttcctaattggaaagcagggtagtaggcatgggcagtccacctttcctgctcatcttccatctttgatgcaactgagtgacaacctttgttcctggtccagaagaggtctaaaatgttaccttcccaacatttcaggggcttgaaaagacttcgtatgacatgatccctgagataggctagtcttgaggatgcatgcttctcattagctaagatggggaattgtaatctgtgtttactatctaagaaaaataataaagccaaggagatgagaaggatgtgagcattacagagaagtagcattctatttcatgaaagtgttgataatatgctagaggatgaattaccatgtttttttctttttgaaaaacatgtatgcgctataagcattattgtggattctaaacaaaagttgaccttaacagtgtggaaagaaacagtaaaatttaagagatagataaatggaggtatatttggatagggttcacactgcaaaagagtgctacattgtttacaggtacttatagaaaaaccagtcaagtacggtcctgaaagaaagtggaaaggagattctgtgactattcaggcaagagaattccaggctaagggcaagaagagaaatgatttaaaggagtccctttggggttcttgactaatgacacataaagcagtgtagctggagtagtgtgattagatgcacaggcacaggctcaggagatggcttagttggtaaactgcttgccctccaagcatgaggagcttcatctggtcccccagaagtaatatataaaaaccaagtgctggcctgcttgtaatccccatgccaggaaggcagagatagaaggatcatggtgcttgctggtcagctagtctacccagctctgaggtccactgagagaccctgcttcaaaaaggatggagaaggctggagagatggctcagcgattaagaacactgactgctcttccagaggtcctgagttcaattcccagcacccacatggtggctcacaaccaactgcaatgggttctgatgccctcttctggtgtgtgtgaagacagtgaccgtgtactcacatttataaaataaataaattgtttaaaaataaagatggagagcaatcgaacacacacatatacacacagacacagacacacagtgacctgcggacatatgtaccatgttctaagctatggtaaagatgttatttatttaaaatctgttattattgttgttgtttttgttgttgttttgctgggtctttttgagtcagggtctcaaggagccaggattggtatcaagctcttgatcctccagcctccacatcccaagtgctagaattacagttatgtggcaaaatatctagcaattttatctatttcgtacaaacatgttacatgttaatgaggtaacatgagttttggaaacagatatacattttatcatgtttaaatttgattgagcacatattctcattattgtgaagactttcagtccttacttttttgaagtgtgcaggacatttcataatcacatgattatgtaatagcaccccagagctgcttcttcctctctggctgtcactgatgacccctcccccactgcctttcctctgcaccttccacagcttggattttgctctaacattagtgggaagccattgcaaagtttgagaaacactctttgtggatgtcacaggattctgacttcaatttaagtagtaaccactgtgaacttaaatatgttcttagtccctctgttaggcaaggtgggtggatatatatatatcctgtaaaataattatctattgctatccaaggactagaggcctttgaatgaaagctgtgatgtagaattattattttaacatctatcttctttctgaaatgtacaaaagtatttacctgtaaactaaatatttacatcttggaaaattttaagatattgtgcttctgatttcttcttgtttctgtaggttagagttaggatgttcctttcttcttcgaaaaaaatggaattccaaactttatagaagttaaaaccctaacatatagcagttctagagagatgcctcaggggttaagagcacttgctaatcttgcagaggactcaggtttcattctcggcatccacgtggcagcttataaccatcggcaactatggttgcaggggagctgatgccctctttggcctccattggcagtggtcatgcaagtgctgcacgtacatacatacatacatggaggcaaaacacccacacacataaaatgatttaaataattatttttcaaaaacaggtacatcatttgaatttgaattttagaatgagaagagatcagagccatctcccaatctgttgttcactcacaaactgttgtctacacaaggatggcttaaaaacaatcctaatccacatctgtgtagtcattgctactctggtatccgagacaagaggatcagttgacccaggagtaaaaggttatcctgagcaatgcagtgagacctccatttcaaaaaaagcaaactaaataattccttgctgtgcaaatattgtgcttctaacgtgtgggctcacgagtgtttgtgtgtattggcggtgtatctgtcagcccaggaaagttaatatgtaacttgttcagtgaactttttttaatgctgtggagcatctcacctgctagtgtatgtttgtgttagggggacataactgtcactaggaaagctaatgtgtaacttattcacgttcagtgaaatgattgtggagtctgacaaaatgattttcaaaatcatctgatctggtccaaccatgttacaagccaggagactaaaagaaaaacattgtcatgggaggccctgaatgatgggcaagatcctaagactctgacagatctgtttcttccaactgctcttttaggcagatgctctctctgacttgggaactacctccagcattactgtgaggggtaattgctaagttgcagggagtcatttcctacaatttcatatcctgttgctaatcttggaaggtggtggctgctgcagaatgtctttgcttggtgacacagctgtatgtgaaagcatttgtgcagactgtaatttgactctaggctacacatagtttgctctttgttcttccttctctggcctctctatgggccctgcaagcagatttggccagctgcatctctaaatctataaactttgagttttacatttggtaacatttaaaattttaattaggttgcaagtttttttaatcatattaattttgcccagaaatattctgatttttttttgtcatgagatcaatgtcataactttttttaaaaagtcatatttgcaccagatctcactgcttagtaaattattcactacaaacaagctcggtatataattttagggttttctggttctatcattttattaagaaatgtgaaccggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaagaaatgtgaaccattgtcagaaaaatccataaatggaaagaatatcatcaccagttttgttgtttttgagacaggatatcatattgcccagactggctttgaactcaccgtgtagccaaggaaggccttaaactcctgatccttcagcttcctgagagtttatgggcatgtgccaatctgcccagctatagtagccatttttgtttagtttaacaattttcatatatatatatatacacactatgtgtgtgtgtgtgtataatgttacatgtataatggtataatcattacttgttaaatatgcattcatatataatgaaatacttgagtacctcccatctaaaaaatcccatattcactgatttcagatttttggattaaggatgtattcttttaaaatgcttctctggccccaagcactttagttaaaggctattcgacttgtatataagcgtatgaaaaacataagtgcacatacaagcatattttctgtatttctgagtctcaataaagtaacatttatttgaagcactaaaaaacaagctggtgttttctgctttgtctcccttctgttgataaaatatattccatatggctactacctgaaatagaagctgccacatttatccatctaatttggtaaggggttcttaatactggtttatttatgtattcattcacaagtagatggcacttaagtccaaaatgtctttaagcattattattatcctactgctttttatttctaaaatgaaacagcccataacaaatctgtataattttactggttcatgctatagagaaataaatagttggtgttttgaaattctttgccaaaagcttacgtagttggcaggaattatccggccaaatgatgttcttttcataattaaagtcctttaaataccagaccacagatcatagtggatcatccgcaaatggcaagcttaagtcttaaggccagcttttgtgagtaagacattacacataggcatgtatttcctctgtgattacttggagtctgtttttttctgtctctgttaccattctcgttctgcagtggttttagacacactatcctgggaaattatgactggagtaagttttcctttcactatgataaatgcttgacacagcctgttgtttttgacctattgagagaaaaaacaaaaaacaaaaaaaaacaaaaaaaacaacaacatacaaatctcaaagtgttcctaaatgccctttgctctcccctttcattgtgttctatgggagtgttttgagggagaaagaaagggacagcatgaaggaattcaggcagtcttcctctttttcctcattcctgtgggctttgctgtgagttgtagcaaaagactactcccacctctgatctcatagcacagtcctctttggcatattgatttagacttcagcatgcaggcatccagcaactggtctgacagctcgtggttctctctgcttccctgggaggaatctgtatgtagggttttggagagcaagagccctgatccactataagtgtcatatgaggtaaaggtgatgtaaatgtatattcctttatatgcttggattgatggagataaaacaaagttggaaatgatccaattgtagcttgtaattagattaaaagggatgctgggtaaagaggccagtgattcatatgtaaaagtacttcatacatattaaggtgttagatactcaccatttcttatatgtttccttatctgagggtaaattacatactacctttaaagaaacaagaaacaaaaataaaaattaaacttatttatttatttggagggtgtgtgtgcataaatgtgcttgggtgtatgtatgagtacaggcttgcaacagcatatgtgtggatgtcagaggactatgtacaggagttggttctctccttccaccacttgagtcctgggtatcaaaatctgttcaacaagcttggtgtcaagtcccttaacctgagccttctcaccagctcagaaacctgattcttaaacatttctggagattgtctgactgttgttcagatatggtagctggcaagacgtttaaaatttttagttcaaataaacatccctactgttaatagtttatgttacaagtggatctttgctgcatttctcattataggtgttcaagagacggtatttttatttgactcaacttcctgatggttcatatattctcaattcttataaagatgagaaaaattccaaagagtctaaaggttgcatctacttggatgcctgcattgatgttgttcaggtaaggctattgcagtaatcattctttctctttcgctaagcaggttgttgatgaacaattaaaaatctaagcattctttccttcttggttgatgctatccccatgcccaaacacctatattaaaaatttccaaatcttctaagtacaccactttcattcagtgccaatatttaaaggtctatcaaacccatttgagtctgactccaaagtacttcttgatgcatattatcttttaattctgggctttttctctgagtatcccttgtattgcctgtcctagagttctgccttcttttttgttttgagattcctattattatcattatttttattatgagtacttgttgtgaatgtgggtatgtgcacatgagtgcaggtacccgtggaagcaagaagagggcattggattcccctgaagctggagttacaggcacttataccccgcttaaggtaggtactgagaactggactcaggccctatgaatgaactactaaacactgagccatctctctacccctaagtcttgccttcccaccttccaatttgctgttttatgtgagtccatcttccttcctgagacatacagtggatcattcagttgtattttcaaaacctttggatcttgatttcctgtcccacaatgaaagatttaaagaattcaaggcccatgggggttttcctttagcctatagtctaatttcatcccttttcattcctatataaatccatgttctgatcacaacacacagtatattccgtagagttaaggcatgtatatggcttccttatttattatttatttttgtgatgattagaattgaatttagttttgtgcatgctaagcaatatttgtagccaatgtttactgttgacacaaaaccttgctaaattgcccttatcttttaaaacttggtttacattccatttcaaccttaaagtgctttctgtttccttcctcgctttcatatccacaggtcaaatccagttccatgtcccctgggctatcatttggctcttacctttatcaaaaaccatactttaaattgtgttttgttctcttttggagttgtgttgcaaaacccgtctcactcattcctgtatctcctacaataattaataaggctgtgcacaccctagggagtagcaaatgtttattgatttggattactggagctatagacaaaggtcaggtgggaaagagatgtgcagaggaaatatttgaatgtaagtcaattgacagagggaaggagccttgagctgctgaagagggagtgctgattagttcaataactttagtttatctgaatccttattttcaaaactgtagtgttagattaatgagctccacgtactctatccaatactattccatgaggtgcaaatgcaaagaaattaaaccgtgagcatctgtgtaaattcaacatgttttttatctagttttgtttagtgtgcatggtgccaaggctggaacttcaggtcttaagtaaacttagcatcagccccagtccaaaggtgctttttaaatacaaaataatcacacctttgaattttactcaaaagaaaagacaggcacacatgatttctagattttctcaattagccctgatctagttccctttctttgtattgttcccacagacatccatttatgattccctcttcctagtattttccaatgcataaacctttacaacttgctacgctggcttaatttcatcctttcctatgccttgaagacagaaaaggaggaccttccttggtttcttcttgaataatgaccatgcagtagagaattattgatctatgggcctatgagtcttgacatgattgctgaggctctggaggggatactatgccacttcgtttgtcatgacagagaaggtggtaaaagaaaaaaatgtgttattgggtttgaaaacaggatgggtttttttcccttctattctaatatgtagtgtagaccactccacatattttaattagagtcacagtttaatgtgaaaccgttatgcccttcttttaccctagtgatgtatttgatactgttcattttgaaataaattgcatatgtgtaataatgagaaaatataaaggaagcattgtatttgtttcaggtcatattttcacttgcttctatcaccgagttttgaaaatctataaggaaagcacgaaaaaaattttgagtgaagatagcaaaatgcattcttgtttgaatggtggtggtttgcttttctaaatgtgaaagatcccaaagaccctaaatgattgatgccaacttcacccttactccattttgttccaaactgggaggagcatcaaagataggtttaacgtggtctgggagtttgtataccttattgaaagaagcaatgattttgtgaaagaattggtatacatataggctgagctgaggtaaaagtaacgtgcaaatgaatgcatttaatattaaagagggcagcttatctaattgaccaagtgtttccctttctccctttctctagtgccccaaaatgcgccgtcatgcttttgaactcaagatgttagataagtatagccattatctggcagctgaaacggagcaggaaatggaggaatggttgataatgttgaaaaagattattcagatcaatactgacagtttagtgcaagagaaaaaggacacagtcgaggcaatacaaggtaaggattttgaaatgatttgcgcttgaggtaaagccctcattttcaatccatagaaacatcctttgtgttaggtgaagatagaaccttaatattgaaggctaacctgcttctttatgaagagtggcttcagaagaggcttttcaaagagttggtactgcacaggacctgccatttaaaacacactcggaagaaatttgcaccagattttcaaaagtccattgaagcttttcctgtgctttcataatcccaattctttgtcataaatctagtaggaaaggatggagtgggagcaaggagagtcctcttaggttattagtaacgctctgtatggtttggaacatctgcttttaatgaatttgcagaggaggaaactagcagccaaggaaaagccgagaacatcatggccagtttggaaaggagcatgcatccggaactgatgaaggtatatctttcttatggcagcttgccttcccctgacacaaggcagggcaagatagtaaggttttagtgctagatttcatttggaaatgtcactttcaagttcaaaaccccaccaaacttgttaaacaggtagagagaaaagatacagtctaaatgatgcactgaaagtgtccactctcagtgtggaaaatctttttttctcctttctttctttctttctttctttctttctttctttctttctttctttctttctttctctctctctctctctctctctctttttatagacacaagagaaaagaagaaaaaaacattctaagcttttgtaacacctattttgtctatttttattcaatttgatttgatatataattaaataaatattcttctttcaatgggctaatgatgcagttcatgcaaatgatattcagcccaaagacacatggtaatttcttttgtaaattatgcaaataacttattcagataaagacttcggtgagcagctattgtttgtattgttttacccttctttgtggagtttgaaatgaacaaattttgaaagtagacagttattaccatgtgtatcttactctgtgttctatattataattaattgaaagtgacaaaactacttatttgtttcaatcgttgctgagtctacgtacatttttactttattcatttccctggcctggtgatacaaacttatttctgttttttctcttttcaatttagctctctctttaaaaatttaaaacgtctttaaattactgcactgtactcatgacctcattgctgtctatgatttagtggattttagtcgaatcctttttatatttttcagtcataatagactgtgcagttccttatcttccctaagactatagactcagcactgtatatgataacaggtgaaaagcactatggagatgtcagacatggtattggtctcttttatttcttgtttgcatccaaagtcttttagacttacatttttacactgagtactacatgtagaatattttagatcttatggaaatatataaagatcagatttgtttcttattatgagtctcaataatgtgatacagcggtgatgaagttgtataaatgacatggctaactggtatttagcattgttttgaaggaaatgtagcaacattatggctttttacattttagtatggcagagaaacagaacaactgaacaaactcagtagaggagacggaagacagaatctcttttctttcgactcagaggttcaggtattgatctatttctaattcaaacttgatcgagattgttttagatttgtcttattcacgttgaacatgtgtgttaactgaatcttcatttcataagactgttaatagcatggggctgagtgtatatatcttttcctcagtcctttcatcttgctgttcaccatggataaattagataatacctagcaataatttcagtattctctggatccattaagtacacctgtgatctagtgctagtgaatattcacaatataaagagtgctgaatgtaatgaactaaggcttttctccatttgatattggtatcaagaacaggaaaaatgtgtagtgtatggctctcagaatttccctcataaagaatatttcacaaaattatttggaggagtgaattctttgttttctttcccccttttctatatgaaaccctgttgaacagtttattattgttgctgttgttattgcgcgcgcgcctgtgtgtgtgtgtgtgtgtgtgtgtgtgtgtgtatgtgtgttatttgtatcccgtggcacacatgtggacgtcagaagacaacttggtggatttggtcctttaccccttaatgagccctggggattgaacttagaatttctaccatgtacggtagtgcctttagctgctgagtcatcttgattttgttttaaatataaaaaatatattatatgagcacagcaggatttagctcagtaaaagcatattaagagaatataaaataatttgagaaaaagatgattttgttatttctttttatgcttcatagagtactctaattgagtatgtataatgcatactttgataaaattaccatgtaaagttgatatcatgtgtggttcttgcatgtgtatttggggagggtatgtgcatacctttctgtgcacctgtgaagtccagaacttgacttgaaatattgtttcctatcactctccttataccttaaaatggatttctcactgagcctggagcccactgttttagctagacttgtcagcaaacccctgagatccatctgtctcttgtcatgttctccagctctgggcttacaggggtaccgtgttatgccaggatttcctgtggatatggaggctcccaatgaggtcttcatacttgcacagtaagcacttcagccagtgaccttaatgccagcgaattattttttttaaaaaacaacttctattttgccatagcaattctatatattgttttaatgtcaattatgtgatacatacatatagatgttggtgagatggtctagttagtaaagatgccaatgacttaaattcctagaaccccctttaaaggtggaaggagatgattctagaaaattgtcgtctgacccttgtgcatgtgctattgtatacataccaacacacacacatacacacacacacacacacactaacggacccgcacacacactaagtaagtaaatgtaataaaacatagatcagtgagtttcagagatggtagctctgagatactcattcagaaaactacttgttgcaagcatgacttagcctttgattgccctcagtgaatgggctgtaattggacatgtcaggctctttgacggagtacaaaggaggcaattgatggtggttgaaactaaatctagtatctttaaaaacttatgatgtagtgtttttgtggtcatgaaactgaactgatttttttatcagtgagctccagtgagagaaaacccacaaatgaatgaatgaatctttaaggaccatctttaagaatgtagtgttgattgtggaaggtcatctcaccacggagtaatgttgtgttaagaagaaaaggtgaaatgctatcccctaatttcaacttccttttctggtcacatttcaatgtagagagagaagatttttgcctgtgaccttaagggaataatgaaatgctattttgactgaagggatgtggatcaaactttaaactgtggggaaggccatatagctcaacgtttatacttggggcccatagaaagagaaggatttgggggaagaggtgctttgggccaattactcttcacattccaatgtccacattctgaagacagaaaatagagcagataaatgggcagaaattagaattgatctccatggcaatggcttgcctctgctggccccatagataagtgtttaaaagggctctgcctagtcccacacttgaattatttttgtagatagagtcagagtgaggaaaccatacattcagatacaaattttacacattagactctttacatagggcttttattatcgacacaggctgggtcaaaacagctataattatttagattcttcaggtataatacttgttttgatgaagtaactgaggaaaaaaatcttatagttcttggcttgattgttccttcttgtgaacagtctttggtcaaattcattttgagtcatttctcccctaccatgctatggcattaatgaaagtgtaagttgttccatagtctacacttggctttctgtttgcaactagaatggacaaaggtacttagactatgtgagccttgggaactggaagctttctctgaggaaacacagattcctaccctactcagaactgattcccagtatcttttgtttaaaaattgtatttatcttgaaatgcaagtactttttttttaaagaactgtatcctttatggtaattaaggcacattcctcagttctattataagctgagctcaagtttatctatcttctaggcagaaacctctctctctccctttccttctccccctccccctcccctggctccccccctccatcatttaaatgtaggtggttaccctgggtttcagccttggctgcctctcaccctagataccaatgactttccaatccttaccaacaacccagacctctcagttttccagccatgtaattacctcaaactcaaaacatccctaactgaattgctcatttctattcacctttacccccaaatctatcattcatttgtatgacacaatgaagtttttgacttcagtgtctctgagatctcctgggtctgacaccactttgttgttcttgttgccttttaaacctattcttgttagtctgacctcctaaagagcttgtgaaggaaacaaatcttactggctttgaggatatattttatgaataagaagaggaggaggaggaggcaggaggtagaggagcaggaggagcaggagaagaagaaccaattaaataatactaaaaaataatgttagataaatctaagaaaggacatatagactgtccggatgtatgcattttttttttacagggagttggggatgtgttcattgctttaggtcaggttctcatcatctccttccaagagttctctgtcagctctcaaaagttgctataaagtcttctgacaaatcttgttgaatgaaggcattaaagggggtggggttcaaatggacagagctattggattctgctgccaattctaatatgctgatctgaatctgtatctatcagtgttattatgaatactgtcttcttaaacaactcatactatctgtttttgcagagattagacttttcaggaattgagcctgatgtaaagccatttgaagaaaagtgcaacaagcgtttcatggtgaattgccatgatttaactttcaatatcttgggtcacattggagacaatgcaaaaggaccacccacaaatgtatgtatgaccctttcttctactgtgctggacccagcatattaaagaaatacctttcttttttataagtaagaactaattggcaggatgaaaattccagtgttaaatattatgataaatttggcatgaagaatttcatctttttcttttggccaaaatacaaaggtgttctcatcttgagagaattcctgcaaatcttacctcctcagagtagcacatagagaatgtgctctcttcaggacaggcatgtccctagaagctggaaaaaaatctgccctcacactggatttgactaaggaataggatttcttttagaaaattggttcatagaaattaattagtttccccaagccttagtgagacatagatgctgtttagtctgctaggctcactcattatcctatagaatgaaattcattcttggtctgtgtaaatattaggtatcatgagttgacgtggtctgaaatacttgccactgtaaatttcaaatattcagagagactatataatgttcatctttattttgggtttctagtttcaaaaatatcaagtaaagatattctttcacaaagtacctaaaacacatcagagcactttcctgcctgcaaagggttaatctttatgccatctggcatgaaatttctctttgtgagcagctttcaaatgccatctgtaaggaggaatcatgtcttccaaatttgctgatggggcagagcattttttgagtagttcactgttgactgatgctggcttttatgaattgtatagtctagtacattgcagtataccagaaagtaattgttttctaatctataagttagcaatttttggagtcatatcagtaaatgtatagagatataagttttatttgtagatcaatttttctttaggtgaaacttttgaatcctgttcatctttttaaaactataacttgttaatttttgtgaattcataccttggaaatttatacctgacaaaattaactttttatcttaatttaaaaattaaaattaaaattaaaagtcttatttctgaatgcctctcctgttattcgatgcataacaagcataatgcacttttaattaactaaatactaaactcagaagataacacaataaactcaaacttgaagggaaaaaaaacccgcattatgcaacttttctccaaaagtcttagttttaaaatgccaactgtcttcattcctaggttgagccctttttcatcaacctcgccttatttgatgtaaagaacaattgtaaaatttcagcagactttcatgtagatttgaacccaccctctgtccgtgaaatgctgtggggtacctcgacccaactgtccaatgatgggaatgcaaagggcttttcacctgagtctctcatccatggaattgctgagtctcagttatgctacataaagcaggtgagtgttgatcagtttgcagcaacttcagaacaagagagagaagcgcctttccttattttctcgtttcaggcaattgtcttatagcattccaccttttagaaggtctgtctacaaatggtcttttgctgactgaggttggcaatgggaaatgaaaagcgatgaacatgttagtcacattttggcagagtgacatttttaggtagaaccatggtaggaaatccaatgggaatattttgggaagtccaatgcaaatgtagcgccagatatacacatgtgaatacatgtacacatgtacacacacacatacctcctctgcataagtgccaaaacattgggaattttagggtcagatattatgttcattgctataggttttttaaggactctgggtctgtgatagcttttccatagattaaaatccatgtagcctctttgcttgttctttagataatagttgccagatacaggaacattcaccaacaatgggaaaagctcacaaaagagaagttgacaaagtacagcattcttaattagtatatgagaacccgatattgaattctatgtttctagtttccaacataatgtcgaataagtattcttaagtctgtttattgtattatttcaaaatattggatgttgagataggaacttcagtggatcaggtgattgatcgggtggcattcagtaatctacatcaagaagaaagttatcattgttgttattttggtattgagatgaagttgtattgatccaggctggtctggaatgcctggactaaagatattctcctgccttagccttctgagtagctggacctacaggtttaggccaccatacctaatctcaacacttaaaaaaaatgtcctttctgtgctaacatttccactggggtcttgcataatcaaaatagttttgtggcatgacataagtgttattccttcacaggcaagcaaattgacgattgggggttgggtaagctgtccatcatgacatagctaagagtgctaaagataggatttgaacctatatctgaaagatctcaagcaacagtattagaaagaatgccatgtaactaagttgtatgacatgtaccatcaccacaagcactgctggatcctgggaattgtattaggagtggagtgaggatgttgatatattctttagaagaaggtggcagtgaaatggctaggagtcaccccggtgaaaaagaattaaaccagagcctttggcacagaggaccaaagtctcagccaacaacgggctttctttagtaactttctacatcaagggacagggagatgctagacagttatggggtcacatgcagaaccccaaagggtgtgccctacccctgcattgtagcccttgtcagtaaaaacaaaatggacttctaggagctggggagatggctcaccgtgtaagtacctgctgctcaagtgtgaggaccagaacagatctctaaatatgcatataagccaggaaggcttagtggtctttctataatcccagcacacagacaaaggatctcagagacagagataggatattctggagcaagatgactatccaggctagtcaacatggtaagctctaggttcacttagagacccttcctcagtgtttaaaatggaaagccactgaggaaggcaactggtgtcaaccttgggttcccacatgcacacacataacacatgtgtatcgtacattctaaggaacacatacatcttcacacaccacatacatacatatagataataaatgaacctctgtgtgcctcactaccctctcctctaaagtgagagcagtgacactcctacttcccatggccataatgggggttagacaagatgtactatccctagaaagcactctgcaacaggcacacccaccttgttccatgcaacaccttttctcaactcagtgtgcctgttatgggtatctaagtgagcttagataaaggagggaaaacatgtgcttttatcaattgccaagaattattaaaatataacattcattgctggctttagtgtggataaattccaaggtggctggaatgggaaataataggtactcagagaaaggtagcaataccaatggtcagtttgactattctaacctgtccacatcatgtgacatactggtgcatggaccatttggaagccgaggatgcaatcttcttcactgtccccttactatataagtatctctgagcctctgtttctgaatcctttaaatgtgtacataactagtggcttcactactactcagtagggagaagaaaataatctatgagaagtagagggagagagggatttgggagggagagaggagggagagggaaagagtagctagttcagatatgggagaaaatgggggaggaagtacagagggtcaggaatttgaaaataggtgtgtagcagtgggggagggggaactggggggtagccactagaaagtcccagatgcaagggacccaagaggttctcaggacccaacagggaggactttagcctaaatacccaacaaaggggagatagaacctgtagagatcatatctagtggataggtacagcccccagttgagggatggagccacccacccaactcaaaaatattaatccagaattcctgctgtcaaaagaaaatgcagggacaaagagtggagcggagactgaaggaaaggccatccagaaactgctccacctagggatccatcccatctgcagataccaaatggggaaccccttggtcctgtggaggcttgatgacccagaataagggaactctaggcctctgaggcaggagtggttgggtgggtgagagagcaccctcgtagaggcagggggagggagggggcttgtggatgggaaactgagaagggagataacatttgaaatgtaaataaataaaataaccaattaaaacatgttgaaaatgaaagtgcagtaagataaagcatacagttaggcatagttatgcataaattatttgacatgaattagacttaattgggcatgatagtatataccagctgcttgagcctgggaactccaggccagcttagccaacatagcaagatgggtatgtggcgagaagagagggaggaaggaagaattggaaggagggagggagggagggaggaagggagggagggaggaagggaggaaagaattggtcaagtcaggtaagaagaaagagatggtaaggaagagaaatggagaagggaagggaaggagaaaaattggaaggagaggaaatgttaaaaatgggaagggaagaaaaactgaaaatgaagcatttaggaaatccaagaaattaaactggacaaataaattcaaatgggaagccactataaacgcctaagacttgaatgttgcaggtgtagctttttggaatgtattaacagactactatttccatcagccagaaggctaaggaatgtcatcagatagcacctgaagcctctacagagctttctttcaagtaatctacctagctgatgactttacggatggatttgaaaagtgccttgatttataaattcctttgttctatatctgtaaaaatttctcaacacagttaccacattggaacatgggattttgggtaacgtgaatctgtgttagcaggccatgattgcccatgtttggctccagaatcaactgtctcttatgcccctaaaataaaaacaataatcaaaatagaaaggactgaatgcaagtttcagttctgagcacacaccttctgcagttgcagcatgtcaatctattagcccagctaaagagcaaatgtctttccagcaataccagaaaccaggttctgtgactatggtatagtttgataggccaccctagtgataatcagacacctaatatgtgttattgcatcaccccatgtaagaaacttctgataacaatattattctcagtcccatcacttcataggacctgagatgtagaaacccgagatgtaggaatggccaagccagaaatgaacccaagcagtctaactcctcaaccatatttttaccttgttccatgtttgtttgtgcttgttgcttggtaatccatcatccagacttgccataaattctttgaattggctggggaggagacactgctaacccctcacactgttttatgctgtgctttgtcaaattttgaagcttcagtttagaactcatgaggtaatatgtctgcaatgctttgaaaactagaaagcaatattaacaaagttggtaatacaccaagtaggaaaagaaaacttggtaaagacccactgatgggttattttatacaaattcatttgatgttccttcaagtatgcgacaaaaaccactgacacaatatttagagaatttctctctctctctctctctctctctctctctctctctctctctttctctttttggaaagacaaaagatggtatggttattctacacacattcaaataaaatgatgtcactttggctgtatccacatgggtgcccttaaagagaggatggagacactaggcaagttctagagcctctgctgcttctttttactttgacagcaccaaagcttttaaactgcagagttttccataagatggtttgtgtgtgtgtgtgtgtgtgtgtgtgtgtgtgtgtgtgtattgcctgtatgggtccatgtgagtatatgtatataaatgtgcatgcaggtgtggagggcagagttcaacaatagtatcttcctcagtcactctttaccttcttttttcttttttttttttttgaagaaatttaatttttcatttatttatttacttggctttaatcatgtgtatgtcaaagtatgcatatatggacaaatgtgtgtgaatgtctacagaggccagaagactgttaggctcctagacctggagatacaggtgtttgttagccccacccccaacatgggggctgggaactgagaactgaactcttggcctttgcaaaaggcaactttctagtttcctccactttttaaattttatttattttatttatttttgagccagcatctctcggtgaatctggatctcttgcatccagctggactggttgaccagtaaactccagggatttacccgttttctccctagcactgggattacaggccgactgctggctttctgtgactgccaaactcaggtgctcacgcttgtgtgtcaaatgcttgatcaccccgccaattttctcagccccagatggtgagtttttgtgttagggaagcagtggaagtgtgttcttccttcttcactgtattcagtatgaattgtgagcgaattgcttggtagatctagctacttgggagacacggtatctttagtatataccaattaaaccaaacgatgtctattgtgttcattaggtctaagaactcaccttgcaaaacagccacggagaaggagcttggatgcatagggtgacactaatgacgaaataggaactgcatttggaagctttggaatctgtagcaaaagcagccagcactaccctgtggatagggtggggcgcaccgagggtaccagtgcttcagcattcaggtggcaggggcaggacggttgcttcaacttctaacctagcatgggctatgtatagctagactgtctcaaaagcagaaagcaccccaaacaacaaaaatgttctacctcttcctggaatcctggacatgatcctatgttgaatatcaacattctgtactctccacactacaagatatcagttgccaaacagccatatgtatgttacataaaaatatctaacagaagtcattttccccctagggaatcttctcagtgacgaacccacatcctgaaattttcctagttgtgagaattgaaaaggtgctgcagggaaacatcacacactgtgcagaaccctacatcaaaaactcagatccgataaaggtaattgaaaattggtacatattcctgctcaatagagaactcacccttttctggtattttaaaatagcattgtcagagacctttgtgatgaaaaatgatcttctctgaggactttttacattgtctactatggaaaactgtacctatatccactccaaggagtttattatcaatgtattgacttcaaagggctgctgttcactgtggtccatctcactctttatactatttcagtgtgatttctttcatgatgtgttcacatagtacatggtagggattttccattttctttttcctgaatgttcttaaatggcaaaattaaaagtttgccatttttatcattatcaaaatccttaaatcatgacatctgactggttagaaactgaatcctgtcctctcgtgtaataaatgagaaatctgagacctagggaagggaaggatttgtggagcaattaattcatacaaccatagttattgtgcaatttaagagtcatcaatctattgaatgttagattttactgtgctcacgtaatatttattaagaggaagatgctgaggaggcatgactaataggtgggggactttatttgcagtgtacacaaaagcctttagcattttgtatccccagggataagcatccagccagtgcttcgacgcctatttaggccttataggcagcttatcctctttgtcatctctcattgcctgttcaaacagcagctgctgcccacatgagactaattgcattgactcttgtcacttgtgccttatcttgggagtagaaggtcaactgtatctagaacaaacttcccctgtgaataatgagtatctgccagcagcgtggaaggaaatacacgttaacactactcaaagtgttcctagcagaagtctgtggtacaaaggagtccaatatctcattagtctgtcttctgaaatgaagaaaagagttgttagggagaaaacaacatacctttaagaattacttttttggctagggatatggctcagtggtagagtataaggctgttgctttgatctccagcataaaatacatacgcgcacacacacacacacacacacagagacagagacagacagagagactgagagacagagacagacagagagatagaatctaaaaagaaatgctttagttttagccttgaaaatgggtagcaaagatatattttaatatttatttatagctgtttccttccaggatttttggtgtgttataatgatgaattggggggaggtttaaagatgaatccatggcatatcgaacaaatctaaactcatctttttttctgaccatagacagcccagaaggtacacaggacagctaaacaagtgtgtagtcgccttggacaatacagaatgccatttgcttgggcagccaggttcgtgtaaatgcaatcctgacccttctatttttagttctcttaaattggggaccaatgtccttaccagcaattcagtggtccatttctggcaggctattagttgtgtcttgggacacttgggatggaaagcttcttcagactttgctatgcatctaagacctacttccaaaactctgcctgtgtgatgggaaatttcttttggtttgggttaatctgatggacactatttaatcttttattttaacacagctcattgctaaagtgatagaattttccctaaagaactagattatacaacaaattatgtacaatatgtccagtttttcagagttggctgaatttatggctttaaaacctatcggctgggcagtggtggcacacgcctttaatcccatcacttgggaggcagaggcaggcagatttctgagttcaaggatagcctggtctacagagtaagttccaggatagtctgggctatacagagaaaccctgtcttgaaaatcaaaccaaaacaaaaatatatcagaatcattctgggaaaaatgtactaaaaattttgatggcaaagaatacagtcatgaagtgcaaacttataattaatagattttctggtgaatcctgtgggaatcatgcttttggaaacatacattttctatgattcttatgttatagtagcttatgacagtgttttatccaaatcttgcaaatctacaggcaatgaggatttgaagcctgtttcttgtttatccccactttgaagtgtaaattcatcagctggtttgtggtacagcctgtacaactgactggaagttcttgggaaagggcatcatgttctgaataattcaatcaactatgttctctgggtgctagggaatagcacagggtaggagagttgaagtgaatcaacccttctgtcactatagccatttcatttggggtaaggatctcaaaatatatcatgtgctaataaatgacaaggcactattttccttgtttctcatactagtaaaacaaatgattgcctaggataggtgactggcaaaaactaatgcaggctggtattctagaagggaaattgtggcttataaaatatacacatatacttaattgtatctaccttaaaagtccatttctgctgctactactctttattattaataataataaagtttaactctgtccagaacactcacttatctaagtacttaatgcatattttgtttacatattttttaatacatttttttgccttgtaactccacttactctagagctcactattatgtcgaccaggctgtctttgaacttgcagcaatttcatgcccttgtcttgagaatgctgttatcacagccattcactcctatgctgggcctaatatataaatatatatttaagagatgggtaccactgccccatctttgagatgaggaaatggagacacagacggaaaggataaagaaaatgaaacccacatctaaactttagaccatgtagcagagtggatatcagcatatgggctatcccacattagcactgattctagaccactgtggcagtctcctgctcttaggcagttacagacactgcctgttgctcttttgccaggtgagttaattcattctgaaaacttcagagagaaactctgatccccccagttctagtgaggcattatgctgctttctcctgcctggattttttttcccatcagctgcagtatcgggatttactaagtcttgtccaggacatttaaaaagcgtatgataagcccctgttactagaaataaatattttaaagcaggagcaatgggctttgctgaggagtgtcgggtttctggctattgctacttccagtgcattaggggctcctatattactttccattttagcagcaaaatagctgcttaaaatggtagaagaggctgggtgtggtggtgcacacatctttaataccagcacttaggaagtagagggaggaggcagacagatctttaagttcaaggccagcctgtttcagaccagccaaggctaccaagtgaaaccctgtctcaaaaaaaaaaaaaaaaaaaaaaaagagttggggaaagcctctcaaaatcatatgattatatatgtagtaaactttatataaaattatgtttaggagccaatgtaatttttaatttttatcagttttatggagataaaatgaattatatatatatccacattaataaattttcacaaatacaacgaccactttaacaatgactggtacaatatagacagaaaggttcctcatggccctgtctaggcacccaggcaaccatccatctgattatcattggataaaattttgtctctcctgaactcatcattaaagtggaatcctgcagcatatgttcctgggattggttatgtgtactcagtatgcttttgagattcgttcctgttgtgtagaattccttttgggtggcattccactgcataatatgccagtttgttcattcatttactggatcaacttctgatgtattaccagtttggagtaaattttctgtgagcatccaggtagcatgtggaaccatgcccagaactacaatggcattgctgtagggtaggtggtgtgtgcttcactttgtgagaccccaccagagcactgtcatgcatgtttacagtttcgcattcacacaggtacaagttgagtttattggtacttcaaattttgtcttaaaagcctttctgttgctgttctagacccattttcaaagatgttcagggctctctggatctggatgggagattttcccctttgtataaacaagacagtagcaagctttcaaatgaagatattctcaagttgctctcagaatacaaaaagtaagtgtgtgacattgttatactaaatgaaaggaatggataaattaatgaatttctaaagtactaaatatgagttatatatgggcaaaattgaatacttaaaaatttgagattggaattcaggtaaccaatgcatgtaacagtcatcatactttacctctaaactattattgatttctacctaggccagagaagacaaaattgcagattatccctggacagctgagtatcacagtggaatgtgttcctgtagatttaccaagtaaggatgtattacatacaatacaattgacaattgtaatcagaacttgagtatctatcaacagtttactgcaggtttgcacagagttttaatttcctagggctttgcggaccagcaagggaaggagctagctagcaaaggatgtttggggtcatatgttgcagactgaggacatcctatatattgtaaaaaccttgagatagaagcattcttaatttgtatgaatagagaggaagttggtgtggctccgtggtaggatgtggtgggaacaatggaacaggaaatggtagtagaaaaagaatatacagaattatatagagtggtaaccccttagatctgtattttattttaagtacactgagaaatcactaaaggattgcacccagggaacaatacccaatgtgcatttaaaaatatataagagtgaaatagatattttttccataaaaagaatcattgaagggaatagagaaatggcccagtagttactgctcttccagaggacccaaatttaggtcccgccacctatatttggctgctcacaaccacttgtaactccagctttaggaaatctgacaacctagcctctgcaggcacctaaacacatgaatacgtgcacgcgcacgcacacacacacacacacacacagtcaaggaaatctttaataagataattgaaatataggcaggagttgatgcatatgcacacagattttttttttacaatgttctttaacttagagggaacttggaagctaacagaatcaagactgtcagtgtgcttcgaggacttattgcacagcattaccataaaactggatgcaatgattgaaattggtgtttataatttgttcaatgagatatcagataaactatcaagattgagttgtgtacacaccctgagactttaactttgctgtgtaaaaatgtgcatagagaggagactagaagacaacacaggcaaatatccatgctagttatctgtggtagtacaatgcaatgactgattgccattgtaaatctttaatttgtgcctccagaggttctattattagcatgcattgttttagtaatcagaaaaaaaaacccaactataacaaaaatgctgtgtccttaggctcagtttagcctgggtcttccttccacccacatgactggacaataaagaaagggtcgtatggctcttgacctctcctacaatggcagcttcagaaacacatatggttcaattgctcagacattttgtgtgttttattttattatggtaacacatcataaggtctataatttcaaaagaaacttccattattttgtagtgaaaatttgcacctgcaccaagttacctttttaaaagtgattcgccatgagctaattggaagcataaattttctctcattgctttcccggataccaataaaaacttgcagcgaaagctaaaattgcagccacaggagggaaaatgcagtgggtttcttcgcagagtttgaatttgtccaaattatgatgtgttatatttggcaaatcattcagtgttgagaatgaaatcacaacccatgtctggtgtaaagggtaaaatcagcactcactatgtccttttagggttcttaaagttgtttaactttttgtcaccaactaagaattctgttttgaaatcattctttgcaaacacagcccgtgtatttctagaaatgcaggaacgtgttaatgactgttaagttacatgcttatttgtgtcctaccatagattgtattacctcttcatatgtgcccctgaagccttttgaaaagaattgtcagaatattactgtggaggttgaagagtttgttccagaaatgacaaaatattgttatccattcactatttacaaaaatcatctgtatgtatatcccttgcaattaaaatatgacagccagaaatcgtttgccaaggtaagaaaagtatacattcttggagcgtgccatattattgatcatctgctcactgcgtgactcactttggctgattaatgattttaggctaggaacattgctgtctgtgtggaattccgggattcggatgaaagtgacgcgtctgcgctaaaggtttgtttatggtggtgatctgtgtgtctttttggaaaagattgtggagatgaaaatttagtacttgatggtgtcatgctgtaagcttaatgtctttgtatttcaacaagaaaatatgctggagtggcaaagataatatttcatttcctactattacatgtgaactaaagggtttgtttaaatgatctatagtcaaaggtagtgtagatatgagctgagaagatgggcaaatgtgggctggggatgtttatctatatgatggtcctgctctgtagtatttgcctagcatgtacaaggccctgggttccatcttgaacatgagaaagtggatgaggttcccttattcccttttgacatttattccacttgaatttgcattgcttagaggtccaatcacaaggtcatttttttaaatgactaaatagtttataatgtttccttcaggaggccttatagtgttactattaggagaccttcaactcctttctctttgaaacctgaacaggcttgttgagctacaggagcacagcatgatggctttgatctgagctaggacttttgctccacaactggccaaacagtgcctccaaacttggcactgtgatctctccaaggcagagtctcagtagcatgcagtgcagccatgaatacccattatgatgcagtgcctttatggttttactataaacttcttcttcttcttgagcccagtgatcagaaacctgagacagaagccccaaacaatgcagccatcacaaagtgtgtatatggttccgtgcttctagcttgaatctaaagcagtcatactgtaacccactagagaaagataccccagcactcccaactaaatggtcgaatattgtactgcccctgtgtttgaaaggcgctccctctctcccaaagagaacattaaattcaattaaggattagctggctcaaatgcagtggaatttttcctccctctgcttgtctcttcagtagggatgagaacaaccagttccctttcctccttaaaatatcctttgagtatcatgtagaaacccttaggttacttctcagcagttcttggaaaaaaaaaaaaaaagagccttgacaactgtatttccggagaattggctgtggacttgtggagtctcaatttcctttcttagcctcctggaggctcactccacagtaagagtggagcagttagtaacttggcatgctggctctgtattcatccctgagcttattgggccaatggacgtaaaagtaaatcagagtggtcgtgaaatgggagcattccaaggaaccatagaaagccttacatgtgatgccacaaaacaagtgattttaaaaaaaaatgtgccttataaagtggtaggttaaaaaaggtaagagaagctgggcacacctgtaatgtcagcacctgaaagacagaggcaggtatgcttgcagatttctgaattcgtgatgagcctggttttcatagtgagttccaggccagccagggctacatagtgaaactctgtctcaagaagcaaacaaacaagcaaagctttatgatgtaagagaacagtaagcttatctgtctgtagcttaatagccatttgatttttttaatttttaggttgtttgtttttttaaaaaacacaccttaaaaaaaaaaaaaagcactcaaccaggaacatccaaaacgaaaacttgcaaaggtccagctatctgtcctgaagagctagaagattttagagagcatctctctcctaaaggggaaaatatctgcagcatcccactgtcagctagtttggagagcatccttttggtggccagatgttggaaagtgttctgtagccagctgagttaggaactctctggagtgctgtctgcagacactgcttttaagtgcgcgggcactttcaggcttatgatagcagctgagtggactcacccacacccctactctcactgcttccaaatgtatgtgggtcggtaacatcgtgttaaaagacctgggttaggaatggtgactctgttcctatcttttacagtgcatttacggaaaaccagcagggtctgtttttaccacaaatgcttatgctgtggtctcgcatcacaaccaaaatccggagttctatgatgaggtaaaaccctgacatttcagtatttacaaaattcagtgcttgctaattcctttctttctttctttcttttttttttttttttaaatttcaagccattcatttgcccatgcaatccctgaatgttttgtcccatgaaaattgaaaatgtcacattgaaaggaagggctcatgccctcatgatagcctatgatgacagggtgagatttacttacaatatgaaagacttctctggttatgatgataatacacaaatctcaaacaggacctgcaactctggccctcaacatttttctcagactggctctgtttcaatgaggaagtcaccgttgcttttgggggtcaccatttcttcagcattcaaacaaatccagagccaggcctggtgcagttggcctggaatcttggctgttctggagtattatacgttcaaggcttgtctgtgcaacttaattgggggtatctcaaaatgagcattaaaagggaaatataagccaatcgtggttattcacctgtaatcccaacatttgaaatgatgaaacaggagggtccaaagttcagggtcattctcagtggcatagcaagcttgaggctggcctgcgctttatgaaaatgtgtcccaatacttattgaaaacagatctggggatgtagttctcaggtaatgaatttctctagtatacacaaggccctaagatcaagtcccaggaccagaaattaaataattaactacataaatgtgggtgtagccaatgaaatgagaaaagagactaccaggaaagaggaaaggggtgttgaggaggagggaagggggatgggcaatagtgaatacctgtgaatgaagtcaaaatgaggctaaggggataggggtgatgggagaaagatagaaggcaggcagcagggacatagtggtggacatggggagctatacaaaaattgtctttgaaagtgccatagtaaaacttaatacttcaaagtgctgctaattttaaaacagaaacaaaattcactacatccagactagctttcctgaaggcacagccagctctttcctcctatggttttaactggtaagggccagcttgtttataagtgaagcactggagggagaaaactgtacagctgggtgtcaaagtcccacttgctgccctgtccaccttgttggatgggatataaagaaaagtgctgtggcctggtgttcccttctactctctctggtttattcttttctctttgtattgcccagtgtggctagtcacaacctcatctagcctctgtgtatttgcttatccaactccacaggctgcttttgattcctagtatttgcatgaggcctgaatgagcatcctgaaccagatgctctgctctgcctaggccctgaagtctccattcttggcttggtctgaaaccatccctcctgctgtcaggatttctcttgatccacctgcttttgtaaagaccctcctgccccagctctgggccccacacattcttttttcaatgtacttcccctggtttcttggggagtggagaaggaattaataatgtcttacatttttgctacccgggggtggggggagagtatgcccatgtttatgtgcagtagagcatttgatgcccagatggtctggatgctgtgaacaggcatattcgataatgaatatacctataacagaccttggtgataatactcccaaccatggccttgtatgcacgataattggaccaaatgtccatcgacatactgttgcctctctatagctaataccaaccagtgcagtgatctgaacataataaatgtgacatgattattttcagagtgtctgaaataatagatttttttctattcattcactgtatattgactaggaaagacagagaacagttattttcatatgtatctgtatggatatgggcttatgtatcaaatttaaatttttggtttttacttgctaataggagacataagcatacaattggtttctaattaggaaattacttgagaatgagtcttataagcatcttttgaacctaatttttggagtcatatgtgacatctttttgtctgttcaagaacaaagttccatttttttttctagagaaaattttatgactttgattttgagggtactgaatgcaatggtggatatttgcatattatttgtaagattttaatttttccatgcacagaggaataacaacttaggtaatataacttttcatattcaatgttcattttaaatagattgcactgagttatgtcatctctggccatgaggatgtggtttttaatctactgttttataaaattctgctttaaagtggaaggtgggagattccattgaaccatacagaaagaagtattaaatcaacaaaagttttaaatccctacaacttaggaggatagtactgtcaaactgaaactgaccagaaaaaatatctgaagtagattgaaatgattcctgctatttggccacttggcttatccttcagggggtagttctggaacagtatagtgaaactgagccgcatgtctgacagcccaacctaaaagctaaaacaaagcaaaacaaaatgttgtatgtgctgtctctgccattgcagatcaaaattgagcttcccattcacctgcaccagaagcatcacctgctttttactttttatcatgtgagttgtgaaatcaacacaaaaggaacaaccaaaaagcaagacacagtggaaactccaggtatgtgtgctgcttctgtgtgtgtgtgtgtgtgtgtgtatgtgtgtgtgtgtgtggtactggggatcagacccagggtcatataatctttctctagttgtcatttcaccaagttgtcaactgcttcactctttgaccaaaaattatatttctgagttctatagttcattgctaagccaaacacattggtgtatacctgtagtcacaactacttatgaggctaaaagtaaagtattgctggaacccaggagttgaagagcagcctgcgcagcaaaacacgtttcatctgaaagcagttcattgacaaaagacaaactatacattgatttttattatcatgcatatcaaatatctttgtccagacaaagttctttaagcaacatcaagtaacagtgctgttcttggggagaaacacatattacaatacagtattgttatttcttttatggagaattgcccagcaactagaattttccagttctgcttattgaggaagagaaaagtaagcccagagccagggacatctgtgagctggagggagactggggactgcctgttgctaatgagaacagatttaatgaagttgaataagctttagcagtgaggcaccagttctgattccatgtcatgaaagctttaaataaaccagtagaagacagctttaggagaccatccaaggactgtgagcatagcttgtgtcatttccactttacgaatgtcatctgcctcaggatgcattcattcagcagatatttatgcatatttttgtgaactatatcagtagatactacagagaatgtagtaaaaaatgcaattatcgagcttgtcttagagttaatattgatatgataaaataacatgatcacaaaagcaacttgaagaggaaacggtttatttcgttttgtagcttgtagtccttcatgaagggaagacagggcaggaactgagagtaggaacctggaggcaggaactgaggcaaagaccacagaggggtactgggggcagaaactgactcgaaggccacaaaaggggactgcttagtggcttgttcctcatggcttgctcagcctgctttcttataggactcaggaccaccagcctagggatggcaccaccaacagtgacctgaaccctcaccccatcaatcattaatcaaaaaaaaaagtttgatagacatgcctataggtcagtcttatggaggcaatcttaaaattgacagtgagtccttcccaaatgtctctatgtcaagttgacagaaaaaccaaccaggtcagaggtcatcatcattgagcatataacctagtcaaattcatggatcctatgtagacaagtctatctaatataagatagataatagtgagcactggaaaggttgtgacacgtgaacacagatgagtgagtgattcagctagtggagggacaagtggttgtgactcaggcaggctctcaggatggcattgaatgaagtcttaaaggaagggattgagcttagagtgctatgatggtaggacggtggagtattctgagttgaaggaacagcttgtacagagtcagaatattaaggggatatggacagaaatctatatgtacttaacaaacataagaccccaggatgctgggcagggaaccacaggatgtggttgaaaagcattgtggcaaactcttgaatgccaggctgcggatctaacttggttttattaccagtgtgggactattgaaaggttactaacaccagtgtgagctctttgggagaaaaatgggccaggaagcaaagtaaagggcagtgtgaggtagagcaggaagaaggaaggaaggacagaaggatacaggttggagacctatttaaaaggttatataaaggaagagggtaaactatgaccatatcaggaaggaagaatacagaaaaggaacgacaagtttgaaggcttgtatctgtaacagaaccagacagaactgtaaggacccaggagtctgtggcaggaggattgccgtgagattaatgctaggctatgctatagtatgaacttgtctttaaaaaaaaaaaaaggcaaagaaaaaattttaaggtttatgtcctctcagtaaaaacctgtgtgggttccttatgaatatattcaaccataagtggatgagaatattattttgtatgtgtgtatatattcgctgtgtatgaacacctacatgcatcaagccacaaggcagtctccagtgtcgtccttaggtgctgcccagtcttattgagacagggtctctcagtgccctggaacttggtaagtaggctgggctagctgctgagcaaacccttgcgattcatctgtctccacaagcgccctgagctggtaattgcatatcacaccacagttggctttttaaaagatttgtgctgaagtttgaatgcatgacctcatgcttgcatagcaagcactttaccaactgagctctctccccagcccctgtaaatgttattcttaaaaattgcgtctgaagctgagtgtggtggcatatgtttttaatcccaatatttgggagacagaggcaggtggatctcttgtgagtttgaggccagcttgagctactggctaattccaggatagccaggactctggagacagacaaataaaagtaaataaataaaattaaataaataaataaataaataaaatataaaaatgaaaaaatgcatctttactaagtgcatatatgctctcccctcttgttaactaattagtgaaataaaacatttacatagcatttacattccagcagatatatacaggaggatgtatgtagggtacatgttgtcaatactatgccatttttataggtaaactaaacatacacaagttttagtgtctctgagatgaattcccagggatgacagtatattgtacctggcaaatagctgactaattgctagatgattgagaggaaccattgatgtttcaaaatcaggtgatcacaaagaagatacagcagtctgtggcaggctcaggactggtgtgtttgaggagctagtgagatctctctcggcgggataccatcaggcagccgggctcattaaaactccacttagagtaggagcctggggaaatgagatgaaagcagacagaactgtaagaatccatgcaagtactttccacctgagtgataaattgcagttttctcatccaaatcctagctagaaatgggcaaggtgttcagtgaagcatgaggtggtgattcttcatgtcactcatcaattcgaactgtcctccctttaagtggcttcccacctttgagccagatggcatgctagagagcataccttttcagcttccaagtgctgcctctgagtttcaactaagggaaacacttggccatgctctgataattcacagtgcaaaagtgtcacctaagcagaatcaggcagacagaaactggattgatggtttcttggggtaggaagaaaaagacagttggagtgacgtgttagagtttcttttttggagcaatgaaaaaattccataattccttttaaatggagcaactgcaaatacatggaaaagcttacatagagtatacctcataaaaactccatgaggagaagtgttgtctaagaacaagaaatagggttttctcatttctagtttgggagttcgtgacaccccacccccattgctcaaattttcacttttacagcatcaacagcatcatctctttgtttttcatcttttaaattttcttttatttttgagatgataattactccctcactctatctttcatattcatggcctctttttttattaattgttgttacatgcatatatgtatatacattcctaaataatataacctgctcagtccaatgttacttatgtgtttgtatacttgccatttacatatatatatatatatatatatatatatatatatatatataaacctgctcagtccaatgttacttttgtgtgtgtatacttgtcatattcatatatatatatatatatatatacatacatacatacattcacacacacaattgtgtgtgtatgtgtgtgtgcatatcttaagggctgaccatttggtatttaataaccacttgttgtgctatgttccctggggaagactatttcttcctccctcagcattccttagctgctatagtcctttgtgtaggactggggcctcctgggcttcctgacattgtcattgttagtggtgcttctgcacacatcactttcctgctttttctgagagcagaggtctggggaaagcatttttgaagtggcaccgagaagatgctcttcagacatgatacagtgtctgttaaagccattcactctactgagagaaggccatgttggttatggttgtcttctaagagcaaaaagcatttgccaaattagacatgtacatgaaagcactgtaaccagatttgtgttgacttctgagttcacagtataaacacacacatgcacatacgtgcataggcattcatgcaaaggattttaaagacttagaaagcagtggatttccaaagtgctcttcagccaacaccccgtttcatttgccagaagtccatcaagagcaaggttgggttttttttaattcttttatattttatagctaaataataaacactcaaagcccagagtaatctgtataatggaaagactgacacgacatgacagaacttgagcaacacagatggctctggttagtatagcaaaacataatgagttttctaatagaaagccaagatccccctttgggggtagaagtgttaagaaatgtagagatggcaggaaatctctcagtggactgaagtcataaacactgttgcctggctgtgttctcattctactccttgacctccaggcaggaaacctctgcctatctaaatgattgactcttttactaccttggatcaaatgtagactgtaaccttgatttatgaacttaatttttccatactccaataccccagggttcccataagaagttttagaagacatgattgctgtcggtggtggtgtcaactctaaatagaaggatagataagggggatttgaaccttctaaaacatgagtctacccaagcagcccccaacagtgacattgaggcatatttgagacagttaaagattttcatcaattatctaaggccggtccctcaattctaactgaaagggctatgttgctcccgtgtttattgccaaagataagaagctaataactttttagtgggtaggctgggttaggaaatgatccaaatgcattgttccttccctgcaccacagttgcctgacacctgggttcccacatacagatccctggaaacatcaccatcctgcctgcttccccagcttgcagacatttgtgtagctaattgtatttgcaatttcatttcttacggttgattatttttttggcagtgggatttgcctgggtacctttgctgaaggatgggagggtcatcacattggagcagcagctgccagtctcagccaatcttcctccaggctacttgaatgtgaatgatgctgaatcaagaagggtaggggaatatctgcatttgggaattagtcctgttttatatatttaaaagtagaatgctgttgttataggatgggaaaggaatactcaaagtatggtctgaaggctggtcctccttcacaattaagttaagcgggaaaggctgttctgtatttacagttgatgatttcagtatcttttaaaactggatttggggtatgactttaaaaaacctcatatatttaactaattcattttatgataattatgtaaatctggagaggattggaaatccacaattctttaggacatgtttattctaaagggcacttattttctccagtatttcctttggatgaacctaatacattcctttttgaaatctcttaaaatgcatgggtgatattgtaggttgtcatgtatctctctctgtcatatatatgctcatggctgtattttctccagcaatcaaatgcggatatcaagtgggtagatggtgcaaagcctttgctgaagattaagacccacttagaatcaaccatttatactcaggtacgttacagcaccgaaatttctcatctgagtactggactatatttcctcattaaactggactacttttaatctcccactgccttggagaaattgtactttaaaatgagggcatgtaaaagctatcatcatcattttaaacatgaaaaaaaattaaacctaagttaggagaaatagcttccctgagacacaaaataataataatgagtgctagttcaaaatacatattgtgcttttccacgtcctgatgtgacccatattgtacagacttcatgagacaattgaatttcccagcagagtgtcatggtaaaactgggtactgaataccagaaatgactggccagagaaattcctggtgctacattttcttcacctgtcatttcagagctctgttcctggtcatttcattgatatacagaagcaagtcaattggatagaatacattatttctgttttgttttgtttttgttttgaagccttaaataagtgcttacctggttgggcatgtttggcaatttcctgtgtgttcaggtacaccccatgttcacctggctgtggtgctttatatgaaggtcaagaggacgtcaagggcataagttggcatagatggctcgggggtccaggtggtagaatacctagctagataggccttcaggatgctggatcggggagagctggggagcctgtgcttgacaataatgaatcaaatttcacaaggctgtttccatctgtgttccaggatctgcatgtgcacaaattcttccatcattgccagctgattcagtcgggctcaaaagaagttccaggggaactcattaaatatttaaaggtaaacgaacaggttctgcaaaaggtttttttttttttgtgcctttctgctgctacagttttgacgtgggatacaagtaccaggcaaacacctgaaaacactttgggccttaggagggcactttctccttttacttttccatcaactggctgttcagaagcaggcaggcagcacggctgcattcaggagaaaatgttcgagccaaaatttgacatcatggtttagaaacctctgattttattgcagaactggctttagcgggagggggtatctcggctcttcctgctaactaccactaaaagaagagcatgttgtagtgggggaaggggcagaaagaataaaaagaggtttccttataataaaatgtgaaatggccctgtgtctattagtgggagaatagactgtcataagggcccactaaaactaaagctagaaacattgtctgcacgcatgtagcgcaggggagggactcttaagggtaccatactgtagcagccagagaacctaatgttaggcttatttcctctgtgtggggattgtggggtgcatcctaggacctgcctggccgcagttgtttctttccatgactttgttagtgagcttggccgtggagaatatgaggcacttttatttgaagactacaggatctccctttacccattggctgctgcctaacagtaatctaaggaaccctgccttgccgagagccagtgtgctgtgacatagagccgatgggtctgaaatcataatcggattttgcgctgcagctctgtcattcactaggcctgtaattaacctttaccaagtcacggcacttctctcagccggcacatggggataagagtaattaatgcccactgcttgtgaggcttgacgaagacacctcatcttctgggtccggattgttcatgacacactaacttcggagtgcttcctgggaagcccacatcagggatctaagcaaagaaaacagaatcttactaaagaccttcatgtgttgtggagggaatgaacacagaaacgagcaagtaaagatgccacctcagatgattatagatgctatatagagagcagttcttaacctgtgagctgcgaccccttgggggggggggtgttccacatcagataccctgcatatcagatattaacattacgattcataacagtagcaaaattacagttaatgaagtagcaacaaaaacaattttcaggctgcggatcaccacagcatgaggaactgtattaaagggtcacagcattaggaaggttgagagccgctgctatagggagacaggaatgtggtagattttctgtcttactagagaggatgcctctggcaaagtgatatttgaccagctacttaaaggacgagggcagccgagtgtctggctggggaagagctgggaacagttagtacagagaccccgaggagcttggtttgatgtattgtggaggaggaaggactgtgatatggctgctggtatgaggttgggaaggcatgccctcagggtatctggggagcctctgaggctagtgaggagaggtttgttgttgttgttgttgttgttgttgttgttgcaagtcaaatagcaagtcttgcaggagttggacagagagaggcataatgtgcctttgattcttgtgctgttttgaggggtattaaacccaggacctcatgcttgccaggtacttaaacaccctaccatgcagctacggcctccctttctggcattttgtatatgtgtacgttcgtgtgtgggggtacctgtgtgtgtaagcatgagtgtgcaacatgtatgtacatggatgtgaaggccagaggtccatcttaggttctgtttctccggagctgtctaccttggttttgaagacagactctctcactggccttgagcccaccaaggagactagtgcaggccagcaagccccagggatctgcctgtggctgcatcttctctacccgtggaatcacaagccggcaacaccatactcagatttttaatgctcgtgctagagatcaaaatcaggtcttcatgcttgactggcaagcaccttacccgctgagctatctcctcggacctgtattttatttttctaaagatatttttgttaagttgcccaggttggtctttaactcactatatagcccaggtaggctgtgaactgccagtagtcctgctttaccctcccaaactgcactgaaccagactggactgcggctataaatcagagctactaggtcaggcttgactttagtttttatagtactattttatagtactattctgcctaccgcattaaaaaaatgtttaattttcattcaagagagacagtcaatcagtagtgactctgggccttagcattaaggactataatagtaatgtaactttccttttttttctaattttttattgtcatgtaagtttcaaatccagttcgtagtactatctaggaatactgcagctatatggatggacagtttatctgttaaactcattgatcatcctttggagggatctctgtgagaattttcacagagtggtgttagatacatcattttcaaatactggtattcttcaaatggaacaaaatgtatttgtttttgagggtgtggaatgacaagagttatacaatgcacatacgccctctggtggccataagtgaaatagcatgcaattgcagaaatagtgcagaaaagggttatacagaagtatctttttgaggatgagaagtcttaagtaaaggtgatttgtccacagaggtccagctacttgttagctgagccgagcctgtgacacatctcttgatgcctagtcctatgagcatcccagtcaacttttttatctgttatccctgtaaatggcagttgagctttgttatgtatgtagttcctatagagcttgcatagaggatgacttagagacattgtcagcatggatattacagcctaagcaatgacagtgcagaaagtaagttagctagcaacttcttcataatgcagagaactgttggaagacagatgtgattaaatgttacatgtttgatacagagttgcaggtattaaagattcagatcattgagaagcccatgtagagcaaggactcctatttttgccttgccgtctgttgccttaatcatttattcagctattcaccaaagatttattaagcatcttatatgggcaaggtattgttctggatgctgggaatgtcactgggggaaatgtggaccgaactagttttgtgtgggtaggaagattataaactttaggggaaaaaatgagtgctgtgaaaaaaaaaagaacaggttaatgagaacattctaggagaggcttgtctgtggaaatgccaatttcaggttaaagagtaaccgaaggaaggctgacagccataggtgagacgagattgttacagtgagtgtgtgtgccctaaacctgcgtgtttgcagggaggcaaaagatagcatagctggaacacagggagttggggaggggggccccgaggctgcttggaactcagcctgacaattgtatgggtcgtggaggcccatgatgtcctttgtagtgattttgtttgatttgtgtttaacaagggcaagatggcattaactaatttgcatgtcaaaaggacactctggctactgttgagaataaattatagaagataatagctatctagtggtagcagggagctccatcctgcatgggatgcacatctgccttgtctgcctggtatttcccttctgcttagctcacatttgcttgtggctctattgccacttcttttgtacatgtggtgcacatacctgtcctactatttgctatttgtactgcagtgatttagttccatggttttgccctttcaacagtgaactctctaatggtaggagctgtgtacacattgtttggtttgctctctgttgtttggctattagaaataaatccagtacggctccattggatgagaaggagaaatgggttcactgacatgcggatttgaattggccctggatgagtaattgggaattggctaaaacctgtgaacaaaacaaaatgaaggaaagcatatggtatatttaaagagcaatggtgatgctagtttggctttctaaagaacaatagtcaatttaaagattcaaaaatgcaggctaggtcttcagtatgttcaacttaattccatagctcaggattcctcaagttcagcactagtgacatttaggagaagatagttctttgttgtagaatgtttagcaaaactctaggcctctacctagtagaaattggtagcacatgcatgcatgcacaagctgtgagagccaaaaatagccccaaacatcgctaatctctcacagagaccatgtgacccctggatgaggaccactattcacagtaacaggaagacatcgtattctagatggctgaggatgtagatcaataggaaagtgctttcttagcatgtgggaatctgtcacatcttcagcactaatagaaaaaagaagatgaaaaccattttggtagaaagtagtctaatgtaatccgcatccatggtgggtgggcatcaatttggaaatatgtactggttacattgagaatggggagaaactatagatgttctagaaaaatgtcaaggggatatcctgaaaggggcagcagaaaagatgactgtgtagagatgtaaaaaatttctcagcaaagttagatttttctttttgcttggctcatggagtgatggaacgagtgaactatggaaagaagaaaggaatgtagcaagaaggactgtaacatttctatgtatacatgaatatataatatatatcagcactacatttagatgtttgtaataccattattagagtcagagtgtaagcatgtggaataaatatattcaaagaatgttgaggactggccagatgacccaatgggtaaaggtgacaagcctgaccatctgagtttgatttctaggacccatgtaatagaagagagaactaattcttgcaagttgtcatctgatcacacacatgcacataggcttccacatgcatgtatatgtatggtcacacagacacacacacacacaaagtaagtaaaacataaaagctttaaaagaatgttaaaatataaaactatctcagtttgatagatgctgtgggataaggcaaattatgtacagacatgttctttactgaagctcacttaacttaccatcaggctggctggaggctaagactgtcttagaaaacatatagaatgcatgacctgaaggcagatcttccagcccccagcccacaatgagtatagatttaccaaaggccagttgtcttcgtaccaagcccataaataaattgtacttgatatcttgagttaggcattcatgtctaattaacttgcagaatccaaatagcaaaagaatggggtggattgagtccttagccagtctcttgtcttgaaagtgcacatttcaacaagcatatagtcaagccagtatatcgctcattacttaattttcttattgtttcacatttgcaaattagatcatatttctgtttgtttccataactaataatgacttattttagtgtttgcatgccatggagatccaagtcatgatacagtttctacctgtaattcttatgcaactcttccgagttctcacaaacatgacccatgaagatgacgttcccatcaactgcaccatgtgagtttcggtgttataatgaaagaagctatttgcttccggtttttctttcttaatttttttgtcatggctataaacttcgctcttaaatctgtgtttgttctattccattggtttggtcatattgtctcatcattacttgtctgaaagaattttttttaacttttgatttctttctttcttctaaagaattttagattatattattttttaaaaaatcaacttgcaactaaaattaacaacacacacctaaatgaaccaaatctaaagtttgtgcatctcagcgaacttctaggcagtcagaatgccatacagaatggaagctatggaacgtccctgtttatcatatttctatgcacttaaccatcaccaaaaccaacaactccatggcagaattagaactagaaaaagttagctgtctagcctctttgatgatgtgcttcattccccttgtttggtcctttctaatcctcaaacagtcagcctttcttgttctttcatacatggtatactgagcccacaggcagattcctttacatacatacacatgatgttggctaggttcaacatgtgctagagaccatggctattctctttctgagattatgtgaccttactgaataggatacattctgaatccattcattttcctgtaactttatttctgtctatctttttgctttctttctgaccgcttgtttagaagcatggcatttcctttccactgttgttttcgttttctaccgttcttctcttactgatttgtaacttctccatactgtggttgaaaactctatctagaatgattgcagtcttcttaaatcttattaatactttttaaaataacctaatgtatgttcaatcctgcagagtatttctgtgcacacaagcagaatgtgtcttcttttactgttgaatgtgttctgtatacgaatatagtttgttaaagtatagttcaagtcaaatatttgcttcctgattttgtctggttgatccatccattgttgaaaattatatattgaaatcctacactattcttgtgctgtttactattctgtgctatttataagacaaacataaatttcaattgccctttctccagtcatgttctatttgtgttgtacaatacggtagctacttagcacatttcgcaagtgtggctagttcttccaaggaatgaatattgaattgcagttcattttagttttaaccaatatagtcactcacctataacccatgtttctcatactgagcagaatgtgtcattaaaaccgtgagttttgatttgaaagaataagctatgtctgtatgaaaacaaaggtacattataaggtagtgggtaaaacacactcgcatttcaaaatgaaaatagttaacttgaaaaactgctgtgctcagtgctggttgtctttggctctgctgcccttactgccttttcccatagaccccagtctacaaacactttcttgccctgtgcccatatctggtgtcagggtgagtcctgtttaaagtttaaggagcattattctaatataatggttctcaacgtgcatgtcccagaagcactgtgcctagcaagtttatcaaaatgttaatcattgaactttgacctcagccctacaaagtcagaaacactaagggaggagccaagcaacctgttaacacgccttccagatgatgccgttgcttactgaagtttgcgacacggctagtctcttaagtttacctccacctttcaacctattttccttgctctgtccctcctttccccttgacacagtttccatgatgtcttttgtttgtttgctttggttgagacagtctcaatctgtagcccagacaggactagactcacggtgatcttcctgccttagcctcccacgtgctgggattacaggtacacaccacctttcccagccactttattgtgttgttgttattctttttatcttcactggaaggtatttgagtatttactttccttgagctcttttacatcatagggctatgaccctacttttaagtgaatacacagatttagaaaggagacaaaacatctgggttgccaaagtaaagtatccttttgaaccaggaagtacatttttcaaggcgccaagtatgttaggcagtggactcttgtagacctagaccactgtcacctctcctctcacccctcttattgttgttcaggcagtttgtttgctttgttttgttttctgggataagacttgctcatatgtgccagtcacactaaggtcatgagttgaagcatggcccactgactttcattaatgttgtttcagggttctcttacacattgtgtctaagtgtcatgaagaaggcttggagagctacttaagatccttcataaaggtttgtggagtaaggctttcttgctggatgattttcctgcttcccaggacagttgtgtctaatggtttacttggttctgtttgcagtatagcttcagacctgaaaaaccaagcactcttcaggcccagttgatacatgaaaccctggctacgactatgatagcaatattgaaacagtctgcagatttcctagccataaataaacttctaaaggtaaggatggaggacacagctggacacaaaaccagtctctccatacttggttgtgatctttcattttatcctttttttttttaatatccttttttgtattggacaattttttattggttattttatttatttacttttcaaatgttatccccctttatcctttttgtcccagaccttccctccttctcttatattacacgtgtatctttcagagccttctccctgctccatatacaccccctgctctgaattaaatatgtaaaagataaagtttggatgaggcagaatcttgtgtttattacatacagtgtatactttgtggacctggggctgcctagttaccagctccgggccagtgttaccttatgcctaacttaacaggtagtaggtactcaataaacagttaactattatggaattctttttttttttttactatttctttattggtgatagaattattacaggccttttgagatgagttagctagagacttgatgctagctttcaaattatatgacatggccagagacttgatgctagctttcaaattatatgacatggccagagacttgatgctagctttcaaattatatgatatggccaaccatataggtcatataggcgttgccagtattgtaccacagcccaagttgattatcctttatttgtgaaagagggacaagagaggccactggggtgaatatgatcaaaatatactatatatgtgtggaaatgccatcattaaacccatttaatatataattaatgtatgttaataaagacatttaagtgttctttgtagagaatttagaagtaataaaaataactaaaagttggcttgctctcatcactaaccatgggcatccccaaacaatatcactgataaaaaattcctgccatgaagcaaccctcctattctcccagtgtgcatgcttatagaaacattgagcatattttgtgttggctaactattcctgggaatggggtttgctctggattatggttgataatccataatccagtgtcacttctttcttttctttgtctaaaatacttgggaagtattttataagaatttaatagtgaattggggtcacctgaaattgttatcaaactttggaaacaagatgtctgttaacttatcctatgtttcagagcctcaaatatttgggtatattaaggcatgtgtgggttttttttttccagtactcatggtttttctttgaaataattgcaaagtcgatggccacatacttattggaagagaataaaattaaggtaagtaggctcaataatcatttaattaattaactaatgaattagttgtgtttgaaacagcctgttgtccaggctggtctcaaacccatgttcaacctcccaagtgcttggattatagacttgagccatcacactaggctctttttaattgataaatggtaattgcacatatttatgagaataacctgtaacatatataaagaaagctaaactttacacatagcaataatatgcaaatcttttttctaatgattcttgcccttttcaagtcttgcttatagaaacaatgagtgtttgcccaaatctaagctcccacagttcatgtgttcttacagtttaatgtgcagcatctcctaaatagttagaaataattatggtaggacataggtaatatcctacagttatttactatacggaatgcatgactatgatggtttgcatttctttttaacaatgtcaatgttgaattgctggagagatggcttagtgcttagtgtttcttgctcttgcagaggacccaagtgtggttcaaagcacctatgtcaggcagctcctaattacctgttaccccagcttctgagaatgttactctcctttgaactctacaggtacccccactctccctccatatacacataaataaaatatactttttcaaataaaactttgttgaaaagattcagtgaggaaaaaagtagcaaatcagatctgttctgtctattagaaaggattaaggtatataatagaaagggtgaaaagggctcttaagcaaccagcctaggctactccatgagttctgggccacagagagcattatgtgataatgactgtcaaacaagacctcaggtggatttctgatttccattatgcacacatctgaacctaggcacatgcgaatacacacacgagcattctgttctaattcattctattattcacaacaatcttacctttcctaacagttacacacatttttagaaaaataaaaaaaaacccacaacattaatacttttttgaaatgtatcactttttttttgtttatatgaatgtggtatcttgaaaacatctgtttctgcctatgtgctatttcatgtctagtgtgtactaaggctaaataaatatttgatattaaaaaagaaagggtgaaaagaccgttagacaatattaatatcatgtgtatatttctgcatgtataatatttctgcattgtgtaataatatgaaatatatttctaaaatttggtatgtacatttacttgctttttctattttaatattatttgtcattattattattgttgttgttgttatatatatgtaatgtatggaggggaccccgtgtgagctacagagaatttttgagactttgtggagttagttctctccttcactacatgtgggttctctgtatccaactcagatcatcaggtactggacagcaaacagttttttccactgcgcagtctcacaggccgcttatttggttttgaattctgttttaaagatacatgttgagaattctggagctgaaatgcctagaaccagaagggtttcagatttttgacattttcaggtttcagaatatttgcatatacacattgagataggtatcttgggaacaggatgcatgtttaaacatgagactcattcatgtgtcatggatactttatacacatagcctgaagacaattttatgctttacatttgcacctgtgttttgacttcaatcagtaacacaccatcaggtatggaattttccatgtgtagagtcaggtctcagacagcttcaggtttttgagcatttaagatttgaggcatttcaacgagaaacaacctgtacaaagaagttttcttggttacagaaatcatagtggtgaggcatgtgaaatgaaaattcatctcataggaatttcatagaataagttgactgaaattgggatacatgctcatgttctgtaccagaaaaaataaaagtaaaagtaaaataataaataaaataaaataaaataaagaagtgtgcctgcatcgcaggagcttggattccagagctggattatattgatccatgctatgcctaataataatttcagacacatattattagagaatcagatcattcctttaagttcagggtctagaataatggttctcagtatgtgggtcccacccagatggggatctaatgaccctttcacatcacatatcagatatcctgcatattagatatttacattatgattcataacagtagcaaaattacagttatgaagtagcaacaaaagtaattttatggttggggtcaccacaacatggggtactgtattagagggtcacagcattaggaagggtgagaaccactgctctagaataaagtttactttgaacaaatactgaagtcatttttagttgaaagaaaaaaaatgtactttttaatggcatttccatgatggaacatgtttgaaagtaaaatgacagttgatctacttagacttttttaacctctgactctttttctatttgtatttaagctccccaggggccaaaggtttcctgaggcgtatcaccacgtcttacattctctgctccttgcaataattccccatgtgaccattcgctatgcagagattcctgatgagtcccgaaatgggaattatagcttagccagctttctgaaggtgagttaaaggaagccaacacatgttcaggagctttcttcactgacagggtctgaaaagaccaaggaataacagttctcttttctcctggaaaggctgggtatttggcttattttttttcccattgttgatgattaaaccatgtcttctgcatgctgggcaagtgctgcactccttagctatatcccttggctctagctaggtcttttcaaggctgttgaaataactcttgggactgatggatcagtttatccaggtttactctccctcccactgatgcaagtagttaaataaaaggctctgtctgagccagaagactggccatgcttgtttcacaaaacagtttaaatacatttcaattggaatgctgttaggtggagcaattgttggctcagccagtcctcatcagtctttatcatactctgacatctttatgcaattaaatcatttttctggtctgttggctttttggtctgtcttctctctctttctctctctgtgtgtgtatgtgtgtgtgtgtgtgtgtgtgtgtgtgtgtgtgtgtgtgagagagagagagagagagagagagagagagagagagagagttgtgagtgtgtgagtgtatgtgcgtgtagatgtacccattgcatacaccctgagaactggagcagcatacctgtcatttattgccatattcttttgcaacagtgcctgtcactgaacctagagctaggctagcagccctaaagccctggaaatcttcctgcctctcacaatccgcatggcactgggcactagaggtacaggattacatatggccatgcccagctctttgttacatagctgtttggattctaactaaagtcttcttatttgtgtagcaagggctcttaccccctgaaccatttctcatgccccaaattttgaatgtttgaactaaaggtacctacctatttgctgttgtcagcagagggtacatgtgctaatgcatatacataggaattatttgttttgctcagtgaggttctttgagaggtgacaaaaatccctatactcacaaaagatgtcagttttttactttttgttttattgtaatgtatgtaggtatgtatttatgtgtgtgtcttgttttggaaattacacagttgaggcccgtaagtcttgattctatagataatttacttttctctttttctttaaggtcacccagaagtcttgacagctattctcatattatccataaaaatgatatcccctttgtatagaacagattttcaaattctttaacatcttgataagaaacacttaaaattatataactaatcttccttctttgctttattagcgctgcttgaccctgatggacagaggatttgttttcaatttgataaatgactatatatcaggatttagccctaaggatcctaaggtaagttctaaggacatagttgtagtagcgtattggacacttaagcatgaagtcaaaggtgatagttatattctcttttagaggattcagaactgctcttttcatttgtgtactttaagtattgttaaaagcaaggattgttgagtagtgtttggagagctgccaagaccacccacagattcagcaatttactaacagaattcaacatatagttttaattctgcctaacatcgattagagtgataggatatggatacccagcaggatcaagaaagaaaacgatagcaagtgaaggctgtggtgatctccatggacacatctcatacttttcccctcttaagaagacatactttcccactaggggtgagaagacagtaaaagactgcagtatttctctttagagtttagggttctttgggattgaccaaactgtggaggtcaggaatgaagaaacatacagaaaaacctggggttggctgagccatgatggagacataccaaaagcctagaaacacagtatgtttattatctacagctgaatggggatgcaagcttcttatatacaactgatggaagaggtagggggttcactttaggggaccactttcaggatgtagtcatgcaggttgcacacactgtcaacctctgcaaatcaaaattccagactagtgatttatgttgaacacctactctactttctgatggtctagaatttttgatctgctttaacacaaagccagttctactctaagaactatataaagtgagtatacccctgtatacatgtgcattcctgacatgagcacagccatgtcaaggaccccaggtgaccctgatccataggaatagcaaggccttcccctggcccaagtacagaggttgacatgttccctctgtgataaggacctagtagactggtagaaagaaaaacaaccttatcacagagggaacatgtcaaaatcctcttttacaaatgacacccaatcagtgttgcagcaggcctttttaaatctaccactctagggccggctatgttaactctttcctgtatagattgcacctgcaagtatactttggaagataaacactccacttctgttaggaaacttaaggtcatatttttcaatcatcaacaaataaatgcctacaaaatgagacctgatatataatttatcatttaggttcttgctgaatacaagtttgaatttctccaaacaatctgcaatcatgaacattacattcctctgaacttgccaatggcatttgcaaagcctaaattacagagagttcaaggtatgtatttgtattttccattgtttgggattgttattccttttgtgatagtactagtgtaggataatgttttctaatgaaaccagttaactttgcggtaacttgagaattgttactatctgaagataggctcattaatggcattctgcatgtccttcattctatcagtggcaatagtcttagtatgaaaaatttggacatgctacatatattgttgctaaacacagatgtcagacactagtaaaatttctttctataataacagtgtattgaattttatttaagaggaaatgagaaagtatgtgaatgcctctctgctgaaagcatcaaaaataaatataaaaagtaaaatgataatttttgtgcagtaaatttatgaaatgcctcagttttaatctccattgctagttttattgaatgctttgttgtatagcactattcttatgttattatgttttttatttgtcccttttcttttcatatattaattagattttttttcatttgcggtggaccgtttgacttcagtaggtaggtttaactcggttcactctaaagtagtatgttgtgtttaaacacaattgatttgatgaatggccaagatgaatgggggcttaatttgcttttccaatcctccctagtcaaagtgagccttcagtttctggcacccataagtcgtaaaggcaagcgcttatttaccctaaaaaatgagctgcagtgctatctgaagaatcagctttcaaatgtctgtccttaggaagaagttcctctgctgcaaatcagcttggggctgggggcggggggggggggctgaatgtctgttttaagtgtttgtcacctcccttaggcgtgctgctttctctatcaccctgttgaatggctacttggccagtcttgaaggtgtacttcaccaaactgaatttattcaagtcactgaagcaaaaaaaaaaaaaaaaaaaaaatcacttgccagttacaaaatctatccatataagtccaccttggttattcaacactgtccttggatttcgaaaatgattggaattcacaaaaagtatgacaatgcaggagagtcacatgccttggtctttaaggaagtctctactcagggttagtgggtatagaagtggtgaaatgacagccagtgaaaatgagaaaatattttaagaccatagtactactatctaactacccgttactaagttaagagcatgtgcggctcacatacttgcccctgtctttttgatgatgatgaaacagtaggaaaaaggagtgggtagggcattgggatttaggaataagttggagaatttgcaacatttaaaagtcctaactgaatacactgtactgcattacattctgaatcagacaaaagaaaaacaagaaatgaaagtcattttatctaaaataaatggaaatagagagtctactacagaaattactaaattggatcccaacccccctctgatttattgtaagtcccacagtgttaatgtggaggatttaatggagatcaaaaagtctaaaaaggtgtgaaagatgcagtttgcagtggtgattttatgaaatgaaaggtctgtatctatgtgatggtgaattgatgtgagatgtgctgaactgatgatgctgaactgatgtgtgatctggtggctttttgtattagcattgtatctactatgaatcatcaggccagtatgtaatgattagtacaataatcaatacttaatactgttggcataatccagttttcttcttttcccactttataaatctaaatggataaggaaatcaagcattaatctatgaagttgagcttatagttaagatgaaatctcttcagataataaagaaatatgttaaaagatacccaaataccgaattatttcattctagaatctattgtaattgtactgagacttgaaataattatgggggaaagtatctttgctgactgaaataataattaaaataaatcatctatccctaattaagagtgttcttaattaggaaaaaatttgcatgctcattctgtattacagaggaattgtttacattgattaataatataatcttatagttcttgctagcatggccacagatgatcaaataataattatagtattttagttgtctaataatttttattttgtattaaaaactacaaattttattgtactgcagattccaatcttgaatacagtttatcagatgagtattgcaagcatcacttcttggttggcctacttctgcgggaaacctccattgctcttcaagacaactatgagatcagatacacagctatctcagtcataaagaatcttttgataaaacatgcatttgatactagataccagcacaaggtaaagctgtctgtacagtagcacactagtcaatttctactaagatgtttcaatcaagatgattacagtgaggagcatagtatgagttatcgatgaagaggtaattttacaaaccaattttttcccatttcaggccggtaagttttcttttttttaaatgccatacaaattaacttgaaggaaaacattttctcagaccattttttattagatattttctttatttacatttcaaatgttatcccatttcctagtttcccctccgaaaatcccctatcccctccccctttccttgttccccaacccatccactcccattcttggtcctggcattcccttatactggagcatagaatcttcacaggaccaagggcctctcctcccattgatgtccaacacggccatcctctgctatatatacacctagagtcacaagttacaccgtgtgttttctttgattgttggtatagttccaaggagctctgggggtactggtcagttcatattgatattcctcctatgggacttcagaccccttcggctccctaggtatttctctggctccttcattgaggaccctgtgctccatccaatggatgactgtgagcatccacttctgtagttgccaggcactggcagagcctcctaggagacagctatatcaggctgctgtcagcaggctcttgttggcatctgcctagtgtctgggcttgttggtttcaaaccatcttttaataatttgatgctggggaagaaacaagccatggtcctgcacatagcgaccacatattctaccactgagctctgtatccccagcttctcaaatcatatttttaaattaatatatataaagatctgtatttacatggcaatgaaaatgagattaggttgctttatgtatttttttatatttaatatacatatttgggccactcaaactctttcattatttattccataaactaggatttttgaaaagtcttacagggattagaaaaatggatgaatcaggagttaagagtgcttgctgctcttgcaaaggactgcagtttggttcccagtacctgcatctgacagcttatagctacctgtaacttcagttccagggagatcccatagttctggcctcctaaggcaccttcattcacatggacacacacacatacacgcacacaaacatcatatagagttttaccatgcatatgcggtcaaatgtaatgttttaaatatatacacatatccctaaataaatatgatattgattcttctttaataagacatataaagtatatcatatataaaatatgtaatatgaatttttctttatactagaaagttatgataatatttaattgtcaaaccatggaggtggctgtaaatcttatatacttttaacattatttatgtgtggccctatattgctctagttgatgtctgctactacttaaatatgtatttaaaagtcattaacattgcattttaagagcgcagaaaattaaactacaagctgaatgaatttggaataaccctaaattacttcctaataatgagaatcttaaggaaacatagtatttcctgtttgataatatatccaaaagttttaatattcaaatataaacaaacttatgatataatttgttattgtgactaatttgaaaaactgattaacaggtggattttttttcctatcattttatcatgttgtatttttcatttaccaagattttttttatctacaaatcttgccaattttttcatgattctgtctggaggtaaattgatctttcattttaagatataagttatattatgtagtttgtgataatattttttgccaaattataaataacacatatactgatcttgcaaacaaccttttcctttatgtggttatgtttgaaagctgtcactggactctgtattttgagtaagtccaaacagcaacacagttcttagataatttttgtaactattagctcatacctcaaattttggagctatcagctcacttttagtcttttaatctgatatatgaggtcaaccccattcatttatagcatatacatattattaatcaataaagctttgatatttttcagaaccagcaagccaaaatagcgcagttgtacctcccatttgtcggactgctcttggaaaatatccagcgactggcaggccgagatactctgtattcctgtgcagccatgcctagttctgtaagtgtgttaatgtatttgtgtctcaagttgtatcttgatttatctgatgcatgtggaattgacgtcatctgctatatgatctcaatcctatgaatttactttttagtccaatttacattgctactgtttttcctagagcaatgtgtctcaaactataatgtggagaatgccttagaacacaaatcttaattcagtaagccctagtgccaagtacagtcattgtgtctaataatctttagctgcctctgtctacagaggcaaagactacatttaagaagttccaaaataatggctttttactattgttttgttcttttttttttaagttctacagttatcatatttaaaaaatattagatattttctttatttatattccaaatgttatccccgttcctattttcccctccgaaaatccctggtgttaatacatttcagtgtatttattcctcttgagagaaaaatgactcttcacttccagagtatcagacactggggataaagattcctttgtttttctctatccttgatagtcattgtttaatatttcttggtatgttccttttagtttatcacagttgggtaagttttctctctattccccttggtgccttaagacttagaaggcaattaaagggtaacaatgcttctatttgtcaagcaatcttgctcttgtaatattaaaatattccccccgcaaccttagacctaaaagggtttctgtcaactgctcctagttttggcctatagagatgtgtaaaatatttatttccacctccataatttgtcccttccacatataccttctaaatttgtctccaggccatatatcatcattttgacatttgccattccaaatcacttattttcatggtgaatgcttcatgatactctccaatttgccagtggccccactaaaacaatggtgtcaggctaggtgctaccacttgaaaggctggaacttgaagatgcaaattcaaggcaaacttggacataaaatgctaccttaaaaaatgtctatattttttacttgttagcccagtggaactggtagctcctattcctcttcatattctaaatggtccttaatcgtgtgtgtgtgtgtgtgtgtgtgtgtgtgtgtgtgcacgcacatgtgcgtgtatgcatatacacacacacacacacacctatatgtatatatatatatatatatatatatacatacatatatatatatatatacatacatatacacactttacagagtcatttcatattgttgggtggcaagttgaattgtgcttttcaatataatctacatttttttccctgtaaaatgccctcgctaattttgaaagctactcttaagttctcaagaaacaactttttaaagatcagtcacaggaagaattttatttttaaattatgtgtatatgcatgtgtcaaagtgtgtgtttgtacatgaatacatgtgtctgtggaaaccagaagagagtggcatatgccttggagctggagttacgggtagtccacatgggttctgggaactgaactctgaccaagagtaattaggcacctaaaattgtggatccatctctccagccctagtagtttactgaagacagggtctcactatgactacagtctaggctggcttggaacttggaacaattctcctgaccaaatgtcctgagtgctagggttactggcatacaccaccatcaccagctgaaaatgccacttttaagctttcctggtagctttcttgcttgtggcagtggattgtgttaatgagtggaatggaaatgtaacctcactgggtgtcacattggccttcacacataatagttcatgctgatgttcattacatacacatttgacattcatgttggaaatgtgcactatctcttcttttgcagctcacattcacttaagaatatttttgttacacttcaacttcaagtattttcactggctccaaggaagagaagtgataaatatgtgtgtgtgtagtcagagattatgattattactataacaagctagcagccaattttttgaggtgtgccacttaactactaatagtacttgatgtaactttcatagtaagctttgttgaaaatcagggtaaaatctaattcagattttttggtgctagttttaaaaatggttaaatgactcgggcatcatattctgttgcaggcatctagggatgagtttccatgtggctttgtttcacctacaaacagagggagcctggccagtgacaaagacacaggtaattaatcactttaaagtttatgtatcacacaaatgtttagcaatgaacctctattctttttaaaatattctgtgttaaatctatacatctatacaaatcctgatctcttctgatgtttaaataaaatatgactcacatgcagtcatgttttctaatttatttaaacataaacaagatggctaggtatagtaggaaaactagaagataaggaaaaacaaaagacactggttccctttcctcttttctttcactaatattgggtagccactttcctaagcttgtgtttccttatctataatgtaaataagctgttttgtgaattacatagctttattacatgaacttccaaggaactgtaatacatagcaaattgttttgagaggggaaaatcacttaacatttacttgttttcttgtagcattttgatatatggatttaacattttgtagaagaccaggatctattccctgtaacatatatgtatatgacttggacttttttccagcctatgggtcatttcaaaatggtcatggaattaagagggaagattcaagaggttcccttattcctgaaggagcaacaggatttccagaccctgggagcactagtgaaaacgtaagaacctaaacatatagaataacctggtgacataataggctaccacagttgtaaaaaataaacatgcagctgtctgctcttgtagtcttttctgggtctataaaatgcaccccacaattcctgaatattttagtcgtactttcctctccttgcagctgctacttggatgtctttttctcccttaagcatagttagtgtgaaatttttagtggaagtttgagacagggttttttcaacaacgttcaagcatgcctcaagctcatgatgtctcccagacaatccttgaactcacaatctcctgttgcttcctcctccaatttactgctcaggctgatctcaaacttctggcttttagcagtcttcctgtctcattctcctgagtaattgcaatgacaggaaaataccatgatgcccagtttacctcgttgtcttaaagctgtttatagtcaattatcctcacatagtctaactcttaccttcttttgctatagttcactgtaatctagagggggtggttccagtttaaaatttctaatccaccttgcactttaattaaaacatatcagagcaaggctaattcattctttctttttaaaaaatagcatcaatttgagagaaactttaggtcatccagttgatattctcagagttccagcattacttagggtcttagagtatgccaactcttccattaaattgtttcaagcctaacattaaaatataaaatgtgtctgccttgagtttcaaaccacatcatagacagtaaagttgtcacactaggtaaagtcatagaatcatattacttagataggtctgtaattttttttaaaaatactaaacccccactcatgatttttaagtaaaactggaattttgactttggccagccatacctgaatgcatgtttataaataagatttttcctattttgtggcacacttgatgtgcatcagtcacctagagggcttaaaatggccgtacctccccctcagagggtcagtaggtctgaaacagggcctgctaatttgtgtttctaagtcctcgatgatgctgattctgctgttaggaagcaccccttaagaaccactggaatagacatatttgagcctttgggtaaatagtaatttattcacaaaggttcctatttcacactattttgaattgtgatgacaccatcatagataaggtcagagcaactaaataacttactagtaattacatgtctgacaagcaatcagaacaaaggtttgtttcaatctatttcaaagtccttagtaaatccttagttttatgtaccctgttagctcagctctattgttttattagcaatggtaaaactttgtattattgttactctattcatataaattctcaaataaatgagatcttgccattatttgggatttaaacaggcctcattaaacaataggatcaacattacttggatctaatttgggaatagtacctggtcctccttattttaattattgtatcagcacatttttttaattttaatttttactaattcactttacatcccacccactgcccccatcctagtcaccccctcccacagtcttccccccttccccttctcctctgagtggatggggaccctatcccctccccaaccctggcatttcaattttctgtgaggccagacaaggcagcccagctagaagaacatatcccacatacagacaacagcttttgggatagcccctgctttttcaggacccacatgaaggccaagctgttcctctactacatatgagtggtggttcagtctctgagggccccaagcatccaggttagttgactgttggtcttcctgtggagttcctatccactttggggcccacaatccttcctcctattcttccataagagtctccaagctccacgcactgtttggctgtgggtgtctgtatctgtctgagtcagctcctgagtggagcctctcaagaggacaacatgctcctgtttgcaagcataaccgaggaccactaatagtgccagggattagtgattgcacatgggatgggtcacaagttgggccagttattggttggtcattccctcagtctctgctcccttccccatgcctgcattacttgtagacaggatacattttgggttaaaagttttgtgggtgagttggtatgtctatcactccactggggttcttgtctggatactggaggtggccttttcaggttccatatccccaaagtattgagtcacagcttaagtcacccccattgactcttgggtacctcccttatcccagggtctgtttcttcctggagatgccctccatgtcctcacccgagtcagctacagatttccattaattctcatggccatgtagccatctctcctgtccttccccatacctgatccagaatcccccattcccctccctcccagttccctccctccatctgcctttcccctacccccacccccttccttcccattccctccccctttgaagtgaaattcaagcttccttgcttgggccttccttcttgttaagcttctttaggtctgtggaatataacatagtacctgtattttatgtcaacccatttttaaatagattaattgatgattgggggttgaatattaattaattctaggaagagattcaaatctaaaagtataactttttggagtgatggggaattacacccataacttgcatatgagagaaaaatggtctacttctcaactttgtctccaaccctaaaaagttttgttatattttcacatacctcacataatagctattctttcagaaattttttattattttagatttttattattaaacacaaagcatattggagtagagcatagatatatcattaatggctctatctttattaagaccctgaagtaatttctagtgatatcactagatactgtagcaatgaagactcagcccatttacctgtaagatatactataaaatttatagttttccacaataggactagtggttacaaaataatttagtttaaggctgtgtaaaattaccatattatttcctaaagtctcctctcttttatcttacagacacgacagagttcttcaaggagtagtgtatcccagtataatcgtctggatcagtatgaaatcagaaacctcttgatgtgctacttatacatagtaaagatgatttctgaaggtgagagactagcatattcagcaagaactgtagtaatacccccctcataggttcaggcctgtaaattgagaacatacatattagaaatagttctttaaagatttaagtcataaaatatcccttaagatgaacattaaaattagtttctaggatctgaatgtctgaaagaatttaaaactattaatttacaaaaattatgcaacaatgtttaaggggttttaagcaaatcataaaatatgttaagtagttaatatcacaggaaggaaataatcacaatacaaaattaacattttagcatttatttgaaccaggatttgaaaaacataaaaatagaagcaaaaaaaccagggctttctgaaggtaggggttgctaccattgccttttttagtaccaatgttgttgtctggagtcagtcattgtctctatagcatcactggtattgtctggagtcagtcgtcatctctgcagcaccactggcattgtctggaatcagttattgtctctgcagcatccctgatgttgtctggagtcaggctgtcaacctgcttctcttcttggagaagaatggtattatctgcttgcattacaagtttctctttatatgactatctataaacaagggattaaattcatgtccacaggagttaaaataaaattaaccttttcctcaaatgccacatttatttacaaaatttccaccctcttcttccatttctctatatttgctcaaaaagtatgcaggtctaaagaacataaaatctacctaagtaggcattatacagtgtacacatataatattatatttttcctcatgaatatagacaattaacaaagtaaatgtaaacgaaggggagtgttcaatagtaaaacacgtggctggcatatgttaagactctgggttcaattcctagtacacatacaaaacagaaagcaaaagtagttatcagcactgtaaaaatcagtaggtaaatttaaaataaattcaaaaaagcacctgagttctaatcatcattctcataaaactatcttgtgcaaatgttctattacttacattttgttttttagatttactattttttatttctctttttgttttttgtttttttttaatcagaatttcattatacaaccttaaatggcctggtaatagctgtgtagaccaggctatcctcttttgctcaagtgctgggattaaggcatgcaccatcatgcctgcttgttttacttttttatgtatatatgtaccacatatattcctgctgcctgcagaggtcacaaaagagcatgagatcctctggacctggagtttgagatggttatgagccacggagtgggtgctgggaactgaacgcaggccctttgcaagagcaacaagtactcttaactgctgagtcatctctccagccccaatttctgtaagttttggagacaaggtcatactatatataaggatggctcaatctcttgatcctcttgcttcagcctctttagtgctagaattacaagggtacatgccacatttggctatttcattttttcctatcacacttggctgtttcatttttttcctatcacacttggctgtttcattttttttcccatcacacttggctctttcattttttttcccatcacacttggctgtttcatttttccccatcacacttggcagtttcacacacacacacacacacacacacacacacacacacacacacacacataccctggtgtcagatgacaaacctagggcttcggctttgcacatgcttaggcaagtgcttcactgtcaagctaatacctaggtcatattttaacacttattttggggggtactagaaacatgaacccagggcctagcacatgagatatacactcccagcctattttatacatttttcttaattattacatactagaaaaagggataacatttgaaatgtaaataaagaaaatacctaattaaaaaaaaaaagaaaaatgccctaaattaaaaaaaaactattactttatttttgtgaccaagaaacattataacagataggaatagcaaattcttgagtataacaatacaacagtctttttttttttcatagtcaatgatagtcttaaagtcacaatcttcttgccaatcttccaaatgctgggactagaggtagctgctagcatgcccaactatttctcatttaaatttttttctggtgctacacatccaggattatctttaacaatttatagcaaacattacttgtttttctttgataatacaaaataatataaatacagattattagataatagccagttagctacagaaagattaaagcccttagccacatatgaataagaaactcttaaataaattaatacaactcaaaaatagtatttctttctttttaagatggatctttttagcctagcttgttctagaacaatcaggctaaccttgaattcaaaatttttcttccttggacccctaaaggctagaattctaccatctcatgttgaaaaataatacaaataactctgcaatccattggtctcctgaatatacaacttaggagtaaactttcaaaattatattgaagtgaaagattgaagctctatgatgggcctccatgttttggaaaagaagtaaaatgagttttaaaatcagaggttcatttcaggaaataatagattacctaataacaaccacaacacaatgctttttgccttcccacaaagataaaaaatgagagaagatggaaactaattgtgatactaatgggatttctgtgatgtttatgggatttccttactggaaccatgaatattctaaaacatttcataacaattttaatagttttgtgatgttgaaaaaaatactgtattgttggtttttaaataaaaatttatagtatgagaatactcttgttaaattcattcttttttgtatgaatttaacaagcgtaatcctataccattaatttacctatcccaagagccaacaataaaaaagatattcaagagatacgtgggggaaatgtaaaaatgggtatctctgagcacaaagaaagtagaaggacagaaaaaagagggagagaaaagatacatgtctggctacttctctccttccaatccaatgtacacacatgtacagtcaccacatactttgctagccagacaagtctggatacatgttttgatgttgtagataaagctatggcttttatttcttatgaactaaatagtttctcttgcaaatagaggttttgcttagtctgccaaatatttttccctttttaactaggtagttctattctttgtagtttcagagaggacagtttcagcaactcatatgttgtctgcatcaaatctctaaagccacactgcatcccataaagtcatattcatttttttctaaaaaatgtttatttctagatactttttaatgtgttagttcaagtgactttgtctaatagtattttcattattctatgtacatttgaatgttgaactctcatgagtttatatccttcaggaactcatatttttttaaaattttgttataaaattagtaactttaatgtcaaattttgctccatgtatatacaatcattctagggacggggaattttgaagtttccttctctgtctatatatttactatcagaaattcactgttttagggtcttaaatagcaggtatcagagttttaagtcctattgctttattagttgcatagtctgaatttacaggaacactatcttattaaacacatacacgttttccttagaagaaaacccggaggaaaactgcaatttttcctatttgctttttcttttcaacccaatatctgaaaaaaatctctcagaatcacttttggacctctttacaaaacgtcttatattttcagattcacaagtgcttttcagagtagtttctcccctggaaagcaaaggagcatgaccagatgtcactgcaatgtcagtactgtggttgctaccagagtgtgttgatctcctttttggaatatattttgaaatgaagtccacaggaaacacctgtgtactactttgccctcttttcttttccaaagataccagtgcagaactaggattacaaggcatactttcctctgaagtttcagatactattattacaggttctccagaggaactgctggaaaagctacaagtgaaggtattctttccatgtttttctgtggaagtagtcttttttccttcagggggttttggtaaagtatctgattcatctttctttgagggatccaatgcagggtttacagaacatgtacatgacagtaatatattggtctctttggtaccattttcctcaacaccgggagagtccacaaaagaagtctccgagaccacctggatttcctgactgttttgtggaattggtttatctggtggtggaggtgcttctatgacctttgacatagatagagattttttttgttcctcatgtggttttgtaatatgcctaggatatgacagcatttgtaccgcttggggaggctcctttactgtatacacatgtttaattttcatctgagtactttcaacgaaatcctcataatcactatctgaaaaattcaactgaacacgtggaggagttggttttagcctctccaaaagcattctgttctcctcttttaatttgatattttctacagtgagctcagcaatctgcactagatttttttgttgcatgttactaaattcttgctgtagcacattcctatacatttcgttcaccagacagcgctcacacgcttttgaactggaggctttgggtgcctgtgtcggtgcctgtgtcagtgcctgtgttagtgcctgtgtcagtgcctctgtcggtgcctgtgtcagtgcctgtgtcagtgcctgtgtcagtgcctctgtcggtgcctgtgatagtgttttagtaccctttggtaccgggccaccaaaccgccttccctctgtcaaccgcgcctttctcatattgcttaatttcacctgtaagcggtgaagctctttatcatggaccgctttcagggacagccacacctttttaaagtcatcagaccccaaatcacttacgctaaactttatgttctccgaccgcgtggattttttaccgtcttccctgtcttcgctcccactactgctgatctctatcctgtttgacatcctagaaacctagacaggcaagtcccaccttggcagggccactgacaaaatggccagagagcgtctgctgagtacttgtcactggctagtgaccagcaggaccaccggtggctttttaactatggagctgtggccagctacttgccatgccagtgacaaaaaaagaaaaggggggggcgggggggggaaacaaggaaatcggagaggagcctctaacaggaaggacactagcccccgcggccctgtctccctgagccctgagcccccgcagctctggcagccctgcctgtaggcaacaggcgcggggctgcggcctcgcaggcctcgcccgctgccgcccgctgcccaccgcccgctgccccgtcacagacctgcggagaagctgccttaaggcacagtccagcagagcgggtgctgaggacccacggaaaggcctggtttcttttgccctagaaagaaaccaaaggcttttggccgaaagaaaacgaaaccaaaaagtgctggagcgtgagggcaaccgcaacccaccaccgctgcctaagatggcgcggaagctctctgaggccaggcgggaatgccctcagactatcaagggggcacgcatgcgcacccccgccagccccgcccacccaccacgggagatgccaagggggccgggggaggagagaaattgcccttgccttaatcttttagaacaaatgatattttagaacaactcatatcaaaaacattttgattatgaatgattaataacttagaatcattaaaaactgttgatattcatggcttgatttaacaacaacaacaacaacaaagaaaaacactttggcgtaaaggtgaggacactgacccatgccgtaatcccagctggatccaaggtgagaaggatcatgagttccaggccaacattttacaacctcctgagattctagacccctgacttaaaaataaaattcagaaaatgctttgtgagaggcaaaggtaaaggaatggaaagtttaaatacaatctgggctacattttctacctagaacccatcttcaacccgggccacggagatagcatttgccgagtaacctgaattcagtcccggaggctcatatgtgtaaatggaacacttgagttgtcctccaacttctaaacatgcgcccaacatgcacaataaatgtaataataaatatgataatggaaattgtttttttaagaactggtgatatgctgtgtgatagagcactttccaagcacatatagagtattaggtttgatgccagtatcagaaaaaaaatgtatttaaaaaatgggagaagcaacatcagaaccccttaatccttcctcactcaatcttaaggttggcattgtctcctcaatctttgtccacctaaggctgttgcttaggtgaaagaaaagacagtagttttcctactttttatgacaaaagattttgtcatttacaatagtgtagtcaatactgttaggtatataagaggagtataaaaacaaagctatattctgacaaaaaataatattttttcttttttgattttttttagccagagctggccagagtggtacattccctttatctcagcacttggaaagtagaggcaagaggatcaggaattcaaggtcaaccttgactctgagacccctgtctaaaacaaataaaataaccccctgtaggtagataggtaataaaaggtctatttggaaaaatgaaagaaatgtattaaaggaacttacgtggataggtttaagacattcttccgtctgaaatagttggacacatagatacaccatcagcattattatccaaagaagaaaatggaaggtgataatctctttctctaaattcttaaaatattttggttaacatagcccttcaagtagcagataaaagcatccgactctctctctagaaaactgcccataaacttaccactataaaattttagagttggctaagccttgggtataaaaaaataaacaaaaatttccttattttgtcttcagctatgataggaagattagaactaaccatcgaaaagaacatctataaagtaaataaaaagattaggacctgaaataaagattacattattcatttgaaatcaattaaaaaaaatatgcatgtgtattcttttgagtgcagtgtgatgagacacgagacatgtttggaatgctagcactcaggaggtaaggcaggaagtagaaagtctgaacacatgtttaagaccagcctgggcctctataaaatcctgcctaaagaaaggagtagacagccgggtggtggtatcgcaaagcctttaatcccagcacttgggaggcagaggcaggtggatttctgagttcaaggccagccaggtctacagagtgagttccaggacagccagggctacacagagaaaccctgtctcaaaaaacaaaacaaacaaacatacgtacatatatatatatatatatatatatatatatatatatatatatatatatatatatatggagagagagagagagagagagagagagagagagaaaggagtagacttggggctggagaagagcagtgactgctcttccaaaggtcttgaattcaattcccagcaaccacatggtggctcacaaccatctgtaatgggatctgatgccctcttctggtgtgtctgagacagctacaatgtactctttttaagtgaaagaaagaaagaaagaaagaaagaaagaaagaaagaaagaaagaaagaaagaaagaaagaaaggaagaaaggaagaaaggaagaaaggaagaaaggaaggaaggaaggagaagacccccccttggtagtgcaagcctatcttcccagaactgtgaggcaggcaagaggataaggaatcatacacagtagcatagtggatttgatgtcaacctttaaaaagatagaatgtgtgcctatgggcagtgggaagacaaatagggataaagtatgtagtgatggctctttgttctcagatctaacactttctttctcctattttcagatactctcttgacttactggaataaagtgtctcctcaggagctcataaacattcttgtacttctagagtaagttacgctattttcctaaacaatcaatccacttacttgaaaaaaggttggttgaaagaaattagatgttactgtttttctgttttcgacagttaatttgctattattgtagaaaattaattatttttaataatctagagtctagcattcttcacccagtgataaaaggaaagtggcagaatatttgtgatcccatagaaaacctcttgcctagtaatagactgtcttcaaggtgagtgagaatcttactatgaccttgaaaactaggaaactataatggcatcagttagcttgtgtcacttttttgaaccagctgctgattaatgcacagctaaaatttagatgttgagctcttagagttgagtaactctaaatactcactttaggaacagacagatgtagctgtatggatttatatagaaatatacatctacctgtattttaaaacacttggggaaaccaactatggtgaatgaaaggcgttatatgataagctactatgttatcattatcaaaaactaaaaggaaaattataaacagattgaaatgtaggaattttttacataaatagtacatgcgcattatagatacagttgatatgctcatataaaatacaaagaggataatcaatatataaccagttgatgcaactttaaaaaaaatcatagaaaatatctgctaattagcagttaagatttcaaggggggtcttttaaatatatatttcttagacttctagattacaaaataatgggattttcattatagcattttcttacaaatcatttctattgatcttatcttgctgcatcctttcagctctccccactctgctgaccccatttctccattagctccgttttccctttcacatagcctgttttcgattgcattttgttcctatttttccctttcatttactctcccggaagtcctcttttttttttcatggacccctttttaatttgatgcccccccccagctgtagtaaacagtgtaaagatgctgggaaatatttaccaatgacaacaactgatggtgagaatttgcttgaaaagaggctggaggaagattagtttgcttttcctggaacttaaacaagcctgttcttgacagctagtgaagctgggaaacaatgaacatgtgggggtttggatgttatttttcctatattcatgtggttatgattattatataaaacattttactatataaaacatattataaaaacattttaatacctctgtataaaatatagcatttgcctctacttctataattaaggaacatggtttggtcttaatgagcactagagacctttgctatggtatggtacagtgcacaaaagttgatttccatgggcaagttcttttctaccctgtagtacattagtatgtaaagacatgggacttttaatgctagtataactatagcaaatataaatgaaaaggtagggtatggctagcccataagtagctatctgtagaaatgaatgctattgtagtatcatttgagtaaattgattttgggaacatatgaccctctactcattacttgtcaaattgcaccaggtagccgtatattactaatgtgctgttgttctcttttctagagtatgtttgtttcacttccgatatatggggaaaagaaacatagcaaggtaattcctgtggtactacaacattctatttcttcattcttttccaacaaagagcaatcccatcggtggcatgtaaaacctaagataatggctttaggttaatgtaaaggcagctgtgacttattcagtgtatcccaattccaagttaaaactaatgtaaatgaatactgttttcaaaggggtagtgactagagtaatagagaaggcttctaccttctgagatctccctaaaccttgaacaaatatttgtgtttcctggaggacttaagtaagggctaaatataacagtaggcagaaatcaaaaggcagaggtggctataaaatgtgtcacttttgcctgcagtctgttaacatcccaagtactaaggtgaataaaaaccctcaacagtaattaggacatacattatatattatctatttattcttttgcctcttatatctttatgaagaaatgtttgaggggttctagggcataactcagtgatagaacatttgtttagcaaatgcacaaggccctggattcaattcctaagaccacacacacacactaaaaaaaaaagaaaaagaaaaaaagaaaaaaaaggaaaatacatttgttcttggaatatggctcagcagctgagtacttttgtagcatatgttgaagccctgggttcaatcccctacactgaaaaaatacagccaggaatttctgaaggcaaatggttgaaggcaaagaaagtcttgcttagttcaattatgagtgtatctgtgtgtatatgaatgagaactactagttaaaggaatccaaatatagtcattaaaaaaacttatgtgtatgcttggacatgcccatgccatgcaaatgtgttaaggtcagagaacagcttgtggacctagtcctctccttctactatgtcccagggatccaggtcaggcttgtttgacatggtggcaaggacctttaaccactgagccatgtttccaggaccaaatagtttattctccaaatttatttattctccaaatttaaagcccatagcagtttctttctttgttttgtttgggtttgggtttgggctgcaggatctcatggagccccagtttgccttgaacttgcttgctctgtctccaaggaggaccttgaacttttgatcctcttgcctcggcttctcaaaggctgggattataggaaatgtaagcacaccatgccaagcttagtaccacagactgaagcctttgccttcggtttattgctgcgtctctggaacagcctagtaataaatctcaagtgatatgtgttccagtggctaccatcgttccctgtgactgtgagctgctctgatctttagcaccatagaccttagcatcgcagattttgttactctgacctcatggttagaagaggacaaacttctccttcctgagtttacacatgacacagctgtaagtgatccagaaagaaactggattgatattcattcttgaatatctgatgcctgatgccagccccttcccatttcagtgtctgtcttcttgcttctccttcctcacttcctgaaaagaaaaaaacctgaatattattagagtgttgttatctacttagccccagtgttttggagaaggatagaaggctctttctaaataccttagctaatagtatatgttttttgtttttttagagacaggatttctctgtgtagccctggctgtcctggaactcactctgtagaccaggctggccttaaactcagacatctgcctgcctctgcctctgcctcccaagtgctgggattaaaggcctggtggcacacgtgtgcgccaccatgcccggctggtatatgctcttttttttagatccattaaaacttataatttaggggctagagagatggctcatcatttctaatatatctcatttaatccaagcaatagttgatagaatcttcgagcagcatattatatttatctggaaacacatcaacaaaaatcacattttagtttaaaagaatcaaacaatgatgtatattattggaacacttcagtttttgttgttactgtatttttgtttgtttgttttttgttttattggtgggggtttgaaacaaggtctcactatgtagccctggctgtcctggaacttacaatgaaaaacaaactggccttgaactcacagagatccacctgcctttgcctcccaactgccagggttaaaagaatataccatcactgcctggctttacttcagttattgatttaaaattttattttagggtacatgatgcctggctatccaaacactttggaatagatagaaaatcacaaactatgccagctcttcgaaacagatcaggggtgatgcaagctcggcttcaacatctcagcagcttagaaagctcattcacacttaatcacagtaagtaatcttgggtcaagggcatatcaaatagcatggtaatgctatttaatctttttttaagaaaaattcaatgtgtatatatgtgtgatatgtatacagatatgagcattgtgtgggtgcaagtttatgtgtatagtgtgtccgtcaaattttatttttaattgtttaagatttgtttattttatttaatatgtattaatgtttagcctgaatctatgtatgtgtgccatgtttgcctggtacctgtgaaggccagaagagggcacttgatcccccaaaactggagttacagatgagtgcgagtcataatgtgggtgctgggacttaaatgcaggtcctctggaagagcaaaaagtgctcttattagtgagccatctctttagctccactaaattttaatacaatgtattaacgtcataataaaatagcatataaaaatattcagttagagttattattgttcatttagtgactactaacatatatgttctgtgctaattacggaaatgaatcgactctagctggacttagtagttcaggcctgtgattccagctaccaaggggggtgaggcagaaagttcacaagatcaaggccatcctgagcaaatttgatcttgtctaatacaataaaaagcttgtgtgtgtgtgtgtgtgtgtgtgtgtgtgtgtgtgtgtgtgtatacatacatacatacatacatacatacatacatacatacatactggggacctagcccactactagagcttgcctcttgcctagtatgcatgagaccttatattcaatccccagtagcatgaaatagtaataatgagctctaaatactagttgttggaggtatatttaaatgtgctaaagcattgagaaggcacctaggataagaagaaaaatcttgcctaactggggccgtttggggactagataaaggggaagtaccctctgatagcacatattaataataataaaaaaaaactcagaggaagaacactttcattttcattcaggaatccaaaggtcacaggaaaagaggccaagaaaactggctttgtgaagcctaattataataataaatgtcctgcatagataggccctgagctaaaagcctgtagatgcaatttcttttttattgttccttaatcttttttttacagtctagtcgttaacccccctccctgtctgccctctggtcattcctcctccatacttccttttcctaccacctgtctccaagaggatgtctctgccaccccacctccacccctccagacctccccactccctggggcctcaagtctctgaagggttaggtgtaccttctctcactaaggccagaccaggcagctttctgttgtgtgtatgtctggggcctcatatcagctggtgtatgctgcctggttggtggctcagtgaggatgcaattttttcaagtttctgcttgctgtaaaagtgcaacaaacctgcttccataggcccataagtagcctggaatcctgtcactggcagaactgaagacatctgactggaggatgctgaatttgcatggctttgtcaggttttttacccatgctggcaacacagctgaagatgcctcctacatgacttcctacttccatcgccatagctcattactgagatcacatcaccaaagaagggtgcagctaaatacatgctgcagggggaaaaaaagtgaccggaagggattaagacagaccgtgactctcgtaaggtatctttgcagtgaagctcattaggtctgatggtgtgagatccttctaagaaggcaagactgtctcactgtggctttgggaggaagttatttggtgctgataacgtaagtctggttgggcatggtttaatatgcttctctgaccttaggttctgcaacaacggaagcagacattttccaccaggcgcttctggaaggcaatactgctactgaagtatctctgacagtactagacacgatctccttttttacccagtgcttcaaggtaaagatgactttgaaatcaatcggtgacaattgcaagaaaggaaaaaaaaaactataatagctagctagtttgaggaacaatagttcggtttgaaataacctggcaggggtggtgagaaaacactggtgacaagtcaagtttgactagctaaccttgggaaatcactgaaactcagtcatccatacagtgaactgttcctactaaaatgtccttaatccccctatgcctcttaaattctattgttttacatttgtctttagattcagttttctgccaggcatagtgacatgtgcctataatgtcaggacttgggcaacagaagcaggaggggtgccaaatttgagggcacctcatctgtataacaaattccctgtcagggaaagctctgtagaaaaagataagaggtggggggagaaagaagttggggaaggaaagaagggagggggtgttttctttcatgtttttattaaaataactactactttttacctgaaatcatgagagaatcagttagccaaaatacccattataacaaggcatcttgtaaggaccatgtccagatttttctcagatttttttttctctcaactcaaatcatcattcctttgatttgtaaaagaaagtcagttagtgtgcatgcttggtggaagggtaaaagaaaacagtagatgtgagagtgctttgaaagtgaaaactatatgagcataatgtaaggtatcataagtattagaacccgaaagtagaaaacatgcctcctgtttctcttcaattacatatcatttggcattctttgcgtttctgtttgtttgcttgcttgtttgttttgccttttctcctgtcttatgtaatatagtcaatagctgtaggcttccagatagactatggaaacgtgccccatgcttctcaaaaacattatataaaggagaatcaaataatatactaatcaattgtagtaggtgatcttacaaaatattaggtctgttttaattaaaataatacacacacacacacacactcatctatttttcatcatgtcagtagacaggacatctgagtctcatgactaaacttccattcctcccttgcttttctgatactttttatttaatagatatttgtgtatttcttggtaaaactcgagtactctcttaagcattttatgaatattatcttactatttttcgtgctggggattgaaccatgacctcatgcatgcaaagcacatattgtggtgctgtgttaccctccacttttctttggaaggatggggtaataaagggaggtaatggcataagaggacatgtgatctttatgaagttatgaaaccgctctgaagttgaattgtggttattcagtactggtgccaaactagtaacagtaactgaattggactcttaaaattgatgacattttggaaacacaaattatatacccataaactaaatacaaataatgaattaacttttaatactcataatagccttagtatcattctcataaaaataagggcccacagggaggttcatattgcacagctagtcggtggtgggatcaaaattcataggtacaccaatcataatggaagtccatggttctaggtactggccaccaatgggcctgtcaccaatttgtatagttctgtatggtgggcagaattgatataacctgcttagtttcttgaaagtcaaaaaggcagaactggagaagttaaccaatgttttgattttatatagtttggtatgtgtatgtgtctctctgtgtgtacgtgtacatatgtatgctgtatatgaatatgtgcattcatgtgtttgaatgcagatccaggtgtggaggtcaaggatatcattgggtgtcagtacagggtctctgttgttttttcactgtgtactccaggctggctggcacatgagcgtccagaaattctgtatctgcctcctgcctctcataggaacactaggactctagctgctactgcttttgtgtactgattttaaatggtttgtgggaatttgaactaaattcgttcatgtcaatcacttttacccacagagccatctctccagccctggtgcttttattttgtttttgtttttatttttgtttttttgtccactctttttttttttttttttttttttttttgcactgttgggtattgaactcaggacctcccagggaggccttctcatagcagacagacattttcccactgtagcctcttggtaatttattttaaagcaaatttcatgaaccaactgatatctctgtacaactgcactgtttactgtttttattaatgtccatttacaagaggcatttaaacagtcagttgtggtatctgttttcatggtatcatgagatattatggagggttcagtttgtcaccagtgcataaccagtgcataaatatatcttatacaaaatatatttccaaaagttagtaacataatcgatttttaaaagaattggtatttctgctaattattgctctcccagagaaatataaaggccaggtgctgtgtatttgtttttagatttctgaatgtgtaagttaattaaaaaatttttcctagccagtcatgactggatatacgcatagttccagcaaatgaattgtgactatgaactagactggcttttgaatgtagcaagttctacatcccactgagctgcaaagagaactttaagaagaaaataaaaaggaaaggaaaggaaaggaaaggaaaggaaaggaaaggaaaggaaaggaaaggaaaggaaaggaaaggaaaggaaaggaaaggaaagagaaaagaaaagacagaaagagaggaagtattgaaggagaaatattcttcccatattcattttgaagtttgatgttctctattgaaagagtaattttttagctcttttaaatgctagagtttcaatagtctagatctagtttgtatggtattttgagatatcccattcaagttgaagatcacaggaatattctcaagtaaaatcctgaaaatattgaaattttataggcagatattgatgatgcagtaaaatcagttcgtttatatgtcggggagaggggacaaactgaaggcgtctataaactgtttttttttttttcatgttttatagaaccaacttttaaataatgatggtcacaacccactaatgaaaaaagtatttgatattcaccttgcttttcttaaaaatggacaatctgaagtgtcactgaagcatgtctttgcctcactgagatctttcatcagtaaggtaagaacaacttgaaagtgctaggagctcaagggaagatggaggactggggatcattgtgctgacatctacaaacagccaataactaccacagcctttgtacggatgagcacagcatagcaaaatcaatgtagagaaccaggcaataatcatttaaaatcacaacaggctttccttttaccatcataccttcacattttcagtaggcccttttcaagggtctccctctctgccttagttagggtttctattgctgcaataaaacaccatgatcaaaaagcatgttgggaaggaaggatatattcagcttacacttccacattgctgttcattgttgagggaatcaagtagggcaggatcctggaggcaggaggtgatgcagaggcatggagtggtgctgcttactggattgctcctcattgcttgctcagcctgatttataatagagcctgggaccaccagcccagggatggctccactcacaatgggctgggctctacctcatcaacagctagacataatttgctttattttattcatatcccaactgcagttttcctcctcctctcctccaagttcctccccctctgcctcccctctccaccccactccccatctacttcttctgtctcttcataaaaggggaggcctctcatgaatatcaacgagccatggcatatcaagttgcagtaagactaggcacctcccctcctattaacgctataagaggcagcccactagtgtgaaagggtttcaaaggcaggcaacagagtcagagacattcctatccccactgttgggaatcctacaaaaagatcaagctacacaattgatatatatgtgcagagggcctaggtcactctcaggcagggcccctggttgacagttcagtctcagcgagcccctgtggactcaggttagttgattctgtgggttttcttgtggtgtccttgacccctctgtacagccaaatcttatgaaggcattttctcatctagggttccctctttcagataattctaggttgtgtgtcaggttggcataagactctccctctgcatcttcttttctctctctcaagattcaacccagggcaccgcattcctagctccaatgtcattttaaagtcatcaaccaatttttctttatcttatttatcatatgataagactaacatacccctactgtgctaatgaggcacaagtcttgcttatttaaaaaattgtgtgtaggccctttgaaagcagaaactaacttttagaactccagggtcttatagaatatcttgcaaatgaaccataagcagccagtatatgaccaaataagcaagccttacctttcattgtatgtaaaacagaaattgtgtaaatgcaaagctttaaaagttttctattctttaatatattttaataataaaggaatcaatagtgaagtgagttctgtatgagcgtgataggataaatagatagaaatacatttagaaaaaaaatcatttaacagttacttgctaggtagttactgcttataatcctgagggcttactgtgcaatatatgaaaacatacacagaatgataaatatatgatgtaccttatcaaagtttcccttcagtagtagttggacttagaagatgcaactgaaagtataaatgtcaccggtgtcttcactgtaagagctagacttcatcttttaggaaacaggcaggcatggaaatattttgagcagggaagtaaaacaatgtatattaaaagagaatcagtatgaccaagggaaagtaaacctctctaaaatgagacattggctgagaagcagagacaggcagaagtttgtgaattcaagaccagcctggtctgtgtagcaagttccaggccagccagagcttcaaagatacatggtaacacaaaggggttaatagaagaaaggaaaggggaaggggaaggggaaggggaaggggaagggaaagggaaagggaaagggaaagggaaggagagattgtgagtagttcaaaacacacagttaaaaaaaaatagatgaggacctggaaaggggcgctggtgtgcggctatggagatagaatacctggtaacaagagtttttttactttatcaccagttcaccaacaaagacatcagcatcaaagggatactggaactcgccagactgactggacttcccctgggaaggatatggagggaaaacagagatcaggatcagaacattagagaaactaacatagaaagggttgaaagagaaaactgtaaaggagacgagagaaaaaagtgacagaggtagcaataaataaacaaacaaacaaacaaatggacaagaattgacagtgtcacagaaaccaaggggcaacagagtatgggcatcctcatgaggtacagagtgccaagtgagatgaaaggagcacattagaacttgcattgaggaagttgctcatgactttggccattgttcatatctcaagtaatgtaagacgacttactgtaaggattaactgcacattgccatgtctgccctcaaatgtttttatactagagtatcttgtccagcaagagtcgatctactcttgcgaaactttatgagatttcccaacttgccaatcagaaagcatttgttacacaccctttgcttgcctaacactgaacctgctaaaaaaggtaaaatgatgcagattgattcctgaaatgcagattaaaattcaaggttttcaagaagccattttgagtagctgacactcaagctttagaagtcctaaaaaatggccattgtgcacttgaaagcagcttgcttgtcccacctttcaaggataggaggtgctaataaacccacactagatatatagtttatctttcacaaagcagcaggctgaatacattctcaaagcaccaggccacttggttgttttgaaaaatcagtgaccacttgggcactctttctctatgacaaaatgttttaactgactgtttgtggagtagaaaatgggcaggtatatatgaacacttcacataaactccattttatttaataaaaaataaggatcaatttcactactactgattttctcagcaggtggaaccttagaacaggagccatcattcatcatttcagtcattcatttattcagtatgtcatcaaatatgttcctgttatgttttggactatcttagactcttctcagattgacagcattttatgccaagtacctccacattattgcagtaccttctatactgacttgacttgttctatcattggcatatgcttgcctatatggtaacaagttcaaaccatcttcagaacagagatctgcccttgtattgatttgttatcctcgaaagctctgagttttaggagaggatatagtcagcagttgattatttggtggatttcattagattttcagatattcatttctattttccttgtttagtttccctcagcctttttcaaaggaagagtaaacatgtgtgctgcattttgctatgaggttttaaagtgctgtacttcaaagattagctcaaccaggaatgaggcatctgcacttttgtatcttttgatgagaaacaactttgaatataccaagaggaaaacctttctgaggacacacttgcaggtgagtaccaatcaaaactcttctttatttttctcttcaatcattggcctccatcaaaatcaacatctatagctagaaagatagctagctcggttggtaaactgcatgttctgcaagcatgagtagctgaatttgatccaaaaggctgtgtatggggctggaggaatggctccgtggttatgagaactggctgtttttccagaggacctatgttttattcatagcacctacagtgtgactcacaaccacctgtaactccaacccagtacatctgatgtcctattttggcctcctgtgtacgaggcatgtacatgatgctcataggcatagatatagatgcaggtaaaataactatacacatagagagaaatcatttttgttttaaagccaagcatggtgggatgcacttgtcaaccgagaactgagggaatggggacagaccaacctgaggctcactagccagccagcctaaccttatttggcaagttctaagccagtgagagaccttgccactgcccccaaattaagatagacagcaactccttccatgagtattttgttccctattctaaggagggatgaagtatccacacgttggttttccttcttcattttcttgtgttttgcaaattgtatcttgggtattctaagtttctgggctaatatccatttatcagtgagtgcatatcaagtgacttcttttgtgactgggttacctcactcaggatgatatcctccagatacatccatttgcctaagaattttataaattcattgtttttaatagctgagtagtactccattgtgtaaatgtaccacattttctgtatccattcctctgttgagggacatctgggttctttccagcttctggctattataaataaggccgctatgaacatagtagagcatgtgtccttattaccagtgggaacatcttctgggtatatgcccaggagaggtattgctgtatcctctggtagtactatgtccaattttctgaggaaccaccagactgatttccagagtggttgtacaagcttgcaatcccaccagcaatggaggagtgttcctctttctccacatcctcaccagcatctgctgtcacctgaatttttgatcttagccattctgactggtgtgactggtgagctaagatgaaaggatgtagcatccagagactaccccacccggggatccattccatagttagccaccaaacgcagacactattgcacatgccagcaagattttgctgaaaggaccctgatatagctgtctcatgtgaggctatgccagtgcctggcaaatacagaagtgaatgctcacagtcatctatttgatggaacacagggcccctaatggaggagctaaagaaagtatccaaggagctgaagggttctgcaaccctataggtggaataacaatatgaactaaccagtacccccagagctcgtgtctctagctgcatatgtagcagaagatggcttagtcggccatcagtgggaagagaggtcccttggtattgcaagctttatatgccccagtacaggggaacgccagggccaagaaatgggagtgggtgggtagggtagcagggtgtgggagagggtataggggactttcaggataacatttgaaatgtaaatgaagaaaatatctaataaaaattgaaaaagaaaggtagacagcaactgaagaatgggctaacctccacacataggcatacatgtgtacctgcaaacgtgtgtgcacccacctctcactctttccccacaaagagcaacatttatagctccatcgaaaactaaggtaagtggatatcatcttcaagtcttactttgtctatagcgtgaagtcagtgccagccagggcaacctgaaagacactatctcaaaacaaaaagtacaaagaggcctgagtttatagctcagtggtagaatgcttgcctagcatgcagaaggctccgggttctagtctcagcactgcaaaagaaatcaatatctggattttcctttctgtgccatagctcagaccatgtggctctctgccacttgaaatgggactgacccaaactgagatgtgtcaaaaatataaagactaagtacattaaaaaatagagcatctaaggtgtcttatattgtttatatgttgaaatgatttgtcaaatttggggattaattaaaatatatcaaaataaatttggggccattaagatgactcagtgggtaaagtgcttgctaccaagcctgatgacctgcttttaagcaccaacaaccaaactcctgacagttgtcctctgatattcacatgcatgtataggtgcagcacatgtggaacacacacacacacacacacacacaaagtaaataggaaaactaaaataagtttcacttccatttctttttcattgtagctacttacatatgtgactcacattctctttctcttggacaagactactctagagtgtaagtcttaaggatgcgtgttctcgttcagattccatgacagtctggacatggagcagctgacttctttagcctctgtacctcagtttcctcaaatataaaataggagaaactctacttcagaatttttgtgagcctaaagtaagatgattagatagtaagattagtagatagtaaatggcaggtgattctggttgttttgcatgcatctgtaaaacctttatttaacaacaaaagattgccaagcatgatagcacatgcctaaaatccaaacacgtgcaagattagggtaaaaggattacgtgtttgagccagcctaatctacaggacaagaagaacctgtctcaaaaaaaaaagcaggaattaaagaagaattgacctgggagtgctagcctgcacctgtatactctcatatacttgagatgccaaggcaagaggatcacttaagcccacaagtccaagatcagtctggatagcacaccaagaccctgtctcaaagacgtgcaattaatctcaagattttgtggaaattacagaacttagagagatagctatctgcttgtgctagactcatagatcaactacatacatggtgtgtgaccctaggcaagttacttaatctagctgaaccagattgctcatctgtaaaatgaggccaagtatttgccatcttatattgttatgagtatgagggtgaaaatgaaaagcatatagcagctggcaccactccagcacagagaacacactgggtgataattattctccatcttcatatcattatgattaattgatgaaacaactcaaaatctaaacacagtggggactttttggctcagtagtctactatgtaatataggcaatctctagttatgtatctccactgccttggtcgttcccattagagccctttactagggaaagggttattgataaggaaacaaccattagcctgcagtctgagctattgaagagactgaagcaggaagacagaagcaagttagatgttagcctggacacagtacagtgatacccctccccacccctccaagcactttttttttaacccttttgaaaaaagtaacctttatttcttcccacagataatcattgctgtgagtcagctaatagctgatgtagcactaagtggaggatcgagatttcaagagtctttattcattatcaataactttgcaaatagcgacagacctatgaaggtaaggaataaactcaaaccactttggctggaattctgagtcagtggtgctcaccatgaacagtgcactgagtttaatctccaacaccaaaataacgaataaaaaccactttaactaaaaaaaagagtttatattcttaaaccgtggtggaattctcagtgactgtcagtatggaacatagagaatgtgtgctttaagagttgttggcttttacttaccactggatctctaacaattatattcagcagtaactaaataaatctttaaactctgtgtctgttagtaataaaatctgtgttgttttttctgcttgatttctaaatttgctcggaaaagaaatatttattttctttcttaaaaattgttaccatttataataccagctaattaaaaactgagttggaaatttgagagaaatttcacttcttaggatggctatcagatccattgccaaaagataagaaatggaacagaagggtttcattatttgttggttttgtgacttccaaacgttaggccaaccgaatgttgcttgctataacagtccaaaattgtccatcttcagcaccagtccatcaggatcaaacctaggattctgagcactacatgcttaaaaactagggcattgtttaaaaaaaaaaaaacaaaaaaaacaaaacaaaacaaaaccctgcttcgcctactgtgttgcctggaaacaggttctgagatgcttccagggcgatgaactgtccacattctcgggaaaagtcatattctcgtatatttgacaatagtgcatgaaatctttttaaaaaatcaaaagctcacagtcacaacgtgcttgatgtttgggacgtgtagaatctatgtaccagaaaaccattcccataggagtgctgcttacagggagcaaaacactgagtagtgccagctgctcacaggctgggaaagtttgccttcaagcagctttgtgggttccccaggggatcagtatacagttcagctaatcccaggagcacagaagcaacgtgtactatttcagctattttactcatgctccaagaatttatgtttctagttgttaccatgctcaaagccatcttatacaggtagattagcatgatgttttccaagtgaatagggttgatgttagctctcctcaagaagagcccctttgccttccctttactcgtttgtgaatgacttagttttatctgctaaggtcacctgtatccctgttacaataaggttagcctttccctcaggaagtagaatttctgtgaatgaacacaagggggttagatgcatctaataatgatttttaaagcagacaaaaaggcagaacggtatattatattcatattaagttccctaactgtgtacttgccccatccccatcttggagtcagaaacactttgagaggttaatgttctctttaatgtctctggagtgtgatgtgactcacaacctttcctttgtggaaatggaaagttggcagcagggttttcactaaggtgtgtgttatagtcagtgggcaagataggcacgcttctcactatgggatgttgcctgcagagcactagctctggagccagattgcctgataagaggtcctgtctccatgacttgccaaccaagagatggtggctgagcttctcaactgctctgggactcagttttcccactggtggaaatgcataaaaagagaacttaattaaaacatataaagcacccagatcagtacccagtacctatgtgctgtcaataactttcagttactgttacaaataaaccaaacatgtagcattaacaatgaaagccagatagtgtgacctcaaagatcatgtttttatgggctttgagtattgccatcaggttcaaaagcctttaaagcctggctagttgcataattttaataaaataactaattaaaaaccctttagatttgccatatgaaatatagtactaccaactgttaataaggaataaaaaccatattatagtccccacatttggatgctcatgcttcaatcctattgacaatactgctaaatatgtgggtttttttgttttcttttgttttgaaattaggcaactgcttttcccacagaagtcaaagatttgaccaagaggatccgcaccgttcttatggccactgcccaaatgaaggaacatgagaaagaccctgaaatgctaattgatctccagtatagcttagctaaatcttatgccagcacaccagagctgaggaaaacttggcttgacagcatggccaaaattcatataaaaaatggagatttttctgaggtgaatacttaaaattttgctcccactggaactcttcaaactcctttgaacctattctgacacttctttctttgtcatccacttctaggctgcaatgtgttatgtccatgtagcggctctagttgcagaatttcttcaccgaaagagtaagacctttctgttctgagatgggaggactctcggctggactctctatctttgcagtgtgcaattgtgaatgggatagaattgagctcttaaaaatatgtttaccttcagcctcattcagtgctaaacagacattgttataaaagaagactagactgctcattttggctttggcttctgtgggaggttataagaataagttaaatagtacacggctgggcttgctgcccagtatttatttcccaagtctatctccctggatgactgccacaaattcagttcttcttagggctcaagagaagctctgcataattctttcagatttatgattgcttctttcccttcctcatccttaacttcaccaaccactgtcattggactaggtatctagagctatttttatgcagtgatacctgagtgttaaagggaatcaggcccttgaaggacatcaacacttctgtatttctaattcaagattcctaattcagggatcaggctgaaagcttccccatccctaaataatattgctgaattttataaatattcaaatagcaaaacaattgagcaaggtttaaaagttaattggtagtggcgattgcaatcaagacatctgctatctatcacaatgagggcaaaatgaaagcaacttaaaggagtcatattgctcctttttttcctatgtttttcttattttattatctctggaatgtctgtatttttcatttcacatgtaaaataatggccactgtggagattcttcccaaatatgactagaatgattaaactatgcattcatgtcatttaggtttgggagaaggggtaagatttcatatagtccaagcaaacctcagacttgctatatagccaagagtgaccttgaacttctgctattcctgcctctaccccccgccccgccgggactatgggcatgcggtgttggagatcaagcccagaactttgtgaatgctaatcaagcaagcatacctgagcaacattttcagcattttacttatattttaaactgacagtgaaatgcttctgaataatcaagtttacagattgttatactcagctaggggttgtggggtctataatcccagcacatcaaggctaaggcaggaggactgcacaaatccaagagagcctgggctacatgatgaattccaagttagggtggactacaaagtatgaaccagaaatagtcccagactcattaagaattattaggaattaactctctagattttgacaatacataattatattagagattcttcctgagaatcttgttttgctcacaagtacaaagacttgatattaaacaaaaattaagaatgatttatcaaaaagaaagcaaatctatatattgttttcattctctccttagtcggggcaagggggtctggggattgataaaatggctacaggcacaataagcatgtgcttttggaccaagctgtccaggcagtccctacaagtagttctaatggagaaagaattgatcaaaataagacccaattcatctttataaattagaacactgatatgtttgtcaagttgccctaaaaatacaaatcaaagttgcacacaggccattccatatccattgacacacatgaggttcttaaacaccattctttggttttaaatgctttccggagaaactggcttcctgttacaccagctttctaattagtgggcacttgaaatatgagttccaggcctattgaaaataaagcctttccattttgaaaacaggtaattctgttagaaattcttcccaagaatcgtgttttattcacgggtataaagaccttcagagcaagattgatttctccccactagcctggccttaagtttagaaaaagtgtatcttgctctagttatttcagcattaggcagataccttaatcggcaatctgacctgtcttaacaagtggatgtagcccaagcttgtcattgatgtagttcatgatattcctaaggttctttcaagtttatctctcatcaacctcaaagagctaaggggcaaaatgatgttttgcattttaaacaaagaaatgttaaatttgagagctgtttatatttttatttatggctgctgtctatttttgaacctgtagaaatcaacgatcttaaactagaaaaccttattctaaaagggcagcaggagtagaaatcctcgggggtttttccaccttagttttaatgattgaaagaaaaaaggaatccaaaacagcttttttaaattatctgcttaaactatgagaatagtatcaagatacttaactaagctaaatcagttaagcatactataaaaatattcttaatgaaaatggaataagatgctgcctagctgacacattgtaagcaaatgttctatcgtgtagactttttaaaataaaaacaaagtttcttctatctggtggtttcctggcgcccagggatagccactatctaatgtgagaactctgcaacccagcagtatttaaaaaatccaaaaaagacttgactcttcaagcaaaatatgctttaaattacatttagcaatgatcatcaagacacactagaacttattgttttcaattaattgtccattagtaccgaagacaaaaaaaaaaaaagagtatttacattgtaaatccctgactggtatgtagcaccaaaaatttgttttctgacatctcaaagaactgtactttcagctcatttcacccaacccttctctccctcgctctgggatggaactcagggtgatgtacatagtacacaagtcctccattattttgagttataccctcagctggccccgcagccatttctcttgaaatgcactataaaaatattcttaatcatgatgtaatagaatgctaattagctgacatattggaaccaaatgttctatcatttagactttcttttaataaaaataaagtttgttctgccaggtagtttcctggtccctaggggtgtcaccttaagtgaaggaccactgttgtaatcttgaaccccttgttttgggcactgaagtgccaggaaaagggaaaagaggaagccaggaatggtgactcatgcctgtattcaggagtgggagggttagaattctgaggccagcctgtaccacatagtgagtcccagctatggtgtgatatctgatcccattcctgcccctccccatagaaaaaagaagaaagaaaagaaaatgaaagtggaagggcatctgcaattgaccccaccccaccttccaacaggtccctgatctttgtaccagagatagcttatagatagattctcaggctcttccctttgcccaagtcagtggaagcagtgataatggggaatttgttatgttactctttcttgtcctcaaatataagatacaacacaagtcagaatttcttttcattttgtctgagagccttgccatgttctggatctcactctctagagactttggcattcttctcttttcctgagagagggcacaacacttttcccctgggaaaacaagagtcaagttttctgcatttttgtaccaccacataacatcctcgttcagcaaaactttggagcttcagattctcccataagcccaaaatatgtgatttcccttctctatagcgtctctttttctcattccttatagggtaatgctgttttcattcccaagtcttcgtatccagtgtcatatagctaaaatttcacaaagtacttcattcccttgtttgttcctagttccagcttcccctttaatgctcaccccccaagatcttacctcttactcttcttctgactgccagtcatttttctaattaagtattggcactgcaatcccatcctccaaaatcctactcactcttttcacagggtcacttggactcaaactgtttgtaccttcctggactgctgccatttttatttctctagaatggcatgtgggaatgtagaagcaataactatgaagcattaagatcaagattccgtgtcaaagctaggtggagtatacctcacccacattctcagcacttgggaggcagagacaggaggatggttataagtttgatgccagccatatatgaaatgtgcctgtttgttcccctctaaatcacaagatcctagaaaacacagactgttgggacaccatgtgactttctccacctagattctcactccacaataacaattttggtcacagttgtaaaagttcttttcagctacagtttactggtaacttcccaggactccagctggcagcagttcttttattttatcttgagaaagttactttaaaatattgacaggcttacttagcaataataattcatttagtccttcttttacactaagctctattccaagcaagtgttcatgcaattctcacaaacttctattattattcttgctataatggtagtggtggtagtaatgatgatgaaaaactataaatactagagaaacaaacatccaaattcatacagtgacacaggctcatctaacttttaaatctatgacacactcagtttctccaagggtgttttatctctgccatctgtttcacttcctgtctgtcataaatcctgggctaggctcttccaataactaactgacttccctttccaagtctcagcgaaatttaaacactagagatgattaccaaaggtctttcggtggttaaacaaaaattgtccaccctcttgtctagatgatatggacagagcaaatatagaaaagatgtgcattttaatataatttttatactaggaaatcatctacaccagccactgcagatcgtgcaccaaaaccataacttacttattataatgaatttgggctcactttgtacaggaggaagaaccatagaatatagtagatctgaggaatatatgaaattacttttacagctgaaacatgtacttatgactttgacccaaagtcataagttattaaaatatgactttgacccaaagtcataagttattaaaaatagcatatccttttaagggtatctgttatttaccaaatttttttgtaataaatatggtccgtttctggttttccacacagaattattccctagtgggtgttcagcgttcaagaaaattactcccaatatagatgaagaaggagccatgaaagaagatgccgggatgatggatgttcattacagtgaagtaagagcccagggcatgcatcatcatttatagaaatttcccattttgaattgtatttatattatgttactagatctggcttaaattgaaaaatgactaagggttggtaagctttaagtaataaaactgtttaggcaaaggaattcctgttggcaggatagaatcttgtctcagtaactcttcccattatcttgttttaaaatacaacatttagatggctagaaaaatggtttagtggttaagagcatttgttctttccgaggagccagatttgattcccagcacttacatggtggttcataaccatctcttactctagtttcaggagacctgattccctcgtctggccttcatggacaccatacactccagtggtatatatacatacatgtaggcaaaatactcatacaaataaaatgaataaaacttatttttaacctccattattgaccatctttatacgatgatctctgtgactagatcccacctagcatgtgaaaagggactctagaaaactagagttaaaattgtcttttacttaaaataggcacgatatttgtaacaaagtagtgtgaatggaagcgccctgcttcctactgcagatggttagaaaacagctttgcttgtccatcagtaaagatctgttaagcaccaacataagatcaagcctattgacttgagataaaaggactgtaaaatgatgaactatgctctccaagttctgctcgggagatagtcattgaaagaatgtaggtatgtgatatgcaaaatcagaggtataaggtaaggagattaacatggctgtgatatgagagctggattacaggtgactagacataatctggagacagagtctggggaaggtcaatcttattgtccagatgtgtggcaattatgtcataagccagaatagtaaaaggcccagggtaagcatgtagctcacttggcagagtacttgtcttgcatgcataacccctgagtttgatattcagctatgcataaactggttaagtttatccatgcctatacttcagtacttcggaggtaatgatgggaggattagaagttttaatttcaagccctcctttggtacgtagagagtaagaggctagcctgagctacaggaaaccctgcctcaaaaagcaaactactacaaaagcctatactcaacaaagctggaaaatctggatgaatggacaaatttctagacagataccaggtaccaaagttaaatcaggatcagataaaccatctaaacagtcccataacccctaaagaaatagaagcagtcattaaaagtctcccaaccaaaaaaacacaggaccagatgggtttagtgcagagttctatcagaccttcaaagaagacctaattccaattctcttcaatctattccacaaaatagaaatagaaagaacactgctcaattcattttatgaagccacaattacacttaaacctaaaccacgcaaagacccaacaaagaaagagaacttcagatgaatttcccctgtgaatattgatgcaaaatactcaataaaattctcacaaactgaatccaagaacacatcaaaataatcattcatcatgaccaagtaggtttcatcccagggatgcagggatgcttcaatataccgaaatccatcaacttaatccagtatataaacaaactcaaagataaaaatcgcatgatcatctcattagatgctgagaaagcatttgacaaaattcaacatcccttcatggtaaaagtcttggaaagatcaggaattcaaggcccatacataaatctagtaaaagctatatacagcaaaccagtagccagcatcaaaaatggacagaaacttgaagcattccccctaaaatcagggactcgacaaggctgcccactccctccctacctattgaatatagtacttgaagtcctagccagagcaattcgacaacaaaaggagaacaaagggaaacaaattggaaaggaagaagtcaaaatatcactatttgcagatgatatgatagtatacttaagtgaccccaaaaattccaccagagaattcctaaatttgataaacaacttcagcaaagtggctggatataaaattaactgaaacaaaccagtagccttcctctactcaaagcatatccagactgagaaagaaattatggacacccttcacaatggtcacaaataatataaaatatgttggtgtgactctaaccaagcaagaacttcaagtctctaaagaaagaaatagaagatcttagaagatggaaagatctcccatgctcatggattagcaggattaatataataaaaatggtcatcctgtagaaagcaatctacagattcaatgcaacccccatcaaaattccaactcaattcttcttagaattagaaagagcaatttgtaaattcatctggaataacaaaaaccccaagatagtgaaaaatattcacagcaataaaagaacttctgggggaatcaccatccctgagttcaagctatactacagagcaatagtgataacaaactgtgtggtattggtacagagacttgtagatcagtggaacagaattgaagacccagaaatgaacccacacacctatggttacttaatctttgacaagggagctaaaaccgtccagtggggaaaaagacagcattttcaatgaatggtgctggttcaactggcagtcagcatgtacaagaatgcgaattgatccattcttatctccttgtagaaagctcaagtccaactggatcaaggacctccacataaaaccagatacactgaaactaatagaagagaagtaggaaagagcctcaagcacatgttccccacccaccctcaagactccctcatagaagcaggaggggggaatgggatagggggcttcggggggaaatcgggaaagaggataacatttgaaatgtaaataaataaaatgtccaatttttaaaaaggaaaacaaacccaaaatacataggaaataacattaggaaggagagaagaatgaactgctgcttaggaaaggcaatgatctgtaggtaccttggagatgtttgggaattgggaaatgatagctgctatttacagggagagtgataagtaagtacaatttcttgaagttttttttaagagctttaattatatattttagtgaaagatacatgcagaaaaatcaatgagtgaatatcatcatattcatataccagcaaatatctttaaaagagttatataatttaactatcaaaagttttctatttacatgatagagaataagaaaagaggggagtacctgatagggatgcatagtaatgccacaaagaaacctgttgacttcatagaagacaataatgaaacagtaataaaaatattttaaaatgaaatatatcacctctaaaataaaattctagatgcaaagttttataaaaaggcaaatgtgacattcacggagattgaagtggtgtatcatcccacaaaattacattttttatttttaaaatatgtatttatttgtttgtttattatttgtttgttttgcttttggagacagagtttctctgtgtagtcctggctgtcctaggactagctctgtagcagaggctggtcttgaactcacagagatctgcctgcttctacctcatgaatgcttggattaaaggcgtgtatcaccactgtctggcaaaattctttttttctaacagttgccgctgacacaggtatggcaacaaatgcctgtaatctccatcttggaaggcagaagcacaaaggatctcaagttccaagccaatctgagccacataaggagactctacctccaaagaagaattgtactaggaatatattatgccaggcatctgataacccaagttatcagaggacggaggcaagagtattgccatgaaatttgtctagtgtacctagttcctgaaccagcctggctacagaacaagaccctgtctcaagtggagaaaggggaaaaggagaagaaaagaaacaaatcttttcactttccataatctgagacttagatataatttagaattctgttggttttagtatgtggccccagtctcacacagtacttcacaggacatatatctttgagcttctccttgtcttccaaacagcagctgtatgttatctctagagatagccttgttaacatagtgggattttgtgctctatagcaataattatacatacttttatttatttaattttataaattgatcacagtgttcaaccaagtaccagtttggtctcatgtagaagggtttcctcatgctttcatatctgaaacaggtgacactgatttagcagttatattaaaatgagtcatattcagcagtacacattatctattatcctagcagtctacaggaagaggaaagaagattgttgtgagttctgcctctctgcctctctgcctctctgcctctctgcctctctgcctctctgcctctctgcctctgcctctctgcctctctgcctctctgcctctctgcctctctgcctctctgcctctgcctctctgcctctctgcccctctggccctctgcccctctgcctttacctccgcctctgcctctctccccctctgcccctctgcctctctgcctctctgcctctttgcctctttgcccctctgcctctgcctctctgcccctctgcccttctgcctctgcctgagtgctaaagaggtgtgtaccgccatgtgcctgctaaacttcttaacatagatattgaatgttaatatgttgactctttattcaagtagtcacattgattgagcaactgctatataagaggagtatatgagttacggaagaaaactagataaataattgtgttcccatttttaaagaatcatggtttattaagaatgtcagcaattgagacattgtgcaaattttgtagaactataaatatttacccaattgattagtaaaatgggaaccaagttatttgtacttgccttctttatctggaccaggaaaaacatctaggaggtcagtacctacattattctaagaagaatggaatagaaggtagaagccttccttgccttctgatgatagctgttgatcctcagcattccttagcttgcagctatatggattctgtttctgtctctgcagtcacatgttattttcctgaatacctgcagtgtcttatgctatctatattggcttgagggttcaccctttatcagtatattcatcgtttttattagttaattttatttattcagtatattcatcttaatcaattatatctataacactttttctggatcaggttacattctgaggcaggtaagaacttcagcttacagtttagagcagtgtttcataaccttcataatgctgcagccctctaatacagctcctcatgttgtagtgactcccagtcataacattattttgtttctaattaataactataattttgctattgttacaaattataatatgaatatctgatatacaacccctgtgaaagctcatttaccaccccgcccccaaggggtagcacctgacaaggtgagaagcactgattttgggaaatacaattcagttcataacgggataaagtaaaaacttcacctcattttctagctaggaatctatagaatattgccacctgctatatcgcaatgagatctacaggatgcattcagttatctaagaaacaaacaaggatcattttggcaattcgttctgtagatctagtgactcagccagaagcatagcagttggcctactctttttttattgttgagaacatgagatgatacttcacaaaattgtggcaagcagctgttatgattctcacaggcaaaagagctctctatcataggacattaacccatccctgatgttcaaatcatatgaaggaagaatttgctctctggattatttcagtctaatgaagacctaaatcactaatgcaatagcttgaaaagctgtcacattgtctttaatgttctatgcattatttcaatatgaaagaaaataatggaggtgtacaagcttagtggaattcaccttgttaagcattttttgcattgtctagttacttacttttgttaaagcatatgtgtgcatgttgatatttctgtacattattgctatttctatacatgcatacaacatttgttgatgatatccaaccatacttctacccttaccacctgccctgcacaccctggcatgatttccatcctgtagtaaatcacccttcaactttcagatcaactgagcccataatttgaatcaaaggattcaattcagcatgatactatctgcaagtaaagtctctattatcacttaaacagaacacatgtagtttactgttgacgttaatgtcatattttagaaatatttctaatttcctggtgcttgtaacatttgattttgaaaatacagttctgagactgtattttcaactgtagtgctggcacatacttctaatcccagcaatcacaaccctaaggcaggaagctcaccagtgggactacaggaatcctgagctctatagcttactgattcagaaggaagaagtgaacagggggaagatgtggtcatactaatagacttctgtgcatttgcttgaacttagcccatttggtatgttcttttgtctctagctgcatatgtagcagaggatggcctagttggccattactgggaagagaggcctcttggtcttgcaaagatcatatgccccagtacagggaaacgccagaaccaggaagcgggagtggatgggtagggaagcagggcgaggggagggtataggggactttcgggatagcatttgaaatgtaaatgaagaaaatgtctaataaaaaattttttaaaagaaaaaagacaaataagttaaaatggttagcaattgttttgtctaaagctgcttttaatgcctcattgaatatttctcttaatgcaggaggttttgctggaattgctagaacagtgtgtggatggtttgtggaaggcagagcgatatgaagtaatttctgagatttccaagttgattattccaatttatgagaaacgccgtgaatttgaggtagggaatggacacattgccatcattgccttctatactttgttttggtcttgttaaaacactaatatcatgttgtccctatcattttactctgatgtcttctaatgaaaatactggaattgtatcacagaataagtattcttattttgccctttttgtttgtgccagggtgcataggatcttgagcatgatagacacatgctctgtctccaagactcagtccagattgtagcattcctccctggactgtcaaaaccaccaaacctccatatcaccaagaatgacctaaaaacatgattcttttctttgaacttgagtgcagagactacaaagtactggctgaccatgatgaagaaacagtatgatggcattaataagccagctgtgagtgtctaccaatgtgccctgccaagaaaactgttgataaattctagtgaagaactgctgccatgtgcacaaggcagaatttttaatattcaagtctttgggcccatatcataatttccactgcatctgtacaaaaaggggaaggaaattggcttgggattcaagctattttgagagtagatgtgggatgagctgagtgtggtgacatacaaaaacaaaaacctgttttaaactcaaaggttttgggaagttgctgaagctgaccagaggtgctaagtccctccctctccaatataaatggtaaggactgctagaagacactctcagaccatctgagctgcccagaagagtctcagatcaactgagatctctgaaacagacactctttaaccagttcagctacctgcaagtgtgctccagggttttagttctcttgggctttcatgagtcacgccacggtagacttttgatgatacagctgtctttgagtcatttttgcccatataagggcttatctcacccatacctctattagcaaaccacataaagctcattaattcaacagaaaaaaaatgtttgaagatatcgacaaatagaactagagaaacagctcagcggttaagagcacctgtggcttttgctgaggacctgggtccaatttccagcacccccatggtggctgagaatcgtctgtaaatcccattccaggggatctgatactgtcttccgacctctgtagtatacaggcatacatgcacgcaaaatatcacacgcagaaaaattcattttaaaaaggaaagttaataagtatacatacataggtaaaattcacatgttcataaaatttaaaatattttgtacttctgggcattgaaccctggctaggcaagttttctaccactcagctgcaacccgatcccctttattgcaacttttgaggtgaagtcttgctaatagcccaggatggcctggtactgtagtgggtaaagtaataccctgtctcaaaaataaataaggaacaagaacaaaataataacaaaaactaaacattgatagttttttctctcttgcgtgttgatcttgatgatacttaatgactgccaaaatcacaaagttctctattctaattttttcagaaactgactcaagtttatagaactctccatggcgcttacacaaaaattttggaggttatgcacaccaaaaaacgacttttaggtactttctttagagttgccttttatggccaggtaagtgtactttagcaaagtatatcaagttgtttgacttttaaaatattttcctttgacttactagatggcctttgtgtagtttcttgtagaagtctttcttgctgtgtacacagcacgggactcattttgtaatgttccagttcactttgcttcacttgtctacttaggtcagggatgcaaagtatgaacttctcattactaacattcatgaaaaaaatacattttagtttcctccttctaccaagaatatgtttatatacttatgaatttgagtacacacaggaaaatattacatgggaataattaatacaataaataaaaaataaaagtattttcatataacatcacccccttccagacaataatgtttgtatgcttgtgcctttgacaattctcaacttattcaaagttagaaagttgactatatgcatgtggtatttaatatattattaatatactaaaattaaaatattaatatggtcttagaatttctatttttatgttaaaacacaattattaaaagcaacttttagaagaagagtctatgtcagcttgtaactctcaagtcatactccattactgaaggaagtcagagcaggaactcaagcagggcaggaacctagaggcaggagctggtgcagaggccacgaaggggtgctgctttcctgtagaacccagggcaacctgcccaaggggtgatcccacccactgtgggcttggtcctcctatatcaatcatctatcaaaacatgccctacagccttatctgataaggtattttctcagttgaggttccaacttcccaaattactctaggttatatcaagatgtcataaactaggcaacataaatatattaaaactgatattaataagtattattttaagtatattcaaatatgttgtcactagtcatgcggattctccttgaatgtttgttcacacagtatcatttgtttacctttacaatagtctttttttgaagaagaagatggaaaggagtatatctataaggaacccaagctcactggcctttcagagatttccttgagacttgtgaaactttacggggagaaatttggtactgaaaatgtcaaaataattcaggattcagacaaggtaacttgtgccatgcatttgaaagcactgttcatttctcacaggcctagtacattgctcctgatttgtgagagggaagctgtccctaactccctgggactaagattacagatgtgcactgcccaaagggtcacattcgaggcccttctgcctacactggcaaggcattactgaagcgcctgatcccccaatgtttttttttggggggggggctggtctcaaattcacaatagttccccctgcaatttttcctggttttgtgattacagtatggactggatctgagtttctaatgaagtcagtttacagagagatagtttgggtctcaccctaaatattatctatcctgttagaccctatcataacaaggtgtaaaagatctaacaagagagactgttttgtgggaaatgcactaatccttctagatagccattgggaaataacagccagaatgtttgagtcctcacagtacccagaatgagagctcacttcctaggtagaaaggacttccgcagtgcagagtttgtgcctacatttatccagtaactttcaacaaagcaccaaaagtcaactcgacaacagttgacaaagaaaaatctcacctctttatttcctagaaacgcctgtatctcttgtgagttttataatctttaacgtaggcttaagagctttcaaagtagatgtcatgattagttccagatcagtatttggcaatacctctctataagtttcaccggttttgttttgattcattgaattaagacagtagaaaattccctgtccttgcaaccagaatctcagctcatttccatgctgttgactgctgtagaaatgaataggtgatggttagtgagactctctggacaacatgtgtctttctccttcattctgctttgaaaacctagctccaaatgctgctgaaaaaccactgtgaggcaaccagacttctgatgttattctatacttctcataggtgacatacaagaagctatttctatccatataaaatacaatcgtcccccctcataactgtggcttctacagccacagagtcagccaaccatggatccaaattattcagaaaacactgcatctgtacccaagagtttcagactttttgttgttattttgttttccttggttttgagacaagctcttattttgttgcccagactactctagaattccctatgtcacccagtgttgtgtgtcagtattcccaggaagacatgagcaagcctctactcattccagatagaaaaccaatggcagatcaaagtaagggtgccacaaagtgcaatttattgaaccgtaaggttttttcaggttttttttaatgggaacaagataagaagttatttagtaaaatagaaatgactcaaagacggctgtatcaaccaaaagcccaacctctgtatcaaccaaaagcccaacctagcataaaggacagctcacaaaaagcagacagcttccacagattagaaagtatcttttccaggcaactaatatgggctgagcttcttcctgacaactcagctcgactgtgaacgtatctcagtagtccttatttatgcttagaaaaggagagatagagtgaatgtggtcagtttcagggaccccatgaggctactgagtattttacttctttaactgaccttccctgcaagatggaatattttatatctaagaacattgtgtctcttgaggagtttccttgaagaatgcagtgtttcacctccctttagaatatcctgtatcttggagaccaagatggagggctttgtttaaccttgtaggaaattgttacacaacactcaccctagccaaattttttttccccctgaaacatttttttaacaggatctgacttaggcaggactgaaatgcaggacctgcctctgccttcagagtgctgaaattataggcatacattaccatacctgcaagatgttttctttgtaactgttccctaagtaagagagtatagcaagcaattgcgtaacgtttatgttgtagtatgatcacaagtcatcccgagatggttttaaagctgcagaagcataatttttaggttctctgcagcaatcttgccactctttatagggaagttgatttttaatatgtaacagtagaattaaaggcattcgtgtatgtgcttgtgaggtgggaggggggtcgggggggggggaatctggggacctgagctaatatgccaagcaaaccaaaaccaaaaccaaaagaaaccactctttgtttgccaaagaacaaaatctgcttaaagtcacaggcaatttgaatagaagtttagtggtgtcttccaggatcttaaatgtatgtgtcctttggcccaacatttaaatcaatacaaacttatctccatatataaatggggctagaatcttcactgaaggagtctttcctgctatttatatataaacggtgtactatttaatatgtgcatgtataaatattttaggatttgacatcccacttgaactttttattttctatttatgttttcatcttagccaaataattgctttgactgaggtctttttctaaaactccagcttttaaacgtgagagaattatttctgggacttttggctaaaataagtataatcagaaagaaaggttaatgtttccagagcaacctaagtaaataggaggaatttaaagaggttaacagtgttaagaaatttactgtcccctgtctttatgcctacatatatggaggataaaatcatacagagactgtttaggggggtggatttttgttggctttctttctttccttccttctttccttccttccttccttccttccttccttccttccttccttcctttcttccttctttccttccttttctttcactagatagaccgatgtgactgataaataaccaagctagtaaacaagtcacccagaaaactaggcagattttgttgagaagacactgaaagcaaatcccgaattttctctggagttaaggagaaatgctagagagttcgagaatccacaagtgaaccttcagcaaggacatcagcagcaattcttggcatgaaagtttgatgactcataaaatgaccagcaaccatcactagacttttgggttatcttgctgctgctgctgctgctgcctttgtcactgggaattgaactaagtaccttgcacatgctagaccagcactccaccttatatgtcttcaacatagaatcactgttttttcttttgatccctttcctctgctggctaggattaaactgatgtaggtaagaacaactactcttgaaggctgaagagatgactccatggttagggcacttgcttctcttgtggaggatctaggctcagttcccagcacacacatactggttcactgtcacatttaacttcagatccagtgattttgttgttcacttctggccttggcaagaactacaagcatttgttattttacaagtttatacaaacatgtccttgtgaacatacccacatgtagacaaactctaatacacataaaatacaatataaaaataataaaatctttcaaaaatatccactcgtatcagacactacttgtggatagccaaattgatatactactttattgcataattaggtggtatattaaaatacttaaagctatataaatctttgaactaaataattattttctaaaaatgtatcctaaggcaaacaatcagaacaacaaaaatccctacaccatttaaattcaaagatgttcaccaaaaaatgattttccatagcaaaatgtaaaaaaaaaatgaccaatataattcatgtgtattcattcagccattaatgtcatattaagccacttgtggttcacacctctaatcctaacactgaagtggccaaaccaggaagacaactgcaagtttaacattattgatggttacctagagaattccaaggtcgcctgagataagtgtggaaccccgtctcaaataatataaataaatagtgttaacactattgtcaatactccagtagaaactatagtagtttcagcatgtttttattgaggtagacttcacatattgtacaactattttaataaatatttaaagaataagattataaaactgttcaatgtgaatctcaattttgagaacatatatgcatacaaacaattggaaagaaatatgtgaaatgtagaaaacgctaattgctgaggactaagattgcagtggtgttctctgttcctcctatatttctgtagtctctataggtttctgtaccttccttataataaaagataaattatctgtaaaacacaactataatctctcccagtaagtgtacaatagatcaggagcatagttgtaatgccatgtttcttgtgtggcctcaaagcggtaagctatactatcattttcttttcattgattaaaaaaaaaaatctccttataggtaaatgccaaagagcttgatccaaaattcgctcatatacaagtcacttatgtgaagccgtattttgatgacaaagaactcacagaaagaaagacggagtttgaaagaaatcataatatcaacagatttgtttttgaggccccatatacattatcaggcaagaaacaaggttgcattgaagaacagtgcaagcgtcgtactatcttgaccagtgagtaggaatcaatatgttactttcatatctgtcttggtcccttctcatatacacaagtaccagctggccagcaggaccatgtgtctgaaatgtgaatcatttgttattttacaagtttatacaaacatgtccttgtaataaaccatcgttttcccatatgttactcctaattgcttagaggtgtctcataaagataattttatcctttcatcctgaagcaggaggaactagttggcacccttaggattttttctaagaaaagcatgggaaggcataaaacaagttgattctgggttttcctagaattctactgaataaattattttctaaaattggttttgtgctgcctcatccaaccttggtatgacgaggtcctggtctaattgtagctcattgggccttgtctggtccgggaagtctgctcttttctgaagagaaacggagggggaggagcagtgaatttgggggagaagggaggtggttgagaggagtgaatggagggaagtatatgagagaagataaatacaaagaattctactcattgctacgttaaaaaatggtctttgtatttcatagcttcaaactcatttccatatgtaaaaaagaggatacctataaactgtgaacagcaggtgaatttaaaaccaattgatgttgctactgatgaaatcaaagataaaactgcagagctacacaagctctgctcctctgttgacgtggacatgattcagcttcagctaaagttgcagggctgtgtctctgtgcaggtatgttggttggttgcgcaacaagctcaaaaggctgttgatgtttcttttgcttttatgagggcgcagagcaagcattaactactattgtatgttatattcttattgagagcaaaaaaaatcaatattcttttttaacataagaaataaatcacatttaatttatacgaattttgtattatatcagaagacattacaataaacttctaaggctggccatgacctgtattattacatcagaaatcattaactattttattggagtatcattttgccagattaatccccttagttaatgtttttcacacaaacttctcatgagaaaaaaaatagatctctaggctgcgggtttcttaggtattttattgtgtatctgctatcctctcagcccttgggggttttaatgaaaagggaaatgcaaacgctccttttgattacatgcttgccacactatcatttctttctcatgtgtaatttaggtcaatgctggtccattagcatatgcgagggctttcttaaatgaaagtcaagctaacaagtatccacctaaaaaagtgaatgagttgaaggacatgtttaggtaagtgttcgtcttcagatcatacctctattcttttcttctattttctgttaaaaaaaaaaaagagagaaatcaaaatattcactaagtaagggtattgtctgcatttgcagtgattatttgatctccaaattgctctttaagtaagtagtcaggaaccatatgatcggtttcatactctgaggcactaacactgctcctgtgacccaagggattaaatataccagcttactctattgctttggatattttaaatgacacaaacacaaggctatattcattacacgatttccttcattgcccggttgaccttgcagtctagcatttcagaccatgtaggaaggggtgcagtggggctacaaaggttgtacaggctttcttctagtccttgtgttgttatttccacttggactctgcagctctggagaatgcctttccttgtctgcagtgagtagctctgtaagctaaggcatcactgaatggtcaggaaaaagaaaagtctgactcatacataaatagaaatcaattacaaggcatgactaatagaataaaatagactaaggagatagatagtgacctataagctcgtttgctcctgactttaatcatttactttttctgtctgcgagtcatcatctagtccaggttgcagagtaacctgtacacattcatttaccaatatttattaatagtgtctgcctggcaggtacaaagaactctactagttgctatgatgggaatacaaaatatgtaggcaatgaggtactttgccactgtgtgtatccactcttcattgtgggcattaaacgcacaaaaaataagtgaagaaaattaacttaaacatatgaaataatgggagaaaagacttttatggcagttcctctactttgtccctagtcctaccaggccaaatactttacacacaatgctaatagccaaatagtaagcccccaaataaattgtgtttgaatgagtgacattaaatgactccattaagtttcctagggggcatatgatttgagctaggtattaaattatttttgttttgtattgagacaggatctcactatataatcttgactagcccagaacaggctatgcagaccaggttgtcctcaaattcacagagacccacctgtttctacctcctgagtgttggtattaaaggcaggcaccaggcactgagccaggttttaaaacagaccagaaaccagaagagaaagataaaaaaagaaaggttatttgaatgtatttcaaactaaggaagtgaccataaccaatagtaggggaaaaaaaaaacagaaaattccaatctttctttaagaaagtcattgtcaaagtaaattgtcaaacttatggatggtgctactttgtaagtaacttttcttcttctttgtatcttcatgttcttccacagaaaattcatacaagcatgcagcattgcacttgaactaaatgagcggctaattaaagaggatcaaattgagtaccatgaagggctaaagtcaaatttcagagacatggtaaaagaactgtctgacattatccatgagcaggcaagtgttaacatccttaaaagtaaggaccgactgcggtccctaaagtactacttaacaaaatatattggtttgaaatgtattgctctaaaatcatttcgtttatatttaattttcattagattgtaatttattttctttgtatgaatggatacatgtgtgggtgagtaggtggctatgtgttgtatatgtgctacagtgggcatgtgacacgacacctatactgtcctgtgtgtatgagtagagataaaaagaaaacatgcagaagtcagtttttccttccattgtgtgggttcctggaattgaactcaggttgttaggcttgactgcaaacatttttacctgctgagtcatttcactggcccattagcttatattttaaattgtgttcatctgatatcttcaaccatttaagttatgtactatgaatgaaacttgaggcagttacctaaaactgctgctgaagcaatgatctagaagagactaatttattctttatgctatgacatcaaagacaactagctaagcaagtctaatttgatctaatgattaacaagagtctctcggggagaatcccaaagaggtgaaaagattaacttagtagctacgttcctagataatgttaagaagctagatactgacagtagggtgtgtggtggatgcctttagtcccagcactcaggaagcagaggtaggaggatctttgtgagtttcaggccagcctgggctacacaagtccaggacatccaggctggttatagtgggaaaccctatcttgaaaaaacaaaataaataaacaaacaaagaatattaaaaaaaaaaaagaagttagatactggcactaggaaaatggctcagtgagcaatgtgcctgttgcacaaacatgaggaggatctgaattcagatacacagcccctacctgtaaccccagtgcttggagtggaatggagactggaggattcctggagctcattagtcagccagcctagccaaatccacgagttcaataagactgtctccagaaacaaagtagagcccaatagaagacacccattgtcatccttctggtatgcacccacatgaacccatgcacacacccatataaacaaatacatatattacatataagcaaataccattacagcttttttaacaaggcagtgtgatataggtgacaggctgaatcactgagtgttagtatcaactacagctaccttaggaaaacagcctgaaaaaaaaaataaatgtcaacacctgatcctagcttataggcaaattctgtgaccattaagtaattaccacttttacatagccactgatccttatagaaatcctgatcatgttcctagactatctcttgaggccctagaatttgtgtttacatatactttgcatatggattgccctgttaaccatttaaatctttttatcatgtttgtaaaagttgtggcataatgatctgctgtctcactgggggtatttgagcttatcataacaccttcttcctttccctgtgaatgaaaacatggaataaataatactttttctctctgaacaaggttacatgtagcccagactggccttaaactaaagctagttttgaattcctaatcttcgtgcctgcctctaccttccaagtgctggaattataggcatgatccaccatgctaagctccagagaacagaattggaaagctcattcttacagtctagcatggtgttacatctgtaattccagtgcttagtacactgaagtatgaggttagtgagttcaaggccaacgtggattacatatggactacatgctatatagcttgggctatataagcaagacaccatcccagggaaggaaaaaactcacaaactattcccagaaaaggagttcatttgtcttagaatctgggttttagtgattgaaggcagttgttccatgtgggagactctcacacagaagtttatcttacagtgtggcccagtgaacggtagaaagacttgtcagacaacaaaagctagctagctttcggttaaccctcctaggtctttgcatttctttggtatgctttaccttaaagagctatgggagatttcatcactgggtgtgactttgggttcacttttctaatcattgtcatctgctcactatggagaaccagggtggaccagaattaagtggttagtgaggtcaagtccagtctcttacatacccattctttttgtttgtttgtttgttgtttcttataaagggaaaatatttcattggggctggcttacaacttcaaaggtttggttcattgttgtcatcatgtttgtgtgatactgtcttagtgggacagagcttttgcttgtgtgtcagaatctacacatacatggggtcacgaattgttcatccaaagtcctgactttttgcaaagccttcccaagaaatagacaaaggatttgtgctacagggtatctaatttgaacccgaagctccccaattcagcaagactagctggccagtgaggcctagggatcctcctatccctaactcctcaatgctagggtaccaccatgccgagctttttctgtgagtactggggatctgaacttaggtcctcatgcttgagcaaatccttccagtcctcagaactcatgctattaagacaacctttgatatagaaagaggatgggaaaccaaaggtattcagcagacgttcagggcaaaaatttcctttatcaagttctgtagctggaaccttgaagacttgaggggctttcagtgttctttgtcttctttttgccacctttactagcctattaggtctgaatgtaaatagcaagacatttgttgatgctaggcagggacttttctgcttccatcactgcatctcgacctcaccccttagcacaacagcaaaagcaccatcactctcctgaggcatgtcctattagtaaatggtgtacatagcttgtttctttgaagccgtctgcttgatgaatctcatttctcataatacatgggggaaaacagtaacaatgactctttcacagaagataaaaaacaattgcacatgctgttttgagcccgtgtatactgtctgacagttacttcatttgcatgcagctgcattgcctagtcttgaattctaaagtattcaaattcaaggcaaattattcagtttattaccactatatgatcaagatatttagaatggtcattttgtcaggtttttccactaaaagcatgaatttttcaaatcaggtggctacttcccacctgcttatatcaattactttgttaaactattggtatttttcttagctgaagaccaatattttaggcccttgatatgagctaacattagctaaccaagaaaactttttgtttctatgtgttgcatgtttatgtaaaccattaactttatagtgaattttataaatgaattaatatattccataagatattagagtaaaagaacataaaaacagccatatctgttgaaattgatcatgctaccacaaaatagacaaagtgtatttgagtatatactgaaataagaactgttctattgagcccagtacttgatttcttcaaaaaagaaattgccttaatatttcttggcagttttcaatatattttttatagtacaccaaagtgtaaaataagtttttatacctattatttggtaaaagttaaagtaagtatactttaacttttgttttccttaattttgtgaccataaaacttttttaaagaataatttaagattattaattgtagatttcttatttaggtggagttggtggtagccactgtaggatctggtaggtttttcaacacagcctcaatggacaccccatttgtttgtcacatctgacagacatgaataattgattcgtcatcagttaaatctgtagcatgcttttagattagtgtcatgagttaagatttttgtaagatcaaattcctctaagatctttttaagcctattatttataacaacacaaatgataggacacagtactgtcatttgtaggccaaggcttaatactaaaccttcaaagccaacttgaaaacctaatgtcctagtttgcatactgttactatgtctgactaaaagcaacacggggcacaaagggattatttggcccacacatacctctcacagtccattatgtagggaattcaggagaggaatcatgagctgcttactgatgcgttccccatggcttgctcagcctactttaatatatactaggttcacttgcacaggctggtactgtccacagtgggctggatcctccttctacatcaatcattaaaggccagtctgatgaggacattttctcagttgagtttccctcttcttagatgactgtagcttgtattcagttaaaaagaacaaaagaacacacatgatatgcactcactgataagtagatattagcccagaagctcagaatccttcttagaagggggaacaaaatacccatggaaggagttatagagacaaagtttggagctaagacagaaggaaagaccatccagagactgccccaccgggggatctatcccataaacaaccaccaaacccagacactattgcagatgccaacaagattttgctgacaggaccctgttattgctgtcgcctgtgaagctatgccagtgcctggcaaatacagaagtggatgctcacagtcatctattggatggaacacagggtccccaatggaggagctagagaaaggacccaaggagctgaaggggtctgcaaccctataggagaaacaacaatatgaactaagcagtaccccccagagctcatgtctctagctgcatatgtagcagaggatggcctagttcaccatcaatgggaggagaggcccttggtcttgtgaagattctatgccccagtataggggaatgccagggccaggaagtgggagtggatgggttgtggagcagggggaaaggggagggtataggggattttcagagaggaaactaggaaaggggatagcatttgaaatgtaaatgaagaaagcatctattaaaaaataaaaaaattaaatgtattttatacatcaaacataaaaaaaatgaacaaaaaagaaacagcccacccaatatattttagatttgtttccatttgtgtgtatatgtatgcatgtatctgttatgtggtggagggagggatgtgtgtgtgtgtgtgtgtgtgtgtgtgtgtctgcctcatgtatacagtgtggaggcaaggaaaaaagggtgtcagatcctgtggaactggagttagaagcaatgtgagcctcccaatgagagtactggtcaggtcctttgaaaaagcaggaagtgctcttaaccactgagcatctttccagctttgaaaactcaatattagaaagccaaatcaaacccaaaaaaaaaaaaggcttaagacctgaactaagactcaaagagagggaatataatatgtatactattcttttcctttgtctatttcatttaagcgtaaaacctttgttgctttggcttttgaccaccttaactggctaatttttaaaatatgcataccaacatgaatgtataccttcatatacatgttgaaatataatattcacattttgtatttcatttgtttatatagattagtttgtataatcatatttcaaataggcacttttgattcctaccttcatttagtattattccaagtctgcagggaaggagcactggaaaagtgcctgagtgattctgagaataactctgttagaaggtacatggatgatccattactcttatcaaagcttttgtggtgacaagttaaaagagaattcaaagatcagatcctgtctcttttaattgaattttgcatttcctgaccttttgtttttcctaatgagtaaccagatcttttctgcttttttgatacgctgcctttgtaactcagctgtgaagactaaagccggtaatgttattctttgctctttctgcttttcgtcattttaaatagcccagtgtcagtgataaattcaaatatgcctgtaattttatatacacagtcccctttttggcactaatagtttcagttggtgataattgtgtgggttttgcttttgttctttgtttcagatactacaagaagacacaatgcattctccctggatgaacaacacattacatgtattttgtgcaattagtggtacatcaagtaacagaggttatggttccccaagatacgcggaagtatgaagagatttggaaggaaatggcaatgagactgacctttctcaggaatatttggagctgtgcaactgttagcatttagagatttgatatgtgtggagtgttgcctcctgacaccaaaatcgtcatgctttcatacagggtgcttgtatctgtaaatatttaagcaactcgaaagtgcctgaaaaattgcagcactgtgcttgctttgtactttttttaggtaaatctatatgctgaaaagtagagctcaaaaccattcgttcaatttgcttagttaccacttactaataatgagaatatgtaaaattgtataatggaacccaataaaaggtaacaaacttatttgt

SEQ ID NO: 392 - DNA, 14259 bp, mus musculus
gtggtaggagtcacgtggttgcgttttatataacgcttcgctgagacaagacagttattaggcagcgcggggcagccggcatggagctcgggaggcgaggcagactcgcgcgcgcggcgatcccgccttctcgctcgcgcagcccgctcccagccgccgctctttcctgctagttccctgttcctagacgcctctcctcactccaacctccgcagttccttctctcaatggattcccttcagaccgcacagatggtgagcttgtccgccgagctcggcagcaacaacttggagctggcggagccggaggagccggggacatcagcggccgcagggcagtcagccgcccacccggaggaggtgacacccgagggctcccaagctctcggggctcaagagcccgagcaaagcctgcctctggcggtcccgacaccgctggagtgcaaagtcctgctcacgcaggcggatgccttggcatctgaggggcaccttcgggaagccctcgaggtgtaccgacagctctccgagaggcagcagctcgtagcggagcagctggagcagctagtgcgctgcttggccgacagtgtcccgcaagaggagctggcctccgactcgagcggcacttcgagctgctgcgccgcggcgctgaaagaggcaggggaggccgcggccgtggcccccgaggtatgggatggctttaagtgcaagaagtgtcacgggtttctctcagacccggtgtccctgtggtgcggccacaccttttgtaaactgtgcctggagcgcgggcgagccgccgatcggcgctgcgctctgtgcggggtcaagctctccgctctgatggcggccagtgggagggcacgcgggccgcggcgcgcggggcagccggcgcccctgcaactgcgagttaacgtggtactcagcggcctcctgggcaagttgttcccgggccccgcgcgggcgtcgcaactccggcacgagggcaaccggctgttccgcgagcaccaggtggaggcagctctgctcaagtacaacgaggctgttcgtctaggtgagtcccccccaccccccatgcgccgccacaggggccgtgcgggcttgctcgccacgcgaggggggcgggggagcgatccctgctgggaggcgggggcggggggacggaccggactgatttggtttcgcgcgcgcgcgcgcgcgcgcgggctggggggtggggtggcgagggaagagcccgtggcccacgaggaggagggagggggcattgcaaggagtttgtcttccctactttagcttttttttaaaagctgtgtctcagtcttctgattggtcctatagctttttttttcttttctcgtgctctttccctctctcctgcttgctttcctgctcctatacctcctggttccagtttcttagtttatcccgttcgtctcttttttgcgcattttttttctcagttttgtcgctgtttcggtcttgctcagtgtcactgtctctagttcacggtctttcctggacactttggagctcgctcttacacctgccggtacctcccctatcagcagaagaacttggcactattttccaaactcccgcgcggtcctcctggcttttaccaaccggaggtggcttgcgggcgcctgagtccgtggctcccgcctctgggagttgtcccttccggggccgaggctccctgtggggtgggtcccgcctggaattaggtcaggagagcactggttgcataaggccctcgagccagcccgggccggcggcccctcccccgcgcgggcgggcgggcaggcaagcgggcgggcgggcgggcggggattgtgtaacgctgaggtaactgaagtgggccacgctcgcctcagaaaccatcccgcgagcgtgtgcggggggcggagggggggggggctcgctccccgctgccctgtgactcattgtcaccgtttcctatcacacgattccttggctgaaatagatgcacttgccccgccccctccacccgctgcagttagacagccagttccccgacatcgaaccctttgacccctctaacccaatgaatggcaggactaggcaactgctcgggatcccccccccccaaggcaacaagggactgatcacaaaggggccatgcctctgtttaacctgctccaagagttgcccaagagagtgggctttgtagcttcaagggcaacccgggcagtcccacatctctgctggactggagtaccagagttttcccagggacctgtttgcaccttctgcctcctcccactccaacccaggaagtggccttggaaccaccagctgatgccagccagcacctaggcaggcaggcaaggcagggcgatgtgtccaaccaaacgtgctggtgtggagggagttggctaagcagaaggggctgtagggtcctaggacctcctaggcaatctctggtggatagaggagggatgggatggagtctccccacatttcagtcccacccaagccagcaacaggtaatgcagaagggagcaaaaccagtggctatgagaactggggaacacagatatcctcacaacacataccctgcttgtgtctaaacaaagcaggctgtgagctgccaatgggctagtgggtgtgtgattcagagaagtgtcagagagtactgtaaactctatgctaaaatcaagagcaagtaatgggcacccaggtcagcccagagcatacatccttcaggggatggcatagaggcagacatcaaagcctgtttctggcagcagaagctgtagcctagagcttgtgaaagggcgaagccatatgaatgaaagaggtaggggccacttaagtatggaattctaaggggggctggatactttcatccacgggctagccaggaagcctcttcccaccttcctctttgtcactgctatcacttccccaggaagactctttcctgtacctttgttaataatctccttggagcagtcagggtaaaaaaaaaaaaaagtcaataccatccatcttcaccattctaaggggaaatgggccccttccacggactatatttatcctggaactggctaatgttctattattctaaaagctgtacccacactcagtaaaaggaactttcctctacccaagcctcaaaacttgaacattaaccagcagtgactcgaaccagctgtgtgacctatcacttcacctcattggccttagttttcctatctgaagaatgggtgggttgaagacctactcaggcctggattctagtgattcagtgatggtgacaataagactcctaaaagttgtgtcaagaaggtactttctcattttgccatcactaggaggatggaccttgtaaatgcatagctgtttctccaggaaaggtttataccataagcactgaccattagggagagagggaggttttttgtctttgttgttgttttgtttgttttctttttgttttttgggttttttgttttgttttggggtttttggggagtttttttgttgtttgtttgtttgttttttgttttggtttggatttttttgttttgtttttcgagactggggttctccctggctgtcctggaactcactctgtagaccaggctggcctctaactgagaaatcctcctgcctctgcctcccaggtgctgggattaaaggtgtgtgccaccatgcccggcttgggggaggtattggtatgctggagttattgttaggctacaggtcatccctactagatgactagcatggacttgccttgcttggggtcaaggtatgggtcccaattggcttcctctctctctctcttccctggcctcattctttttggatggtggctcatttagaagccaggttgttgggcactagcagtgtgcatctgcagaacagtgccagggtttcctctaggtgaaaatttctaatgtattgtggacacttcacctcttaggaactgcttgaaaaaggagggcaacattactgctttgcatggacaagctatggtgttggtcaggacaatattaggactggaaatgacacttaactctttgggtttagtagaaagagcttacataacttttctttcctcaagctccatcctcatacaggatttatcatgtgcttctgctgggggccattaataagggcttttttttctcatttcggcagctccaaacgaccatttgctttatagcaatcggtcccaaatttatttcaccttggagtctcatgaggatgcactgcatgatgcagaaatagcatgtaaactacggccaatgggttttaaggtgagtgtgggacaagagggatggaaaggggctatgctatagagagactggcaagaagggctgtctccctggggcagaagatgctagagcttctgcagaataggggagaaaactttctaatgagctggacagtgcagggcatcccttgataaagggaggtctaagtctgcaagggatctcaataaatctacattcagttgataaccttcaggatagccttgtctttattttttttttcaaatatggaatcagtagtacaacctgacttcatgtctcagctcttctacttttcttaactgtacagccttggggagattacttcattttggtgccctcacctataacatgcttatatccaaagcatccttctaaataggactgttgtggagattatataaggtcacgtaggggagatgcttggaacaatgcatgtagcattatataagcatttgctaccaccaccaccaccaccaccaccaccatcactcatacatttttagggataatagggagaggaatataagaaagatattcctgctctgatccttcaggataactactgatagccatgctttttgaaagctcaaacagcttttgggtttttaaagcgagatcttcatatttgcacaatggctgtgccattttgaatcattaatacagtcatttgacatgccagtataccccccaatctaagtcacatgggagaggtgggaagaaagacagagtagacatcaagagaggggaatacctgaatacaaagcatcactttctatgtctctgcctggcatcaggaccaatctcctccacatacctgtagactgtttagtagaattgggtctgtttatgaatctttgcaaagtgtgaccacgggaaagtggctacattctctgaaactcaagcacccttacttgttaaatgatgctattgctgtctgccatgattgtttcacaggtatgtataaggatcaacagtgagaatgacaactagaacatcctgcaagctgtaaccattataggttcttgtacaacccaaggtagcaaaagcagtgtctccaagaccagggccactgtgatttatctgaatctcatggggtcaggtgtcctcaggtgtcctctgaatccagaatgttctgatggtagaaagaccatggattaggcaatacctctaataatcttcaggcaacccccctatgtgtctaattaaacacactgcagcaatttacatgcaaaatcacactgaatagtataaatactatacaacagtttataacagtttcgttcagatgttggtgcctagtgatgatgttaaacctatgaaaatattggataatcagaagttttacatatctaggaacttccgataaggccttgtgaagttgggtgtggtggcatgaccctgcattgggattccaggaggatcatggttgagctcagcctggactattacagtgagcccttctgggggaaaaaccttacatgtggactggtaaactttgtctatactattagagtgaatcacattggtctgtaatgagagttttcatggacgtgattgaccagtgtgttttctttcccaagaaacatatttacagctcaatacaagtctccaataccttaagttgccactgaaatgggctaacatgtgagttaggtagctgtcttgggataagaggggcttgcagccatttccactggaaaactaaatctggataccatgatgggaagagcactgagacttatgttctagatgcagtgagaaaagggatttccaccatgaaggaggaattggtgcaagtacttggcaggggtgccatttccctatagctgggaaaaaagggaaagggagcattcagaggactctgctggcttgggggctgaaagcttctaatgcatatacctccatactctgagttttgtatttcccaccatttctatatgagatgccataagggagccagtccggtaggcagcccaatttcatctagggcttaatgtcatcaccgcaccttgctggtagtataggtgtcagtggggtaagctggccaccctgagaaagtgaggcatgtgagttgctactctgttgattaccgggaccccagaggcctctccagttttccaggacttagcaccctatagctgttctggagcatagtgctagcctttctcccgaaggccactgttggcagaaataacaagggagtgtggcagccaagattaggctcgagaaagaagcaagggtgtggaaagaggtccccaagaggtttgtggctgtggctcctagccaagtcctgacaccatgcagacacatgttagaagaggaggtagaggtagacttcctctgaggcttcccagttgtttgttgtactttggtcaagttctctctctctggatctccctttggttgtctttgaaatgggatttaaaatagtttaccattaggacagagatgaaaatctaagtctttagacaagactctgcctgatagtgactgctcagtaggtactcagcgattgctgttaattgtagctacattaagaaggtgaataagatgggactgactgctactgttttcttccaggcacacttcagaaaagcacaagctttagccactctaggcaaggtgaaagaagcactcaaagaatttctctactgcgtatcccttgatggaaagaacaagagcgccagatctgaagctcaaagggtgagttgagtgacctagggttaggtgtctagtagacccccgtcactctgtcttctttagggagaaggatgaagatgctaccctcctcagtatttgtggtcctgagtgggtgcttctctgggtttaaggggcatgagagagatgccaactgattgcccagaagccccatcattgtggtatgtactatcaaattggcaggtttttttttaggagtcagtaatgaatgctttgactcagaatcagtaggatataaaacaaaactaaaccaagtaagctaacctggagatgaaggctcactgaagagtatctttgtggatgagggcctgatagtgggagctgcttagaactgtataacttttctttggctgaatcacacgtttcgctagccacacatgaaggacagctcctgggaagggtcactgatgtctccatgttgcttgccacatacagaacttaaaccttcaactcttctgctagaaaattaaacctactatctcgcaaatgcaagtcagagatcattatgaaagaatataattagcccttctaactcttcgctttcaggagattgtgattgtaaaacaaatatcatgagaaatgccaggaacttgattaaaaggtcaagcatcttcattggatgggctttgacttttattgctttttgtacatttattcttctggtgtctgaataattggcctgaaagttggatgctgacactcagtgattgtttttggtttcctgccgccatactctcattcaacaccaggccacaagcccttctatccaccaccaccctttgtaatgctttggctggggaggggtggaaaaaagtaggcaagagacaggatttgtctctgaagactctagaagggaatatttagcaaaactaataaagttgacagaggctggactctagcaagaaatttcctgtctggaaaaaaaatgacctgatttgtgtgtgtgtgtgtgtggggggggtaagattttattgaaaggggtgtggatcaagcagaattattagccatgggcctttcttaaaacttaagtgtagtcagtccatagtataacattagctgagcattccacttagttcccataactcactgttatttctctagatgagaaatctgaggctcagtgactttcttgaggccacctgcttctttgcttttattttgccttcaggtggccccagaggttctggtatcatcagttgaactaacctcactccagtttgcttttatagataggctgttgtcatttctatacctgcctgatgaaaggcacggcattgtgtgaaactctggagacccaaggaagcctaagtgcctattggaacttacaagctttttttttctttttttttttctttttttggttaagatgaatgccaggcaatacaagtgaatgtgtacttacaagaagtattataaaattctgaaattaatgtaacaatttggaggcaaatttctgctgaatgtgatgaagctatagcagccatttaaacatactgagaggcttcgactgtgtgtattcactggattattctagttttagggctaaacatttgaaaactagtccacatgcactgggtattaataagccttctcataacccacagccctgtgatttattttaaactacagattttctttcttaacccagttgggcctttctatggctaaagttagagcagaattgacttttcattcatatggaatgattattctcactgaaagttgaccctaacttttgttttccaaagacattgaaaaggcctacagagagatcttaggcagtaaagctaagaagagaactgctatgttatttctgccttgtttcctttgattttggctcctggccgccttttcttcatattaccttgtgtcttttcgaccttgttcttgggtgctatatggccccctccaggtagactgtctcagaagtggatatattctttttggtccttgagtaggatttctgataatcagttcaattcctggggagtgttgtgcactaaatgattatatgtatgaccctgggcactaggtgtgtcttccaacctttgtcagtttatatctggaaaatagggttttagcactgcaaggggacataaacatctcattgaggatgagaggcacctgagttctaggcttcttcttgatcccttggatgtataaatgccaacatcatttccatgaatatgttgtatatttgctaagcacttatcgctggctggagagaaagacttattctgtgacacacttctcgtgcaaagtaagatggtatagtttaaggtttggtattctcttctatagaggcaggaaaaggcagatgacatcagagagatgggagtactggggcaaggcagcacttgagcagaacttggaatactgagtagggcttggatgtatggaaagtgctgatagatacagaaaggagcatcatgaagaaacctcagaggacaagcagaagagtaaacccacctttgaatttagcattcttgcaaagtctcttgataaatgaacacttcggactatggagactgaataacagtgtggggcatttttagtggctttccaaacatggcagggtcttctaagtgataaacatttgagtatgttttggaagttcagtgatctctttcttgttgtattatgcacgtacacacacaggatagatctatggatggatacatgcatgcatgcatacatacatacatacttacataaaatccctaacccctaatggcttaggggagagtggaaacaagaatgtaaatagctaatggtgtaacctgcacccaaatgcttatctctgacccctagacccttttgttctctcttctcccttgccagtgtatccaattgcaagggaacctgcctgaccctaggtacttgaacttaaaatctagaaatctctgaagagatgactgggatgaggaagaggctagaagtgggagaggaagtttgagctctgctttcttaacacttcattgctcagatccccaaccctgaaggaattaaaggtccaggggtgacaatgtggacaaggagagcaaaatggaaaaacagaaaagcagcagcaaacaatgtagattggttgacttctcagcccatcgagttgttacggatttgactctgtattcttcctagtttgcttttcctttgctgtgataaacaccattaccaaaagcaacttgggaaacagagttaattttccttacacatcccaggtcacagtctatcactgattgaagtcagggcaggaactcaaagcaggagcctggagacaggaactcaaacagaggaatctgcttactggcttgtgtctcagcatcacaatcagtcacctttcttgtacacactggcaccacctgcccagggttggcacgacccacactgtgctggtacttcctacattaatcattaatcaagaaaatacccaaacatatttgcctacaggccaatctgatacagacattttcttatgtaccctttcctcaggatgacctagtttaaaaaaaaaaaacacctaatacatgaggtatctattctgacttcacctctatgtttccttcaattaagatagattttaaagccccattgcagacatttctgcagaatggtggcaccatcgaggtgactatgaataatgtaggcatctgtcatgccttctcaaaaccctgattcctggctcatacttcagacctggggagattgaagctggacccatggacctgacactttcataagctcctgggtgattctttttgaaaaagatgtattttactttttcaatatgtgtatatgtttgagtctgtgtattgggtgtctgtacatgaggactggtacccctggccatcagaggtttcagatatgctggagctggaatgacaggtggatgtgaggcactctacatgtgtgctgggaatcaaactcggctcctctgcgagaacagtatgtgctcttaatgactaagcaatctttctttccccctgttcctaaatgagtctgtgtgtttatgcaacaacctctccttagtgtgtctagggacatggctccaaggcttcctcattagagttttgccttgcaagctgtgctctctggttccccatccctccccctgcaccttagtctagcacctgtagaaacttgagtagtgaagtcttctgttttatgtcacagcttctctttagtttcttttcaccatcagtcccgggggagtctcaggaacattctcccgatatcctgaagctgttggcacctcaccctagattaaaggaacacgtagagtcaatggctactgaaggcaccagccataatctaccaaagttgtcacaggtaaaactcaactcacccagctcgctcatgatgcttcatttggctcttttgtgggcacacgacaagtgagccctacctctcctactttggttcctgagggaaaaagaaagatggagttgataatggctgtgtcctttgcttaaaaactacaactgggaatttcaggcatggtccaaaagtttatgaatttattatatttgtagtcttggtcagattgagaaaatagagaaatttgatagaaatataaagagattggcccacttcccctaaagccctataactggggtgtgcttattgactctgtcttggtccaatccggaaaatagatttgatacaactataaagagattggcctacttctgaaagcctttaactgggactttagctttggggaagatgctgatggcctttgagtaccagtgagatccttgtgcaacgttgattccatttggggaccaaatggagagaatttcttgctcttgcactataccttacacgtaagtaggcttcttatgcacatctatagcaaagtagagcacgagagctgagttgagaaggatgacaaaaaaaaaggaacagagagatgggcttcaggtgctggcctttctagcacagggtaagtgggcagaagttggggttcagaagaccagacttgaagcaaagtttaacactgaatacctgggcacctttggggagttgtttcttctccatttgtgcctgaagttcctcacttgtatctaagccctggatgttcacatcttcccagtctctgcccctgctctagagaaggaatagaatgcaaggtagctgacttttcttggtgatggcagaactcagaatatctcttgaaatcagagagcccccagtggtcattagtacaggactaagacagcgaacactagaccagaggacctggagtggggacttctacttgcaactcagtctgaaatgaaggaaatagaacctctgcctttccactgtgagcagaccaggcaacagcgaatgcatttccaccaaaactttgcttggcaaggccttgtcctgtgtggacagtactctgggctcacagaaaatcaaaactgtagtattggggattttttttttaagttcttgaaaccatctgaacacccagggatacaggctaagaaacatcgcatcctttcctctgctcttcgttgtttcctctcacctgtgtccactgcgacttttggcagggcttagaggggaaacaaccttttgctgtcaaatatggatgtgggttatagagaaggttctccagagcaatgggaataaacacattttcgggattattttaggttgcattttcaaatatccttttcctagatgaaattctgtaaaagcttagagacagactattagaccaaattatttttgtcttctctttagacttttcacagaaaatggagcaaacagactaaataatctttttatgaaaaataaaaaaaccatatagctctggagcatgagttacttcggcaggcttgtacagagctggcctaaagtcctctgaaagatgtctatgaatgacagtcagggtgaggggaagtaaccagtaacaggatatcccctcactgagtgctttgccttccttacagaccactggggaatgctttggctaggagggaagagtgatgcttcccttgtagttcccccttcacccctgctcagccaacttgtccttccatgtgcctgttgtccttgtttagagaagttctcctaactctactgaagctaggcatgtctttgacatagataagatgtcaccgataagcctcaaggctgtccctccgttgagttgcgtagccactgtgtattcaggagtgaggatcagagctatgtttctctttgtcccctcagggtaagactattggaggaccaatcttggtcccaagcagcttctgatctctgggtttttgcttcacctaggagaatctggagcttccccattgttctaatcaggagggagcagcagctgcagaagagagcagcagcctagcaaattccgctcaaggaaaggtgagtagtaaagaagacagaaagaaagatcaggaaggagaggaccgggatgctgcctccgtcaggaccggcaaatgccaggaaaagaagagaaatcgttgccaaatcgaaacccaagaagacacagaattgcctaataaagtctccaaacaaggtactaattctacccaggaagaaagtatcataatgcagatgactgggctcgctgacctatgtagttacactctctggggacccctctagttcagagtatatggcctagctctggcatttaccaactatgaaatcccaggggttgctgtgacggttctttgagagtgtattggtaactatcatactgaaagtactatgtgatataatgtgatatagctctgttatagtgtaatatagatcatccatagtcaggacatctggtcaagcacccgatcaatcaagggatgacatctcatgcttttccatcatgtcactttcctccaggataaccacttcctgcctcatcccagttgtgggaatgtaggatggcagaggtgtgctcaggtctcgttcggttgtgccctgagaagcagcagctacagcttcatatctttccaagagaggttggcagtgccaagactgatctcagctttgaagacctggctcagtccagggagttaccaccaccgctgctgctgctgctgctgtgcctactgaatttgaatgaccttagccaggagctcctagtcttggacttctctgtctatgggccctgctaaaatgcctctgggagcgcacttcagggaaccctactggcaattgctcaggcagccactaaattaaactctgggggagattgagattgaaaaccagaaagacatttttcccccagaagtattgtctgtaaaaataaaacgagttgctcc

SEQ ID NO: 393 - DNA, 14259 bp, mus musculus; identical to SEQ ID NO: 392

SEQ ID NO: 394 - DNA, 436 bp, mus musculus
gcgccactgttcgctgggagggcggaggaagcggactgttccggagctctgcctagccgggcccaacctttgctccagagatcatggctgccgaggatgtggtggcgactggcgccgacccgagcgagctagagggcggcgggctgctgcacgagattttcacgtctcctctcaacctgctcctcctgggcctctgcatcttcctgctctacaagatcgttcgcggggaccagcccggtgccagtggcgacaacgacgacgacgaaccacccccgctgccccgcctcaagcggcgcgacttcacccctgccgagctgaggcgtttcgatggcgtccaggacccgcgcattctcatggccatcaacggcaaggtgttcgacgtgaccaaaggccgcaagttctacgggcctggtacggaggcagggccagggggtcg

SEQ ID NO: 395 - DNA, 17852 bp, mus musculus
gctaggggtgtgtcttaaggtttctattgctgtgataaaacaccatgaccaaaaccaactttggggggaaaggttttattttattttatagcttgtagttcatcattcaaggatgcagaaatctggaggcaggaactgaagcaaaggtcatgaaggaacactacttactagcttgctccctatggcttgcacagcttgctttcttttagcatccagggctaccagcccagggaggccccatcccacagtgagcttagtcctctgacatcaatcaagaatagagaaaataccccacagtttactcataagccaatctggcaggggcattttctcaatcgaggtttcatcttcccaaatgactctagcttatatcaagttcacctaaaactagacataacagggaagaattggaggggaaggaatggaggtgaactggattaaaatacattacatgcatacatgaaattctaaaccaacttaagaaccagctcagcaccttcacagtttcatcctctgacttaaaattgataaatctacatatagagaactccaggctgtatttagtgtgttgaaggtgaggagcaactgtctgaaatgctaatacttcactctacttggaagattctttatggttagtcacagcatgacacaagaccctcactgttgtgattccagcatgaagggaaagtactttccaacggctgctttcaagctgttgccatgggcaccaattttaattatctgggacaaattatgtgacccagcctaccccccacccaccctccgactgccccataaggaaataggcatggtcaaacaagagctcaagaaacacttttagatttaattaaggtgcctaatataaagttaacttagagttaatccactgggaaattatctggagtgagcctgacccagcgaagtgaatgaatcatacctctttgaaaagggaattggatactcgaaattatctttatgagaaccaaacactatgtacccaaggtacatataccaataaaacaagcaagtttagaggaaagacaactgttctcttttcctggccttaaagaagcaagcttccaagagttctacagatgctaataaccatcgaagggtgaaaagaactgctttgtacttagtacaactcaccatctgccatactatatctgtctctcatttgtgaattgtctgattcactctgttccctaatccctatgggtagtgattttcatgtgttttgttcattgacaaatcccttagtgctttaagcagcgactattacataataagtagtaataaatatttgtcgcatgaagaagtacatgaattcgatttattgaattttgtatgttctctataaccaaatccccctcactattaatattcctttacccatatccatcagaaattgataccctttcattgaaataatatattgactctatacttttgtcttgtgatgttttcctggggagatgttaataaatgtctattcatcccatatgtggcatatataacaggccaaagaaataattatatccaagtgcagctaggtgaactgatgaatttattgggctctctcaaagttacttatagacatgttaatgacctaaaaggagctacatcataaaaaagccccccaaactgcataaacagaatctccacttcagttaaccttccttctcctatatcctctagctcctcctaagattatgtgaggcaaaattacatatacttggtatgcaggtggaagtcagtggctgaaattccaggtaaaggtttaatgatcctttccactttcctttgatgagggaatgttaataggtctgatcatgtaactgtctcattcgggtagccacattctctctgattattgtggtaatggctatggcatttccagaggatggtgttccacgatgctccaccccttactctatcttgtgtattctttccacttcctgtactgccaagtttcctgagcctcagtggaagtgatatagatatcttgttattttgttccatttatggatgggtgctaggccatcatgcctgcatagcaatgtctctttattctaagcagcctgatcaattttgtctctgcgataactactactattgttgatctctgattaagaccaacagtagcaatgatctatgggtgaaaacctaaatgttgagaaggcgctttggaagctatctattcatttaacaacagcagtatcttccccattaggcccatgacctttctaaccacaagtttttgggttacagcaccaaatgtggattccttccttgtgaagcatgcagttgtatctgtaagttttgccactttcgcaccatataaagcacatcattcctagcatgcatacagtgtggtatataggtccaaaccaagtagcactgtcagtgacctgcactaggaatgcttaagcagggaatgatctagttcagtcccagattgagactccacgtcttgaaaacaaaacatgcagcgtcttcagcaatagggtcatactgtgcagttccagaatagggttagcagcagtggcaatagtttatattgaattgggtgaggagaggcttcagatgcatcccatcccaggcaactctaaggtaattagcctatgaacagaaatgaggatttctgttcaataattgttttagttgcttctctgttgctgtgataaaacctatgaccaaaagcaccttgaggacgaaagagtttattttggcttatagttttagaggaataagagtccactgtggtgggaaggcatagcaacaagcagcagatattacagcagaatgtgagagatcacatcttcaatttcaaatatgaagcagagacagtgaactgaaaggagggaaaggctatgaagtctcaaattctgccttcaatgacatactttccccagcaaagctacatgcatgacctctccaaacagaaacatcaggtgaagacagtattcaaatttctgagctaatggggaacacttcttattcagaccaccacaataatcatgttttctgggaatgtctttttctacccatgcagagtacctacattcaaattctttaactattgttttaatattgacaggcacaggctgtcttagaatttaaaaaagcctgaaacaatccaataacttttatcagctgccccccaccccccaaaaatagatagtatggtttgggctggaggaactcctgtatttaaacctctacaatggggcactgccatggtgttgacatgaatcttcccatgttagataggctcagaggggcaaggtagtttttctctgttcatcctagggctaaggggcatcagagccacacactcccctgctgtacctgcttaatggttctagttggctcctcatatctgatagccacctggatgcttcttgtcacttcctcttcattgacctcagctagcttctgaaagagccacagtctgggtgaataatctctactcccatgggagaaatgtacacagtgtacatttatccatccttagaaaaactcaaaccttttaaccaacattgctctattttaatatccatccattgctaccctttctccctgatgctcttgggggagtcaccagaaactaagacacacttggctccatcatctacctgaaaccaaatatactgcatattaagaaggaaccaattaatctgcaattcaggttatacctgtggttgatctacataatcctcacctgcagacaactgtggccaccctattagggatgctgctaaggtggttcccacttcccaaatgtctttcttctacagtaactggtatctccctgttattccctcctttggggaaggtttgccttcaggtatcaaggcattccagaaggttggaagctcgttatttgatactctataaattatttgcctaggaacctgacttgatataaatcttgctacatttgttgtcaagtgacctagacaggccactttatctaccttctagtctcctctcctctggattgatttagcacattatacaccaaatttacatagtgagataagtcattcagatcttctagaccatctagtacctcaataatggtcatgatccacaatgaggctcatcagcaccaccaaagccccataccaacctagatgtttcttttgaatctgttatcatggtgaggagcatgacagcatgcaggcagacatggtgctgagaagtagctcagagttctacatctgggtcttcaggcagcaggaagagagagccattgagtctggattgggtttttgaaacctcaaaacccacctctagtgatacacttccttcaacaaagcgatgtctactaatcctttcaagtaatgccacttcctaagcatttgaatatatgtacctatggtggccatccttattcaaatgaccacaatgattcctgaagggattgcagcatattctgtggtgtgtcagccattttcaatatatcctcatataattgacagaccatattcatccaggaagttcactcccctaaaaaagaggaatgtataagaaatgtttaagatgtaaaatgtataagaaaatggctttactggaatttccctttcagtctttccaccctggctttccttctgggcagacatcttgatgtcagttacatgtcttttcactcacagtaggaacaatactaccatagcaaagaggcacatcattccaatatgacaaggtcaggggaagacatacaggaattgcacccatagtttagttccagttgcatatcgtagttcctaaagcagaaacagtccaacttctccttccaaaatcatccttggttctgttgtgttcctgtttgggaacttaatgttgcatgccttttcctggggatttgagaaaaagtgttgaaaatgatataacaaaagattgctgagcccccccccaaaaaaaaaactgatgggatttggaatattagaacctgaaagttatcatacatgttggtttgggggctaaatggaccagagtagtaacttggcagctgtgtatacaactctgaggctttcttctttgaaaatgattacctgtaatcaggaatatacttcttatttccaagatcagttacttgtatgaatatgatatcaaattatatgcattgctttgtaaactactatctgggaaaaattagttttctatatataaacttagataacttgtcttttatattctgtagggtatattctcaaagctggttgactccaatgttgcttgcccaattaaaatagggatggagagatggctcaatggttaagaacacttactctttctcatataaaggacctggattcagttcctaagactcataaacatctgtagcttcagttttagggaattagatgccctcgcctggcctcttctggcacacagacatgcatgtaggcaaaacactgatgtacataaaataaaaattaataaattctaaaaaataaaatagttagattatattttataaaatggttgcaacaattcatacccctaactgatgtgtgtgtgtgtgtgtgtgtgtgtatgtgtgtgtgtaagctactaatagattatttttttgttagtctgatgagggaaatgatactttattacgttggtttctacttcccttttcatttacaaagttgagcacctttccccaccatgtatactaatttgtatgtctttgtgagttgccttctctttttctaatcttttgagtctttttttttttattagtttgttgttttgatcatgaagagtgactgttgatgggcttagaagggtgcaagttctctttagggggtgtgaacatgtttttagattggattacaatgtgcttgagtgtgtcccctaaatgtttacgtgtaagatatatggttagttggtgatgtacaaagtagtagaaactttaagaggcagggcttacattttatttttcttacatttatgtatatgtatgtgtgtcagtgtgaagatatgtgtgcatgtgttcaggtgcccagagagaccagaggcactggtactacatgcagttacatacagttatgatcttccctgtgggtgctaagagatgaactcaggtcctctggcaaagcagaagatcttcttagccacggaaccatctttctacctccttggttaggaggtttttagatcaaggtagttcttttgagatcatgagtaagtagttactatagtgctcttaaataaacagtctggtggtttgaatatatttggcccagggcactattaggtggtgtggccttgttggagtaggtgtggccttgactgaggaagtgtgtcactgtgggggtcagctttgagacccttctgctatctgtctggataccagtcttctgtttgcctttggaacatgatgtagaactcttagctcctccagaaccatgtcttcctggatgctgccctgctcccaccatgatgataatggactggacttctgaaactataagccagccccaactaaatgctttcctttacaagagttgccttgattgtggtgtctctttacagcaacagaaaccctaactgagacaaacagtaagcctggtcccatccagatctctggtttcctgtttaaatatatgatctcttctactattgtgatatgattatgattttttctttttttcttttttcaagacagggtttctctgtgtagccctggctgtcccagaactcactctgtagaccaggctggccttgaactcagaaatccactgattatgatttttttgttaagtccacacccgattccagagtatgacagattcagagctgcctgagttttggacatgagctacaaaaccctcattttgtcaaaagaagcttggctcaggcagtccattataacaatgcaaaatagactaacacgtagggatagttccttgatgctgaaaatatacaaaaaaaactttgaatttttatatcttaaaaagtaactctatgggatataaataagttatatcccagaaagcttaaaaatgtaaaatagcaacaccgaaacaagcaaacattaaaaacccttgaaaagagattttttgatgtctgcataaaattctcttttgtggactgttatattttctataatcctcccaattgtttctgattattaccagtttatttctttagaaaatgtgacaaacagggtttgggatatagctcagtggttaagagatcttgctgctctttcagaggtgccagctttgattcctactacctacatggcaggtcacaaatgtctgtaacttcacttccagacatctgatggcttcttctggactctgtgggcaccaggtacacatgtgcatacacatacatgtaagcaaaacacacataaacgtaaacataataatatttcccagccctcgggatacagaggcaagtggatctctgtgagttctaggttagcctggtctacaaagggagtttcagcacagccagggttacacagagaaaccctgtctcaaaagcaagcaagcaagcaagcaaacaaacaaacaaacaaacaaaggtgacaaatagagttggccagggatttctgcctttttagaggaaacattcttacagtgacaattactgagggaaatgatgccttttaaagggagaatacgatagcttacatgaaactggttgacagagattccacattattctgaatatttggggatttttcacacgttcagaatagcacattcagcaccgcaaaaactgtttctgacctgccccgcctgactccactgacaccaagtgccactatagttgatggcagaaacattttctggtctcatcacacagctgcataaggtgtactctctttgtctccagttgtttaatggttacatcctgattgctagaaaaacaagatgagaacttaaattgccttccctggctcaaatcccctgggaatagggactaattttagtgcaatttttttgtcaaaagcagaaagcagtgcctatatggttttatctgcagcaatctgtaccacctactcttcttgctaacatatgctaaaatagtacaataataaaggtaataataatggtgtgtactattggctggtaacagaaaagagcatatcttcttggttagttgtattaaaacccaagaaagaattgtcaaacaaagagttcctgcttcctaagtgatatctaacctcatcctcaaaccaaggccatgttccattatgagacctttagatgtagctgggcaaattgattgatgaatgttgactgactgatttcaggacacaccagcaatgcttgaaagcagaggctttgtattgtcgtgtgtgtgtgtgtgtgtgtgtgtgtgtgtgtgtgtgtgtgtagaaggggagggggtttagattgattttagacagatgtgattgctcatgtctatactctcagcattctgggaacccaaggcaaaagagttgccatgaattctaggccaaccaacctgggttacagagtgagaccccatttcaaaacaacaaccaggaaaaaggagaagaacccttttatgtaagtcttaaagggactgaagaaatgagctagaggtgaaaagctgatcgaactagaacatacaatttatatgatctgtgcaagccatgtcacaggtgaatggcagcagcagagcaaaaccccaggattctttttaatttttgagaaggagtctcaccatgtagctgggcttgaacttctggtcctcctgcttgcacccctcaaatgctggattacaggtgtgtgtcaccataccttgctcatcctattatggttctagagacacaatgatgctaaaactcttccattaacaaacagaatgcggaatactttgaatttgagatcagaggagaaaaagtaagtggtatcagaaatacattatgattttggatatttggatagtttaagttagattcttgagatcaacacaaacacatttgcacaggtttttttttttttttgtattttctctaagtcacagcatcatacatagtggattttgtggtatgtaaagtataccctgataaaaccattaaatatatatctatcaatttgtctccaaatactcataatttggctatataaagttatgtgcattgagaatctgctgatatttactcatacattaagatgagtgagaacaaatacgcatgttagtcatcgtgggagttttcttggctcagagaagccactgggctctggggagattgatggagctaaaatgtcattgtcacaagggaggcaactattgatttcgctgacaaaccctgtaattatggaacacaatgcctagttacattaattagaagggagtgagagagtggagctagaggccctactgccagagagagagagagagagagagagagagagagagagagagagagagagagaaagaaagaacagattgatcttctgtaaggtgtggcaggaacttgcagtgagtggagaggcagagaggaagctgaaaaggaaattggaggctggaagcagtttgaagatctgcacaaaaaatggtctaagacagacagctttgggttgcatgtctgttccataaagtcatatgtgatataaaaattctctaaagtgtgccaagtgctataaagctaaaatgttgtaatgaaaaataccagcatatcaaaattcaaaaggaagtgagcattgatgaaaagggatagttggtggaggctagctctcctccttaccattgccgtccacttacctcacagaaacatccactatttcaatgcttcatttatccctccagagacagtccaataccctctgcacatacgaacattcacgaaattgcatttatctgtgtgcatttcgccaatgatagactgttgctcacagtgttctttaaatctctatttgtatccttttaacgatatggcttagaacagatgcttctgtgaggtaagtggacggccatggtaagcaggggagttagcctccaccaactatcccttttcatcaataccttttgacttttgatatgctggtattattcgttgcaatattttagccatatagcatttggcactctcagcatatatcaatctgcttcatgtctttaaaaattgaatatacattttgtatgtgagtactgcaatttgtttaagaaatcctctttgaagctcatttcatttgtatccatgtttatcttcttagaggtcagtaaacaggaaaactacccgtcaacacagtatcagtgtgaacattgcagatattttcttttgatgagcataccagttaattttcatttttattctagtaagcatacttgaatattttctattctcccagacattttttaaagtgtattttgatgacacagtaaagagctgtatggaaatccaagtgcaattcacttttaaagagctggtttggcctggatcgagagagccagccaggcacactgggacagaggtttcttgggattctaggtctactgagggagggactctaaagagttcgagaacaaccactcagagacagtatcagaaacagtggtaagacttcacggtctggcatcaggagacttgcagtccagcctcagttactcacttgccctggtaaatcatacccagaaagtgcaggtcttccttatgtgttatgtaagggcagagatttcaaacacataatgctgtcagttaagacagtaacacaatatgcttgatgaatgttaatagtaagcattatcctaagggacagaaacaaaaggccaaagtgcttagagcattgggtggagtaaacacactctcaagcatagatctaacctgaaaaaacagaccgtggtctaagaatcaacaagctccttctgggttaggttgttagtgttccagactgtaacgcagggcaagataactctttttgaagaaaattcctgtacttgcacagttgaagtattcatcacaaaagataggatggcaatctgtgcacagatattacacacacacaacacacacacaacacacacacacacacacaagcacgcacacacaggtgcaagcaaacagtcaatttccctttctttcttggacaatttagtcctaaagccattagataaagcagagcaaggaagccatccatggtggacagtggtgggggcaggggcaggggcaggggcaggggcaggggcaggggcaggggcaggggcaggggcaggggcagaggcaggcaactagattaaaatgtcagataacaagcagagagagaagggtgtttttgttgaaggtgtctggtaggaggagttagagtcaagctggttgatgaaggcatccctatagaatggaagtctagtgaggagactgacctgcattctcagagcctgagtaggatgaggagggcatctgtgtgggggtggtggtaatagggggagccaaagcctgagcagactggggaggaaattcacgttaggggagcagttcttataccgaatcagaggcttccatacctttaaaacttcatgtctcacttttttttcttggctgtatgatattcccctagagcattattgatttaccaggggatatactcttagagaaatctctccctctctttcccagcagctaacaattgtaaatagtgccaaagctagaaatgtggtatgtgctcaacttctttccacgctggaatttgggctggcttgagcttgtaaaggttttgtgaatgctgttgcaaatgccgtgggatcatgtgtgaaactgcccttgctctgtcagaatattctttccgtattgtcatcctccacctctggcctctggctctcacactttctgcctctcttccacaatgattcctgagcctcgggagggagtctctctctctctctctctctctctctctctcacacacacacacacacacacacacacacacactcacacacacacacacacacacacacacacacactcacacacacacacacacacacacacacacacacacacacacacacctcctttagagaagtacattcttatattctgcaccttggccagttacaggcctctgcactcatcattatctactgcaaatagaaacttctctgatgagggttgagagatgcattagtttgcaggtataatgataagatattaggagtcattttaatattatgccaatttagcagcataatcgtagtatggactcctgtaggacctatgacctatctagccataggtgctatgctcaagaatggtgccaggtgtggcttttgtcttgtggagtagtacttaaatccaattaacaattggatttctagtgcttagttactcccatgatgctcatgccactcttgcactatgggcatgtcttgccagatctgtcattcatgtagcttgaagggttcacaattggatataactgataattattttcctcccccagtagcttgtatagtgcctccagcactatataagctaaccagtatcaatgaagtttctaggtctgtaaaaccttaatttctccatgttctacgactcaagtatgtgatatcttcagcaatcaggtcatactgtcacattctggagtgaaacccacagcactggcaatagcaggtaatgtttagggatccctctacttccttttcttaaagacaaatacacatttatataattaaaataacatttataaaaatataccaatagacatgatgtatgtatgtatggtatgtgttcttactactaaaaagatacatgtccatccttttttttttttgttttatttatctgtttattagtgacaggatcttgcagtgttgctcagggtggcctcaaattcctaggctcatttgattgtcctgccccagtttcctgggtagctggaaccacaggtgcttcccactagtttacattaacatatatgtttaatgaactaaagtgaaagggacagtctatcatctagacaccactactgttgacattttggcatatagccatcccatttttggtatatgtattattttttagcctcccttaagttatatatttctttttatccaacataatgtcacttcctttaaaaaatctttttaacgatcctcttataaatagtcacagtgtttctggagctggtaatgaggatctctgatccgttttagagaagagatggtttaatgagatccttgaaaaacaaaatcatagcaaaaatggattggaaggaggaagtgtggacttacaatgataattaatgccttctgtttacttggtgaatgtaagtctagactgtatgcttttgtgtcttcattacactccccttcttttgtattttcattacactgtgttctgttctctgtaagaatttttgggttgatagggatgaaagtgttagtgtctttttgagtctggtccttggtatatagcttgccattgtgctctgtttttaatttgatagttttgctgaggtcagtatattcaactgactgtgtctagggatgacgagacattctgggaaaaaaatttttttttcaagaatcccaatttggggcactagtaaagattcttgcagtttttaaactactcaaaagtataagatgctggtgaagtgtagcatactagaatgctagactcaaaaggatcccctggttctccaccttcttaatgctacagttcctgtaatccagttctttatattgtggtgacccccaagttatttcgttgccacttcatggctgcaattttgctactgttatgaattgtagtataaacatctgatacacaggtgatcttgggcaaccatgtgaaaatgtcctttatctccaaagggtcgtgacccacaggttgagaaccatgggtatagacccatttctccttcattttacagttggagaaactgagcccagagaagttaaatgaatcactgtaggttacacggcctctgaaggcagaacctggactaaaacgtgagtctccagagttctaggccactgttatagaagacttaagaaacccttaatattaattaagtaatccttgtaaaaactcagtgaagtaggttaacgttatttgttctgactttagagccatttactgcaaagtgattaaatgtgtgtaagccagaactgattccactataattaaacatgtttttaatcactctcaaaagaacagactattaagtaggattattatttgaggaattagctttcagtttctggtccaaccagtttgaagatcacttctcacccggtatcatgggatcttttatattaggcataaagcctgtgttttcttagtaagattaagcaaatacaatgtgtttgattagctgcatcttaggactcctacaaccttctcagtaaacggatgagtgtggaggaggaagtgcctgcctatcctccagagatttatacaaagtaacatttacttattgatattctttccaaatggagactttaggccacagtgccgccttcctcctcctcctcctccccctcccccctcctccttcttcttcctccttctcttctacttcttcttctcctctttttcttatatttgtatgtgtgtgtgtgtgtgtgtgtgtgtgtgtgtatgagagagagagagagagagagagagagagagagagagagagggagagagagggagagagagagagagagacatgacaactcatgggagtggcttctctccttccactatgtgaggccatgtaaattcaggtcttcaggtttgaggcagcaggcatctttaaccgctgaaccatctcactagatttcttacttgtactcatggctacacagaataagcaagcaatgttcaataatagctaaatataatttattttggttattttgttgaaatgccatttgaaggagataggaaaaaaatccatagcaagtgtacaaattgtgagttatcttgtataatcaatgctttacaaaagtttcctaagtttacacctttgaaggcaatctactacagggtaagaagactccacactcatattcctcaagccagtcaacctgtgcccacaaactcatgacaacaggcatcctcctctatggagaacacagtagatggctgtcatagtttgggttttactgctgtgaacagacaccatgaccaaagcaacccttataaggacagcatttaattagggctggcttacaggttcagaggttcagtccattattatcaaggtaggaacatggcagcatctaggcaggcatggtgcaagaggaactgagagttctacatcttcatctgaaggctgttatcagaagactggtttccaggcagctaggatgagggtcttaaagcccacactcacagtgacacacctactccaatagggccacaccttctaatagttctattccctggtcccaacatatacaaaccatcacaattgctaatgttcttttagaaactgagttttcttcctttctacttccaccttataatatgccaaactttctttactcctttacagtgaaaagctggatgactcaggacactgcccccagaggcaaagggggaaggagaggaagatgttagggcagcagggcagacagggaggaggagggtccgtgattagctgccttctctgtacttttctcacctcagtttgcttagaaaactcttcagtcagcaaagaaaatatgttgcgcgcactcaacaggccaggaagaacgacgctgctacaggatccttctgcacacatttattcagtcctgtttcttctttctccatatatctcccttgtttatatctcccctgtttatatctcccttgtttttatatctcccttgtttatatatctcccttgtttttatatctcccttgtttttatatctcccctgtttatatatctcccccgaaccctgggcctctcactccttttatactctctctcatccacgcactgcaggccatgccccctcgccagtcacgaggcttcagctaatcagggcagcaagggcaaatctccaccaaattggattcacctgtatcctggtacacctgcgcagcactcaagatgtttgtgtcttatatgaggaagtcaggtgcaagtcatatgacttagctgcagtccctggcgcctttgggactgccgccacaccggctccccacaattcccccttttttcttttttggcagagagaatgtctgtagatagcccccagcagccatgccccttacccgtccttgggagacaaacagcattggtttgatccctgtcttaggttggtgacatgcccagggagtcttatcactgactacctctcaatcatgccaagccactcctggggagattgtgttttgcttgcggcaggtgcatcaaaaggccaggatgttgattaatctatggccagatcttaattgctgcaagcaagcctcatgggtgaaggtagaggtctgatccccagtgtgcaagcataggggccctacacaaaaccatcccttaggctcatcacccagagaggtcttggccagctcccgtgtcgtttttcctgggaaaagggaactaggacactgaaccttcatgcaatcagacatgccttccacaggatgccaacagcaagctatcctctgtgcagtgcttagcctcgcaccccacggcataacgcagcataatttcttttagagcggcaaaccgaatctgaggagattgtcccgcctccactgcagcaaaagcctacgctaccatggcgaaagtgcgggccgcacactctgcacctaacacatgtgccaaacacaaaacacacacacactataacaagcatacatcccagggctctcatccccgctcatcttccctgaagcaagggatagatggccaaaggggctatctctttaaggggaattcagggatcaaaaagcgtggaaaaatttgaatgtcatgtcgagctggtatcggcttctggaataccgaaaggatctctcatctcggctccatcgtttgtgtttgtgggatcatccaccacatccacaggggcaactggatcaggatcctcattcttgcagcgtctcaccaatctctccggcacccaaagaggttccgcctggtcctgtggaaacacacaaacagaccctctcgcccatgtcaacaccagatctggtcgatccccaggggagatggacacaatacctcgtggtaatgagaccataacctcaatcacctgtgtgttcatctggggagtcaatacgccaaatctctggacagaaggtccacctataggtggctgctgaggaggcatagggagaggacgcagaagctaattcgccttcctcctccgcctcggctcttttattttgtccttcctgaccacctgataacactgtgtctcctttctttttcctttttctttttaagcccttttcctcttccgacatactttcttgttgctctgtaaggattttctgacctgtcttgactgtctctcgattcaaacagtaacagagtccatatatcagaacaaacaagaccaaaactatcagacctacccacaaagggtcaatgggagaaaaaagcataactacacagcgaggatctcttgatcactacactgaggttatcatacttccttaatctatcctgaaaccgtgaaccttaacttgtcccaaagccatgaacctttagttaccttgtacctgcttcctggcaacgttatattcccctctattttatccgaggtccttcccaaactcctgggttactttgtgcctacttcctggcaactttatgctcacctctattttatccgaggtccttcccaaactcctggggttgcaagtttcactcaccatgaacttaccctgccagcaaccactgactgctgaaagttctgaactcggtgggggagtcggttccccgtacgggccacca

SEQ ID NO: 396 - DNA, 797 bp, mus musculus
atggaggctgctccagagaagaaaaaggttgccactgttccaggaacccttaaaaggttcctgctgtgccaaaaactctcaagaaaaaggttcccgctgtgccagaaacccttaagaaaaagcgaaggaatttcgcagagttgaaggtgacactcctgaggaagtagtttgccctgaagacactgcgaaaggcaaggaggaagctcatctatgagaaggcaaagcgctatcacaaggagtacaggcagatgcactgagattcggatggccaggatggcaaggaaagctggcaacttctatgtgcccgcagaaccaaaggtggcctttgtcatcagaatccgaggcatcaatggagtgagcccaaaggttcctaaggttctgcagctcctcgtcttcgacagatcttcaatggcacctttgttaagctcaacaaggcttcaattaacatgctgcagattgtggaaccatacattgcatgggggtaccccaacctgaagtcagtaaacgagctcatctacaagcgaggctacggcaaaatcaacaagaagcggattgccttgacagataattccttgattgctcggtctcttggtaagtttggcatcatctgcatggaggatctaattcatgagatctatacagttgggaaatgcttcaaggaagcaaataacttcctgtggcccttcaaattatcttccccacgaggtggaatgaagaaaaagacaactcgctttgtagaaggtggagatgctggcaacaaggaagaccagataaacagtcttattagacggatgaac

SEQ ID NO: 397 - DNA, 797 bp, mus musculus; identical to SEQ ID NO: 396

SEQ ID NO: 398 - DNA, 2415 bp, mus musculus
cagtgctgtctgggaaagctagccctgggaggggctgaggaaacctgagataacagcactggctaaactcctgcgctttaatttccaactgtgcggaaggagtccctgtgggtgagagttaccccagtctcttcatccgtcctcttagggaatcatcaactacggaagagccaggcctaagctctgccttaatactctgtacagagtagggaagagaacacgcgcatctgggcactctgagcgctatcccgaaagagaatgaattgtttatattaagcaaggacagagtggttttattttattctgtgaattttagtcttgggaaatcctgactgaacctgagccctgaatgcagacacttctccaagacagttaggtcacctttgtggttagtcaatcaagtgactgtttcaaaggcacacataggttctgcactctgctagtcgccctgaatataaacgtgagtaaggatgatttcatcgggtctaaaatgctgcatgtttgtttatgcatggatggcctccaaggggaatgaggagggaggggctgtcagaatgtggaggtaacacagatggcctgtgagaggttgggtaccagcttgggagggagagtgatgacctggtacctgcaagtcagttatgcgttgggactttggcactgtagggttatacatgttgcccgtgcaggaataagtgattcctagtgttgtgttttataaaaaaagaaaaggaagccagggatgtttggtagaggcgcggtatggtgctggggaagagggtgcctctgcgggggcccatgctgaggcatcccttcccccactgagggaccaatcacatgacgagtatagtatggaatagagtttatttagggcatgggaagggagtagagacagagggggggtggggggaagaggagtagaggccggccatgaacacgtggagagagacagggagaggaatggggagagaaggggcagagaagggagggtacgatagtgaggagggagcaagcagccccttttatagtgagtcaggcatacctggcaacagccaggtaactgtggggcagagcctagacgaaatgttaatacccagcttcacgcacaaataaataaatgaaaatgagggagagatgcttatgtaaatatgtaagaaagctagatgttttgtttatttcgttccctccttcctgtcttcctttcttctatcttaacttaccttttctttctttttattcctaaataagcacttactgtatccccagcttgtttaaaactcacaatgtagagccgggcgtggtggcgcacgcctttgatcccagcactcgggaggcagaggcaggcggatttctgagttcgaggccagcctggtctacagagtgagttccaggacagccagggatatacagagaaaccttgtctcgaaaaaccaaaaaaaaaaaaaaaaaaaaaaaacctcacaatgtagtcgaagctgaccttaagcaagtgggagtccttctgcctcagcttcccaaaagcattgttatggtattggggtgttggcaagggaggagacagggtatagactgaattgacagtttctcttcctgtcttgagccagaatgctgggttttagccaagacagttattttcaagtgtttttcgttttccaaaatcttaggaaggaaatgaaagaaagctgcctaaggcaaaagaggtgtcttttcactcacaagtttgggcttctttcctttattacacttatttatttttattttgtatgtgtttatgtgagggtgagggtgtgtctgtgtgagtgcttatgtgccatgacttgtatgttctaggagttggctctcttcttccatcctgtaggtcctgggcatcaaacaggttgtcaagtttaatcgcaagtgatcttagccactgaagcatctcacgagctggaggtttgagtttcttaccctgcccttcaccctgtcctgtgcaaagggtatgaaatgaatgtctcagaaggaaaacgccctctgttaaagattctacaggcctggtggactgattagaagttcatggttgtggagttgggatgttgcagatacagatgtcatggactatcattagcctccttcaaagccattctttgcccgattgtctatctgacttaatctccatgtgactaccatgtgaaaactttggaaatgtactgacagacaactagctttcccaagccaaaggctaaggataccatctgataccatgaggcctacagcagaggttagcctcagtttgctggaaacacctgcctgatgtttccactaatgtattgaaagattatgacttttcttttgctactataaaaccttcataacatggttatttcatttgtatttgcaataccctgaagccatgttccctcataaagtcttaattctctt

SEQ ID NO: 399 - DNA, 2415 bp, mus musculus; identical to SEQ ID NO: 398

SEQ ID NO: 400 - DNA, 519 bp, mus musculus
gcccccgtctactctggggtggtgcttagccggcgccagaccgaccctcggctccggagcggcagtgccgtccctctcggcgcctcctcggcttctccggcttcctcggcttcctcggggaccgcggaccctggtatatgcccgactgctgagcccgctaaagccatgtcgaccccggcccggcgccgcctcatgagggacttcaagaggtaacccgcgtccgcgagggccaggcgctcgagggggcggcctgcctgcccgcctgcctgcctgcctgccggggggcacagggcggagcccgaagcggagcggctccgggtgtgatggggagggggatcccggcggcgaatcgcggggctgagggcagccgctgtgtgtctgtttctgaaggttacaggaagatcctccggccggagtgagcggggctccgtcggagaacaacataatggtttggaatgcggtcatttttgggtgagtctgcgggccggctctcgccggcgaccggggcagggaggaccg

SEQ ID NO: 401 - DNA, 1014 bp, mus musculus
gcccccgtctactctggggtggtgcttagccggcgccagaccgaccctcggctccggagcggcagtgccgtccctctcggcgcctcctcggcttctccggcttcctcggcttcctcggggaccgcggaccctggtatatgcccgactgctgagcccgctaaagccatgtcgaccccggcccggcgccgcctcatgagggacttcaagaggtaacccgcgtccgcgagggccaggcgctcgagggggcggcctgcctgcccgcctgcctgcctgcctgccggggggcacagggcggagcccgaagcggagcggctccgggtgtgatggggagggggatcccggcggcgaatcgcggggctgagggcagccgctgtgtgtctgtttctgaaggttacaggaagatcctccggccggagtgagcggggctccgtcggagaacaacataatggtttggaatgcggtcatttttgggtgagtctgcgggccggctctcgccggcgaccggggcagggaggaccggggccggcccctagacgagccgcgcatggggggaaaggggaagagagttggggttgcttgggcctaggcgcctccccggagcctctgcctcgattagctgccttctctctgctaggggaactctttggggttcttggtggcgaggggcagcggaggctgcggcggcctgcgccgccttttcctaacccgggacagcggtgcgggacggaccaggcggcagggatgggaaaccttgacagagccgccgcctctgaggctgcggggaggcggggaccctctgagccggcactaacgggctcttgtttttgtttttattctgtgttgcaggcccgaagggaccccgtttgaggatggtaagagagtttcttagcccacctttcaggagcctactcttcaggggaaagggggtcccgggtatcagcaagcgccccccacttaaagaagcggctttgcccctgccacctctgaccaccaaaggctcaagtgaaattcagt

SEQ ID NO: 402 - DNA, 359 bp, mus musculus
tctactctggggtggtgcttagccggcgccagaccgaccctcggctccggagcggcagtgccgtccctctcggcgcctcctcggcttctccggcttcctcggcttcctcggggaccgcggaccctggtatatgcccgactgctgagcccgctaaagccatgtcgaccccggcccggcgccgcctcatgagggacttcaagaggtaacccgcgtccgcgagggccaggcgctcgagggggcggcctgcctgcccgcctgcctgcctgcctgccggggggcacagggcggagcccgaagcggagcggctccgggtgtgatggggagggggatcccggcggcgaatcgcggggctgagggca

SEQ ID NO: 403 - DNA, 48 bp, mus musculus
ggggcggcagcggcggcggcgggagggggggcagcggcggcggcgaca

SEQ ID NO: 404 - DNA, 406 bp, mus musculus
tggcctcacaacctcagggtggcacgcggggaggtagggtgagagacccgagccggggagcgcagcgtgctggtgcttctcctccttcttttcttcttctttttattttttttttttattcttgccgctactctctcagtgtgtgggtcccagggtccgcagaggtgctgtgtggcagggcccaagtccgctgcctagtgtgccccatatataaggaagccctcacgtccccacattagttggagccgtgcggctggcgtggcgacaacgaccattgaccccccatccccgtttctctgtaagcgtagcccccgccccccccaggcacatacccccagcccccccagtctcagccctgagcgtccctcacacacaggttgcccccccccaaccccagccgcctcgc

SEQ ID NO: 405 - DNA, 165 bp, mus musculus
gggtcccagggtccgcagaggtgctgtgtggcagggcccaagtccgctgcctagtgtgccccatatataaggaagccctcacgtccccacattagttggagccgtgcggctggcgtggcgacaacgaccattgaccccccatccccgtttctctgtaagcgtagc

SEQ ID NO: 406 - DNA, 2985 bp, mus musculus
ttctgcctgtgcgcctcagggaagaagcccacagccactgcgactgtgcgagaagtcaggacagaccgcctctccggacagaccataatttgggtgaggcgccagaagaaaaacccttccgggtcaaggatcggagcagagagatatatattcaggctccggaactgtgaggacacagcgttggaagcctcttcgggagcagcgtcggatccagagattctcgctatggaaactcctcaagacagccgccaaagcatccaaaagcctccgagtccggcagccgaggaggacaaggaagaacagcctggtgagtaaactggttctgactggacttgggtgaagtttggggagaaacggtgggtggaaagaagagtggacaggcacttcaggtcggttacagagcccctgcctgtgcttcctctccgggctttccaggcatccctgggccatgttgctcaggtctttatctctgtatcttccttctgtctttcaggtgggaatgcagtggtctccggggctccagaggaaagaatagacaagaaagagcttgtactgaactggctcgctcagggtgagtttgatcagggcgaaggcgctcagggcgaggttgctggaggtgagcaggctcaagaagagcctgctccattgagtccagctcaggaagccactggaggagaagaggagggagaaaacaaggaaggagaaatggaaggaagacatgctggtgatggtgcttctagctccgaggatgacagcatcctggaagaaggcggcgaaaacatagatcaacagccgcctcagcaagaggcagccagtcctgatagcatcagaaacccacatgttctgaataggctggctcaactgcggtacagacgcaccaggttcacccactctcagctgcatgacctggagcgccttttccaagagactcgctaccccagcttgcgagcaaggtaagaagatggccagtgcttggcgccacatttacgggtctcctttgcctctccctggccctctgaatccctgcagaaataatggcaatggtccgtgaccggcacctgcaattagaaccgtctgcctgcaattagatcctgtggtagtggtatgggagctgtgaggactggaaacaaatgtgttttgttgccctgttcaagactgggaaatttagacaatgtttagtgttgtaaatgagtttccagaagtacgggtgagaagtctggggcgtggctaggaagagcaggagggattccaactcgcgttaaaatgttgctagtgcttttcatcccagacgctctcttcactgattttacattgtcagttcaccaaagagacatctgtgtattgggggacacccttagatttggtctgtggaagaaacccattgctaaagctaggtttaaggtaaatgttaagaatagtgactgtaagtaaatgtgtatgagcacacaagtgtgggcccaaacatataaaaccaaatcggacatgtccttacacaattgatttccaccagaaaggctaaatgttggaactttttctctttaggagggatcttgcacgatggatgggtgtggatgaatgtgatgtgcaggtaagtgttctgaaaacacaaaacatacagtttttggaagggtgccacacccagtgatgttgccctccggaagtacaacagcagaacaggaccctgaagttccctccaaaggctgctagaccagtacacagccaggctaggttcaagatgacgccaggcctccatttttacaggcaggaaatgccaacggaaaagctaagaggctaaggtgctttgttggtccttcagaggactgggtgtgcccttgaaaacattcagaaatctgtgcagcccacatgcctcacaggagtgaagagaccatgctcttactcacttttaacactgtcactcagagaattttctctcagaaatctccttggtctagtctgtaaatgtaagagacctagcatatttctaaaagcaatattgggaccaaggacctgaaacagcctgtggcacattgttttattgagtgtgtatctctctgtactctgaccacaattacactcagccctagtcacaaggggaaaggcctatagtcactaatttgggaggccagaaaggaagtaccaagcaggaagaggtaccctggtgtcatcactgtgcattctgggtgctcaaaagaggcatacagtggatcctgagcagactgcctcccaccttcctattgttcttgggcatgggctggagaggttttggtattttcccacagcaaggcctaggaaccaccaatgagctacaagtgaattctttcctgaagaaaggcatgaaaaatatcgaggatggagagaggaggcggtgttttgggtctgttccgtggttgaaagactgggtgtggtgttccatgtcctaaggggcttgggaacctgtttttatttcagagacaatgaaccctattgcttccaacatactgaataatcagaatacacccgaggaacctcttgagcccctcttggggttagagcaataatcacatagtttctgggtatttaaaagatgcagtgactcttccaggggagtggctcagtgctacagcacatggctagcacacacctggccctgggatgggttctgaataccttccaaactgttaggaaaatgaagagggcatatagcactccaggatgtgtgtgttatgatgatagtgttgaatggactaaagtgtctctgtctcctgcttatagaattggtttcggatgaggagagcccttttccagagaaacaggagagtgctgatgttctgcgaactgccgcctcttccccagagcgactctccctgaagattttggagcagcacttgagtgccagccctgtcatggagccagatgaggatggcttcttctgagccacccatgatggccatgacaaccttttcttctctacaattatttcagcaataaagatgagcattctgaata

SEQ ID NO: 407 - DNA, 2985 bp, mus musculus; identical to SEQ ID NO: 406

SEQ ID NO: 408 - DNA, 899 bp, mus musculus
gggcacccctgctagcaggggcttccctcgcaggcagtccgtcactctgcccagctccaagtttcatcagaaccagcttctcagcagccttaagggtgagccgccccggccctgagctcacgtgacagccgctttcgagaccgctctttctccaaagggggcgagtggctgctgcccacccagaagcagcctgggagcagccaggtcaactccagccgctacaagacggagctgtgccatcccttcgaagaaaacggtgcctgtaagtacggggacaagtgctagttcgcgcatggcatccacaagctccgcagcctgacccgccaccccaagtacaagatggagctgtgccgcaccttccacaccatctgcttttgcccgtatggccccgctgccacttcattcataacgccgaggagcgacgagccctggtgggggccgggacttttccgctgaccgtccagcctccagcatagctttagctttgctgggtttcccagtgccgctgccaccgccgctgccacggggatgctggacagccccatatccatcatcccaacccctatcctgagcgccaatgatctcttgggctcacctactctgcccgatggcaccaataaccccttcgccttttccagccaggagctggtgagcctctttgctcctagcatggggctgtctgggggaggctcccccaccactttcctcttctggcccatgtctgaatcccctcacatgtttgactcccccccccccccacaagccctcaggattctctctcagaccgtgagggctatctgagcagctccagctccagccacagtggctcagactcccctaccttggacaactcaagacgcctgcccattttcagcagactctccatctcagatgactaa

SEQ ID NO: 409 - DNA, 899 bp, mus musculus; identical to SEQ ID NO: 408

SEQ ID NO: 410 - DNA, 899 bp, mus musculus; identical to SEQ ID NO: 408

SEQ ID NO: 411 - DNA, 899 bp, mus musculus; identical to SEQ ID NO: 408

SEQ ID NO: 412 - DNA, 7309 bp, mus musculus
tgtcggcggagcccggcgcccgagccgcgtccgtggaagccgctttgacgtcggcggaaactggagcgacatttaaagcggcagcagcggcgctgcggagtccggctgcttggggtaggactctgaccctgcctcggccccgaggaggagaaagcggccgccgcggagcaggtgaggagtgggctgggcaccgggcccgggagacggagcccgcctacgccttccatgccctggccgcgcctacgcttgcggccgcctcgcttgaaccaggaagcagcggagcccgaggccttggctcctctgctctttctttgtgtgggtcccggagctctaccaagagaaccggtaaggcgcggcgtggtccccttctctgtccagtgccagaggcacccggtacccttgcataagccttagggcgtgggggacgccgccaagtacccacttggctttctccctctccattcgtccgctttggggggcggggaagggggctcttttcccacctccctactagtttgattgagctttactatggggcccatcctcctctttagatccttctttggacacaacaatgcttccggcttcgcatggcccgctacccccaacagagtacccttaggagctaggcctactttcttcaacacccctcaacccccctgccttcgttctgctgtttgcatcgccatccctgtttgtgttttcacgtgaattgacgtttaaaagctcagttgcaccaaagttcaaaggaagaagagggagatggtggaagagggagagatggacaacagctgcagggagccctgtagtgttggtttgtttccccccctctggcccgtggcatttttctcttccctactgtcaccagccttctaaaccagccaacaaccaaagatgtgttacacaatgctatgagatgccttttccgtaggcaggtcgcaaatctctggggaggaaaggtttgagacccacttggggtgatcctgggctaaccctgaccagctggatacctaatcaaaatgaaaccaggtcccagtatcacctagacacctacatttgaatcattcccatgttggaaaaaaaaaacccttattttccaattataaaaatcatgtggccatatacagaaatctctccacttgaaagtggtttctgttgaaaccttcatgttttggattgttggcagattgtctaaaggtcacactttgtgatgaatgcctttgtgattgcctgtaattccttggtgctgttaaaatggagtagctaacatggttttaatttttggcttttagacttttaaagttatgatgttttaaatacagagatactcatgcctcccttgtgtgtttatatgtgagcatgtgtgtgtgtgtgtgtgtgtgtgtgtgtgtgtgtttgtgtgtgtgtgtgtaagtaccaggtgacagtgacattctttagtaacttattaataaaataattctctaccaaatgtacttagcaaggaatggttaatatataatatttgtataacatgtgttttgtgcttataagtattttaatatgcatatgggtcctttgcacttcagatgcactctgaactcaatagcttccgtgaaatgccaaaagaaagtgtttggagtgtcccacagcagcaacagttgcctgcttctctgttgtaactagttactgtttttgcttgcactgactcctttgaagagaactgggtcttctacaagtgaacatcattctttaccaacaacatatgtttgcagtttttatgtaaataggcaccgaggaggggcgctctccctttctgtttgtttcttcactagagtatgtgttgacttcacttggcactctgtctaacgctgcatctctacaaagtgcaaggcagaatagaaggataaggggtaggtagaaataatgggaaattgtgaggcgctaattgtcagtgtccgtaattggccttggctgtgagggtgaacttttgaataggatgtaactaataagattagaggtgaagttgaagggtataaatttcagactaaatattaaacacactaaacttttctggcatttgaagaagtaattcatatgcttaatggtgaagatttttcttaaaatgaaaaattcttatctcttgaggaaaaatgaagtaaagttgggactaggaaagtgaattctaagtttaaaagggtgattagtggaaatgcattttcctgaatttcaaaggaaggcgaccaaggagattattgttcagatctgcatggcaatttcaaagtttcttgacatttctcagagtaagtcctaagatttgacacacagtcaaaagctagtgtatgtaagagcatgtttaaaggtcaagatttacaccaaatattgactaaaatgtaaactgtttaccatacctatgcctcacatttcgaatagtcaggtactttggggtttttccctccctaatcctcccctctttccctcttctctttcccttataggcatggagagtagaaaactgatttctgctacagacattcagtactctgccagtctgctgaactccttgaatgaacagcgtggccatggtctcttttgtgatgttactgttattgtggaagaccgaaaattccgggcccataggaacatcctttcagcctcgagtacatacttccatcagctcttctcagttgctgggcaagttgttgaactaagctttataagagctgagatttttgcagaaattctgaactatatctacagttccaaagttgtccgtgttagagcagatttgcttgacgagttaattaaatcagggcagttactaggcgtgaaatttatagcagagcttggtgtcccactgtcacaggttaaaagcatatcaggtacagaacaggatggtactgctgagaccttaccttctagttctagtgacaaaagccttgacatggaaaaatcaaaagatgaagcccaagataatggggctacagtaatgcccattataactgagtctttttcactatctgctgaagataatgaaatgaaaaagatcattgttactgactcagatgatgatgatgatgacgatgtcattttctgctctgaaattttgcctgcaaaggaggatttgccaagtaacaacacagcaacacaggtccagcctaacccagcctctgttgctatttcggaagtgacaccttgcgctagcaataactcgccccctgtaacaaacatcacacctactcaacttcccactcctgtgaatcaggcaactctaagccaaacacaaggaagtgaagaattgctagtgtcttcagcttcaacacatctgactcctaacattattttgttaaatcaggctccacttactgcaccaccgagtgccagttcttcactcccaaatcatatgtcctcttcagtcaatgtccttgtacagaatcagcagacgcctaacagtgctgttttaacaggaaacaaggctgaggaagaggaagaaattatagatgatgatgatgacatcattagctccagtccagactcagcagtcagtaatacatctctggtccctcaggctgataactccaaaagtaccactttagatggatcattgacacagaagatgcagattcctgtacttcctcaagagccaccttctaattctttaaaaatttcagatgtcattactagaaacactaatgatccaggcttaaggtcaaaacatgtaatggagggtcagaagatcattacattagatacagctactgaaatcgaaggcttgtcaactggttgcaaggtttatgcaaatatcggtgaagatacttacgatatagtgatccctgtcaaagatgaccctgatggaggggaggccaaacttgataatgagctaccaaaaacatctggcagtgagccaccaaacaagcgtatgaaagtaaaacatgatgatcactatgagttaatagtagatggaagggtctattatatttgcattgtatgcaaaaggtcctatgtctgtctgacaagcttgcgaagacattttaacattcattcttgggagaagaagtatcagtgccgttactgtgataaagtatttcctcttgcagaataccgcaccaagcatgaaatccatcacacaggggagcgaaggtatcagtgtttaacgtgtggcaaatctttcatcaactatcagtttatgtcttcacacataaagtcagttcatagtcaagatccttctggggactcaaagctttatcgcttacatccatgcaagtctttacagatcagacagtatgcatacctttctaataagtcaagtgctatgcctgtcatgaaggatgatgctgttggatacaaggttgatgctggaaaagagcctccagtagggaccacatctactcctcctcagaacaagtcaacgttctgggaagatatttttattcagcaagaaaatgattccatttttaaacagaatgtaaccgatggcagtactgagtttgaatttataataccagaatcttactgaactcttggaatatcagaaagtttgggttgaattaaggggtgtggatttcagaagacctgtaaaacaagtcaaggtagaaacgtgttaatttgatctaccatgtcctctgaaagtagactagttgcattgttaatttttagaaacagttttccttaaaagtttgagtagagattgaacacccctgaagtatctgtatagtttagctttccgctcatttgaaaaggtaaatttttaaaggtgcagggacatagttttctgagtagactttgaagaaatctaactgttctttgagaattactggagttactaatatataccctagtacagctgataatgttccccttccaggttaacactctactgctgatttttcaattttcttaatgttaagtctaagtgtgttgtgttttatatggcataagaagtaataaatgtccaaaagttgtgctagtaaataccagagtaagtcctcacttggtttattctgtcagtccaaatggagatcagccttctgcttctctcccactgtgaaatagccatgcaaacaagtctctcctatgaagactgagttcgttttagctaactaggattaaccatagtctgcttttgatggcaaggccactatatgcctttaaactatggtcctggggttacagggagctagcaaacatgcatgtggtgtagccgggggattcctttgtgcttatcattgctcttctgcctttatatgctagcagcagtcaagttgaatggagagctccttttgttaattatgaaaacgttcccacaaaatgctgtgaatttattatctgaaagccaccaaatgcatctttatatgtaatgctagtaaatgttgcgattccatagatgagacttgtggtttgggggcggggggcgggggggggggcggcgaggagggggagggaggctgctggcacagctttttaaatgctcatgttagaatctccagtgggaagttttcattttaagtaatttaaatggcaatctagaattgtcatttcaacaaggtcttttgagtttttttaaccccttaaaataagttccaatctgtgtgcaaactgctgctatattatagcagaaaccataactggaatactggaggcaaatggcttcttgtttattttgacaataatgccagctttcctccttttaagatgacacatatttaaacacttagaagaatttaaaatttacccaaaagctagtaataaaagaaagcaggttggaacagatatatagtttagcatttataacagatttaatacaactctgtaaaaaaattaatgttttgcaatggaaaaaataatagatactgaaaatggttgttgttggatagttgttagtcatttgtgatcttgcttatatatttcttagttcagcataaggtattttcattctctgtgtatttttgtctatttcttgacattgaacgtaaagctttaatcatgctcttttatatataggtcattcttctggttaaactaggtgtgaagatgaagttttcagtgtttcttaagttggtagctgagggtatcaagaatcagtatttgcaggaatacaaaggaagaggatagtcccggcttaccaagaggtagaatgctgtacatttatgttttggtttttggtaagcttaagcctaccatcataagctaactcttagaaaacttaaaatcactttatagctcaagactctgatttctctcacaatattcatttcctttctctgtagctattgatggcactaccttttgaatatagggtctgctcaaaagcagctctcaattgaaaaatgtgtttcatgaatgcagtctcagcagttagacataattgcttctaccagtgtcggtgataaggatgttttggtgtcaactgctaggtaaaatcagtttgtcataataagacttgctaattcctacaagcctattacaacaaactgggaattttataatgaaaaactatctgttctgaataacattggtcaaatgattcactactactgctgtgctctgctctgtcaagtctctaataagaacttttaaactttgtgcctactgaaaagcagcttctagagtttgcagggaggacaagaactagaaagttaaattgtaattttgccaggaagactcttccatgtgttcggggattttttaaatagctttatatatccaaccttgagaggtttttgtggaatactcctctggacaataactctttactcctagccattattagattggaattttgtagcaaaatgctatttaaaatctactgtgaatatttttctacttagctttctgactactgattttttttttttttactgttctttcaagttggcttcaatttcactcaacttctaaattatctgtagttatttttggtagaatctatttgaaatagtaaatttgttcaaagtataagccaacattttaaaaaggttatagcattcttgcaagattaaatagggataattttgttatcattttggtggtcactatcctccactcagagtcactgaagaatttgttcaattgggctaaaaagataaaaacaaatgaaccctgctgtaggcatttaaaatgttatagtgtgtgcattttgaggaattaaatgtaaattcaatagcactggcttctttacctctgttagtcatatgaaaccttgttcatttccccaattactgtacattttcatatttgtacaatcttccttatcataagttctgcttttcattaactgttacctgatattagttcatagagtttatcacaaaataaaacatattcattctaa

SEQ ID NO: 413 - DNA, 7289 bp, mus musculus
cgagccgcgtccgtggaagccgctttgacgtcggcggaaactggagcgacatttaaagcggcagcagcggcgctgcggagtccggctgcttggggtaggactctgaccctgcctcggccccgaggaggagaaagcggccgccgcggagcaggtgaggagtgggctgggcaccgggcccgggagacggagcccgcctacgccttccatgccctggccgcgcctacgcttgcggccgcctcgcttgaaccaggaagcagcggagcccgaggccttggctcctctgctctttctttgtgtgggtcccggagctctaccaagagaaccggtaaggcgcggcgtggtccccttctctgtccagtgccagaggcacccggtacccttgcataagccttagggcgtgggggacgccgccaagtacccacttggctttctccctctccattcgtccgctttggggggcggggaagggggctcttttcccacctccctactagtttgattgagctttactatggggcccatcctcctctttagatccttctttggacacaacaatgcttccggcttcgcatggcccgctacccccaacagagtacccttaggagctaggcctactttcttcaacacccctcaacccccctgccttcgttctgctgtttgcatcgccatccctgtttgtgttttcacgtgaattgacgtttaaaagctcagttgcaccaaagttcaaaggaagaagagggagatggtggaagagggagagatggacaacagctgcagggagccctgtagtgttggtttgtttccccccctctggcccgtggcatttttctcttccctactgtcaccagccttctaaaccagccaacaaccaaagatgtgttacacaatgctatgagatgccttttccgtaggcaggtcgcaaatctctggggaggaaaggtttgagacccacttggggtgatcctgggctaaccctgaccagctggatacctaatcaaaatgaaaccaggtcccagtatcacctagacacctacatttgaatcattcccatgttggaaaaaaaaaacccttattttccaattataaaaatcatgtggccatatacagaaatctctccacttgaaagtggtttctgttgaaaccttcatgttttggattgttggcagattgtctaaaggtcacactttgtgatgaatgcctttgtgattgcctgtaattccttggtgctgttaaaatggagtagctaacatggttttaatttttggcttttagacttttaaagttatgatgttttaaatacagagatactcatgcctcccttgtgtgtttatatgtgagcatgtgtgtgtgtgtgtgtgtgtgtgtgtgtgtgtgtttgtgtgtgtgtgtgtaagtaccaggtgacagtgacattctttagtaacttattaataaaataattctctaccaaatgtacttagcaaggaatggttaatatataatatttgtataacatgtgttttgtgcttataagtattttaatatgcatatgggtcctttgcacttcagatgcactctgaactcaatagcttccgtgaaatgccaaaagaaagtgtttggagtgtcccacagcagcaacagttgcctgcttctctgttgtaactagttactgtttttgcttgcactgactcctttgaagagaactgggtcttctacaagtgaacatcattctttaccaacaacatatgtttgcagtttttatgtaaataggcaccgaggaggggcgctctccctttctgtttgtttcttcactagagtatgtgttgacttcacttggcactctgtctaacgctgcatctctacaaagtgcaaggcagaatagaaggataaggggtaggtagaaataatgggaaattgtgaggcgctaattgtcagtgtccgtaattggccttggctgtgagggtgaacttttgaataggatgtaactaataagattagaggtgaagttgaagggtataaatttcagactaaatattaaacacactaaacttttctggcatttgaagaagtaattcatatgcttaatggtgaagatttttcttaaaatgaaaaattcttatctcttgaggaaaaatgaagtaaagttgggactaggaaagtgaattctaagtttaaaagggtgattagtggaaatgcattttcctgaatttcaaaggaaggcgaccaaggagattattgttcagatctgcatggcaatttcaaagtttcttgacatttctcagagtaagtcctaagatttgacacacagtcaaaagctagtgtatgtaagagcatgtttaaaggtcaagatttacaccaaatattgactaaaatgtaaactgtttaccatacctatgcctcacatttcgaatagtcaggtactttggggtttttccctccctaatcctcccctctttccctcttctctttcccttataggcatggagagtagaaaactgatttctgctacagacattcagtactctgccagtctgctgaactccttgaatgaacagcgtggccatggtctcttttgtgatgttactgttattgtggaagaccgaaaattccgggcccataggaacatcctttcagcctcgagtacatacttccatcagctcttctcagttgctgggcaagttgttgaactaagctttataagagctgagatttttgcagaaattctgaactatatctacagttccaaagttgtccgtgttagagcagatttgcttgacgagttaattaaatcagggcagttactaggcgtgaaatttatagcagagcttggtgtcccactgtcacaggttaaaagcatatcaggtacagaacaggatggtactgctgagaccttaccttctagttctagtgacaaaagccttgacatggaaaaatcaaaagatgaagcccaagataatggggctacagtaatgcccattataactgagtctttttcactatctgctgaagataatgaaatgaaaaagatcattgttactgactcagatgatgatgatgatgacgatgtcattttctgctctgaaattttgcctgcaaaggaggatttgccaagtaacaacacagcaacacaggtccagcctaacccagcctctgttgctatttcggaagtgacaccttgcgctagcaataactcgccccctgtaacaaacatcacacctactcaacttcccactcctgtgaatcaggcaactctaagccaaacacaaggaagtgaagaattgctagtgtcttcagcttcaacacatctgactcctaacattattttgttaaatcaggctccacttactgcaccaccgagtgccagttcttcactcccaaatcatatgtcctcttcagtcaatgtccttgtacagaatcagcagacgcctaacagtgctgttttaacaggaaacaaggctgaggaagaggaagaaattatagatgatgatgatgacatcattagctccagtccagactcagcagtcagtaatacatctctggtccctcaggctgataactccaaaagtaccactttagatggatcattgacacagaagatgcagattcctgtacttcctcaagagccaccttctaattctttaaaaatttcagatgtcattactagaaacactaatgatccaggcttaaggtcaaaacatgtaatggagggtcagaagatcattacattagatacagctactgaaatcgaaggcttgtcaactggttgcaaggtttatgcaaatatcggtgaagatacttacgatatagtgatccctgtcaaagatgaccctgatggaggggaggccaaacttgataatgagctaccaaaaacatctggcagtgagccaccaaacaagcgtatgaaagtaaaacatgatgatcactatgagttaatagtagatggaagggtctattatatttgcattgtatgcaaaaggtcctatgtctgtctgacaagcttgcgaagacattttaacattcattcttgggagaagaagtatcagtgccgttactgtgataaagtatttcctcttgcagaataccgcaccaagcatgaaatccatcacacaggggagcgaaggtatcagtgtttaacgtgtggcaaatctttcatcaactatcagtttatgtcttcacacataaagtcagttcatagtcaagatccttctggggactcaaagctttatcgcttacatccatgcaagtctttacagatcagacagtatgcatacctttctaataagtcaagtgctatgcctgtcatgaaggatgatgctgttggatacaaggttgatgctggaaaagagcctccagtagggaccacatctactcctcctcagaacaagtcaacgttctgggaagatatttttattcagcaagaaaatgattccatttttaaacagaatgtaaccgatggcagtactgagtttgaatttataataccagaatcttactgaactcttggaatatcagaaagtttgggttgaattaaggggtgtggatttcagaagacctgtaaaacaagtcaaggtagaaacgtgttaatttgatctaccatgtcctctgaaagtagactagttgcattgttaatttttagaaacagttttccttaaaagtttgagtagagattgaacacccctgaagtatctgtatagtttagctttccgctcatttgaaaaggtaaatttttaaaggtgcagggacatagttttctgagtagactttgaagaaatctaactgttctttgagaattactggagttactaatatataccctagtacagctgataatgttccccttccaggttaacactctactgctgatttttcaattttcttaatgttaagtctaagtgtgttgtgttttatatggcataagaagtaataaatgtccaaaagttgtgctagtaaataccagagtaagtcctcacttggtttattctgtcagtccaaatggagatcagccttctgcttctctcccactgtgaaatagccatgcaaacaagtctctcctatgaagactgagttcgttttagctaactaggattaaccatagtctgcttttgatggcaaggccactatatgcctttaaactatggtcctggggttacagggagctagcaaacatgcatgtggtgtagccgggggattcctttgtgcttatcattgctcttctgcctttatatgctagcagcagtcaagttgaatggagagctccttttgttaattatgaaaacgttcccacaaaatgctgtgaatttattatctgaaagccaccaaatgcatctttatatgtaatgctagtaaatgttgcgattccatagatgagacttgtggtttgggggcggggggcgggggggggggcggcgaggagggggagggaggctgctggcacagctttttaaatgctcatgttagaatctccagtgggaagttttcattttaagtaatttaaatggcaatctagaattgtcatttcaacaaggtcttttgagtttttttaaccccttaaaataagttccaatctgtgtgcaaactgctgctatattatagcagaaaccataactggaatactggaggcaaatggcttcttgtttattttgacaataatgccagctttcctccttttaagatgacacatatttaaacacttagaagaatttaaaatttacccaaaagctagtaataaaagaaagcaggttggaacagatatatagtttagcatttataacagatttaatacaactctgtaaaaaaattaatgttttgcaatggaaaaaataatagatactgaaaatggttgttgttggatagttgttagtcatttgtgatcttgcttatatatttcttagttcagcataaggtattttcattctctgtgtatttttgtctatttcttgacattgaacgtaaagctttaatcatgctcttttatatataggtcattcttctggttaaactaggtgtgaagatgaagttttcagtgtttcttaagttggtagctgagggtatcaagaatcagtatttgcaggaatacaaaggaagaggatagtcccggcttaccaagaggtagaatgctgtacatttatgttttggtttttggtaagcttaagcctaccatcataagctaactcttagaaaacttaaaatcactttatagctcaagactctgatttctctcacaatattcatttcctttctctgtagctattgatggcactaccttttgaatatagggtctgctcaaaagcagctctcaattgaaaaatgtgtttcatgaatgcagtctcagcagttagacataattgcttctaccagtgtcggtgataaggatgttttggtgtcaactgctaggtaaaatcagtttgtcataataagacttgctaattcctacaagcctattacaacaaactgggaattttataatgaaaaactatctgttctgaataacattggtcaaatgattcactactactgctgtgctctgctctgtcaagtctctaataagaacttttaaactttgtgcctactgaaaagcagcttctagagtttgcagggaggacaagaactagaaagttaaattgtaattttgccaggaagactcttccatgtgttcggggattttttaaatagctttatatatccaaccttgagaggtttttgtggaatactcctctggacaataactctttactcctagccattattagattggaattttgtagcaaaatgctatttaaaatctactgtgaatatttttctacttagctttctgactactgattttttttttttttactgttctttcaagttggcttcaatttcactcaacttctaaattatctgtagttatttttggtagaatctatttgaaatagtaaatttgttcaaagtataagccaacattttaaaaaggttatagcattcttgcaagattaaatagggataattttgttatcattttggtggtcactatcctccactcagagtcactgaagaatttgttcaattgggctaaaaagataaaaacaaatgaaccctgctgtaggcatttaaaatgttatagtgtgtgcattttgaggaattaaatgtaaattcaatagcactggcttctttacctctgttagtcatatgaaaccttgttcatttccccaattactgtacattttcatatttgtacaatcttccttatcataagttctgcttttcattaactgttacctgatattagttcatagagtttatcacaaaataaaacatattcattctaa

SEQ ID NO: 414 - DNA, 212246 bp, mus musculus
agctcttttcttcttccccactctttagatccaccatcttcgagggcgggggaaccctttggttttctttataatttctttcttatttctttatctcgtccctgttttgttttgttttgtttttttacgattttggttttgctccggttttaattctctctgtttctgtctccctgtgtctctatctctgtgccggtctctgtctctgcctgtctctctgtctgttctctctctctctctctctctctctctctctctctctctctcttcctttctctctctctctctctctctctctctctctctctctctctctctctctctctctctcagaaatcgctttggggaacccagcttgcagccaatgaacccgccttccagattggtgtgaagacagaagtgaggtgggggggcgtggagggggtgtgagagagatcctgggaggggggagaggaagagaggagagaggaagagaggagagggagagagagaggaagagagaagagagagagagaagaggaggaggcggcggcggaggaggattagtgtggggtggaaaggaagagtgagcgagcgagagcaagttgaggggagggggtgtaagagccggcgaattctttttctttttctattattattttgacgactcccgagttgcgcccatgctcttgtcagcttcgttttaggcgtagcacagccaggcagaagaaaatggggcaaagcgtgctccgggcggtcttctttttagtcctggggcttttgggtcattctcacggaggattccccaacaccatcagcataggtaagctccccagagccagccagagggggccaggctcttctgcatttgaaacccactaccctagtggggctgggggtatcgcaacatgagtccctgtcctgcatggtttggggacggtgtctagggatgggggactgagctgagatattggagacctgagctgcaaagaactgacgagtatggggagcatccaagatgagggaaggggtctcccggggctaatgcgggtggacggccaggttttctgaccgaggagcaagggagtcaagctggaggttgggatgctgcaagaggctaagagtcgcggcttttcagctcgctattctggactttgccagggcatgcttgcagccactggaagttgtcccagggtgatactgcctgtctggccgcgccaggacgcataacctgggcccaggtcgccccgtcccgcgtctcaggcttcagtgagacaggacagtgttagaagaaaaggaacccactttgaaacccccagaccaaggaagtagctgtgtggatggaggatggggtgggaagtgggggtgatacaaggagtcgggcaagcagggaagtcacgcagaccaagcattcatgaattgcggctgtgtctgtctggagaccagctccagtagccggaagggagttctccccgcctctgcctgtatttgcaagtagagaagttagaattgttgcttttactgaactgaccccctgtattgtcataggggatgattgggacagcaaggggaacgaaattgtttttcttcccaccctatcccctgtaccccaggagggaaaatgaaccagctgtgtggctaagggtgggggtggggttggagtcagggttcggggccagactcaagcttaagaaagaaccaagtcccacttttagctccttcatccttcccctacagcagcctcctctttctcccgtctttttagtttcctccgtgtacaaaacccaggtttttcacagtggaaagcagagtttccaagtcttgaaagacacacaggttgaaaaaaatcattcctcagttgagcttcccagaaacactgaggtagcctggtagctcctgtttgttactttctaactcctgctgaagtaggggggacacaagccgaatctccattgcctttgcttctaggtggacttttcatgagaaacacggtacaggagcacagtgctttccgctttgctgtgcagttatacaacaccaaccagaacaccactgagaagcccttccatttgaactaccacgtagaccacttggattcctccaatagtttttctgtgactaatgcttgtaagtagatctgcgttggctccctttgggaccttaggggacctcatttgcattttgtttgtgatgtatggggctttgcaaacgtgtgtgctgggggtgggggtgggtagtgattgcctcaataagcagactgaggcagttgtcaatcctgggttcatgttgcataaatcaaccttgaaggattctgctgcggggctgaaagcagtgggcaaaaactctgaggtgaattatgtttgatgcaaaacttccactttcctccctgctaaactggtggtgttctctcccccgcacccttttctgttgggggaaaagaaagaaagaaagaaaatagcatggttgttcagggaaatttcagatggaatttttaaaaaagaagcaacagcagctccttgattgagagaatgcggggcatgcaatacttgagtggtgaagctgtgtctgctggtcggaatgggctgagtttaatgatggcctgacacataggaacaaaatatgagaaccctgcaaacaagtgaccttgaagcatagatcaggctggattccctggcttctttctttctgtgctacccagagtgctctgataggaactgataagactacaaactgattgcaagtgataaatgcatgtcagcctaaaagcaagagggaagaccgtgcccaggtgactttttggaaagccaatcctgcctgtgctatcgtgcctgcgcacgcgtgcacgaacacacacacacacagccacacactcacacacacacacatgattgttaaggacaacacagttcttaatttagagcaagaggttggttgtgggaagaagcttgaagcaggaaaactgaatacttaaaaaggggagtttcatcagccccaaagccatttctggaatccacctttatacccatggttatctcttttcaaagggggaattttaacagtaaaaccacaggaactcaaatggttaataacttgttggacacaggtttttgttttgttgtgtttaacttgagagaacattttgtgagaaacactgaattcttcatcagagctttgtttcactaaaagtttctcccaaatgaagccacttaacacaaagtatgtcttgtttctctggaatggtgtgctttgaaatctgaagtttcaccacattttgggaaatggtatttatgtctgttggaatttaactttgtatatgactttcttcaaatccttccatctccaaaaatgtgcaatccctaacagtccttaaacaggacctcaagagcaaatttcattggatttaaagtcttggcttgaagagaagggggagtggaagaagtacttttcaaaaaatgtaacagttatccgcctgcagaaaaatttagctgaaggtgcagattcttttaagaacatgttctgagacactctgtatttgacattctttagttttccaacactgacaaaaaaaaagtgtgaaagttacaaaatgtctggctatacttcctgtcttccttttgtaatccccgacctctctccagcatttacaaggcacatctgattcttaatcctgctgcactgcgatctcctcaagaggctgaatctgaaaggcagtttcctaaatatcaattagaacagatttaaaaccaaatacatgaaaccaacggggtgcattatcattaacaagggataatacatatttcatctcccttccctgtctttccactgatgaactctgggctaagagggtcatttggtttctcaggaatgattgatttccaaagctttgggttttgttcttctgatcaaactgctctgacactcagcagcctgcctccagctagcagaacctgaacaacagtcaggaaatgatctctgtcatgagaaaaaatctcaggtttaggaacaggtaataaaccatccatattggacagtaagtggccagtgaggggactgggaaaccaactgatcagaatctctcaacttaaacccatagcactcttacttacaaagctgggttatagttgcacacttaacaatgtaagagaaggggttagattcactaagcagcaagaaaaacaagaccaaaaggaaacctcctccttagttatgtcaaatacacacaggcatacacacttccagggcacacgtgggagaacaatctagaaatcagtgatgtatgcctagctgcctgttgcacactcagacttgacagttagctcagaagacagcagagagaagctgccatcttctctggtccctggaacagtcatgtctgaaagtcacaattgtctgaatgggagtagatctcaaagctgtctcctggcagctgctgcttggtggcttagtgtgagaaagatacttagtccaactgtagcctctgaaaacaacaattcaagtgggcagagaaatgttggcgatgtctgttccatcctccctgcccccatggcctttattgtttttgtggaagtatgagtcaaacctgtcagatacaagcaaacaattttaacagtacttgaaccaagcaaatgactacagatgccagtccaccaagtgattattaccaatgccacagaggaaacaaataatatcaatgccctctagccttcctatctggggaactctggtgaaaacctcagacgagtccaaatctggttatgtagccctcctatctagttcagtgtggaactggactagcaacaatgaaataagcttccttgtcatgcagagttcccagtttcagctttctttggggctgaagctgatctcctctctggatctccgaccctggggcaagcatatactttctagggcataggtatgcaggaaaacggaaatgtgaggagtaatgccttctgtccccgcccctgccctctgcttcacctctgcactgtcacctttctccatgcaaagtattcagaagtcgttctcacaatgaatcctaggcaccagttatttaaagactttactagcaagcaagcaagctttttcttttcttttcttttctttttctgcacaagcctcaagaggtttgcttaagacagactctaacttcattctgtgccttaagaggccaataaaagcctccctggctttgaaaggtggttcagttgggatcttagctcagaagagaatggaagtttcgcagaaagactcacctgatttagagcacatgttcccatttcataggaattaatagagtccactgccttacttttaagtttagccgggtaaaggcagagagaatgacgttgtaactaaaacggtttcagcattcatgcctccgtaaacatagaaaggcacacacatgattagtgcataagagaaacaatgcacgcccattttgtaagttacagatctagcatttaggggaggagaaaaaaagaaccaaaccaatgtgataattctctggcttacaagggtagggaaatatcaggagattgctcagtcccgtggtttgactttgctgtcccgtttcctcgggaagccccgttgattcccttgaagtcccctcctgtgtcatgccgctgtgcacttgtagtgcactccacactacaccgccccagcctctgcagtgtcagctcattagcacacagatctcatattccctctccgcactgtcattgcaaaaattgctgttgtacacctttacagccaacaaatgtgctcgtggattacgtactgaagcaggggaaaggcaaatgcaacctaaaaggttattcactgcagaattgtcctctaaatgcattggcttaaataaaaatctgttgatggaagaagctcagtgtggatgctgagactgacagtggatgggggactacttacaggagtaccaactctgatggagccctgggcaaaattccttttgtcagctaaacctaacctatcaacagcaaggttttcttctactaatgtttacaagtgacttgaaatctacctgcaaactgagaacttcccccttttataactgagcctgttttgctaccaagtgtacttagctgagacaggcttctatctcctacccacagagtcacaatctaattatctaattactctaattgccaggaaggagccacttaaccatttaggtccatttggaaaagaaatgtctctcttgatcacaagctctgcaataccatgggctttgttttggctttgtttgactgtttgccttcctcatataagcttagaaacgaagatgaataccctgagattaaggctcttgtcctgctataggttgtcaagtcctaaccattatccgctctgaccccacctcccccatgactgaaggatatttgcacttttgctgccctgcctcctctaccctgtctcctgactagtcctcaagaagctcactggcttagttttttggtccttttggccagctggcttagcctactgaagcacgaaggggacacctcagtggtgccagtcaaagatttaagtcaccttctcacaaggtttatcatcattttttttccttaatctatgctttgtaatggaagagggaggatggcgaggctgttcattttggccataaaaatagatggcaatcagcaggctgtaaaggtgagcttcctgcaaagtgtattaccactcatacaagacagcttcctattgatcttataagtgaaggcaatggagaaaggagggtttgcagaaaaataaaagaggaaagagaattactccgttattctatctgtgtttactgaaaagtggggccgttgtttttctctctctctacaatttaaacttgtttttcttctaaataaaactagtgttccatatgccccatcttctacctcaatagagattgttttcttaattgtatgtttccctccatggtccctcaaattgaatgagtagtgggagatgctttaatggttttggtccctgagatatctgtaacttccacggctacggggattcagagatgattggctgcttctgttttgacagcttgagaaaataaatgaaggtgttgaggtgttgttgtttgtcttcctttctgcataggagatttgtcatttttatacaattgatttaaggattaaaagacaacaaatattttttaagagatgaccagaaatttaggagctagaattcattactttggaacaggagaataaaagtccttatccaaatgatttgcctttggatttcttagatgggggaccactgatacattttaaaagaacttttgtaaaactttgtatctcctataaagatcaagaaaatcatattaaaccaaattttgactcgattcctttgcatgttggtagtttaggcctaattagaagggatgtccaggagacctcaccattaaagcaaccaatggaggcaatagttatgctttgaaaaggaaaggaggtgtccatgcacaaaagcagctccctccctctgaaagctgctcaggggccatccaagccccagacacagagttttaaatatgctcagcctaaagtctagaatcaacacaaagttagggatactgtctccccaaggagttaatgcttagcaaactgataatgtgggcaaaatttgtatttttcatatttctactctttttatcattatgatttcctttcttactctggctgtccagctcatgccgttgcctggtctccaaatgcctactcattggcccatccacactaactttacatagggactatttcctacactgagagtcttggtctttcttttttcttattagactgtccttgctcttagttaatgctccttaaggactatacactactttggggataccagcttttccctgaacacaacaatataacctaaagtggtagaagagaggattgaaatgcataacaggagattattaactttaaaacctgggagtataagaggcatcatgtctcaatttcaaaggaagatactcaaatgggggggtggttcttaggatataatattcatattggctttttacccaaatcaaagtcagcaggctttggatatggaagtgttttttcagggaaaaggtagctattcatagtaggatgggtatgagtacagctaaaccacaggctcagtttcaagtgaaaaacttgaaagtctttgggacaattttgggaatcggcccaaatacatagggtttcattttattgaagtagctgttgtaagagctgtaactatatgtgggcagtggcaggagatacattgtaccaaacgaaagtcattcaggagaggagaggagggtggtagggaagctgagtctcatgcagaaggtttctatcctttggaatggcatgtggaattgcatgccagtggtggtaacactggatgcactcagtacctagccaagaagcagctccctctcatttcctctagctttctcttaccttggctcagtcatatattgtggtccctctgcctatggaaggatccatcctactctcttctggactcacactacacatgagtgagggaaatgaatggtggccctcctccctgtttcccaattgtcacttgctttttaagcattgaccctcaatgcaacactgttttagcttgtttgcaaaagtcaaaggaccatagataagacgggaaacagtgctggtgatggtctcttaccatatgctgcacaattcaatacaaaatagcatttatcaacctttcatgcatgcaccatatgcatgaaaggcatgattaggatttaaaagtttactatgagcccaagacttttcatttctagcaagttcctggtccttaaatcacattttgaacaacaacaaccaaaaggccaaagttaagagactgtatttaccaaagtaaaggttctttgggtcacacttttatcattaagatttgtctaatgaaacaaagttctgcacaagatacatttgctttattctgagtctcatattcccaacaatctcatgtccatttcatccaggtaggtgtcattattagatgcccactgaaaacatttgcttaaagttggttcttgtaagagtgtggaatggtgagctacagggcaggctgagagagaatgtagcccatgagtcagaatgacagtgtcttggctccttgccacgtcccaaagtgccctgtttagaaactatatatgcaagagatctaaggttgctttgtagttccaactctttttccactttgcttctctgggtcaagacatgccagaggaggcatgtaacaactgcttttcagctgcccagcttctcttaaacagggttggaaacaagaagcacaacagaattctttcttttttcaagaagagactgaaaaatcaactcaattttcaggtactcagagtgaaggaagaagtgtagtgttgcttctgaacatatcttagctaaggactgatccaaggaagacattaaaagaattgccaatgacatttgaagactgaatctgatgcaatcccaccccacccccacccccaaatactgtcactctaatggtctgcctttagtctttactttaacaaatttacttatgtgcattattgcattagaagcatatgctaaaatctgagtatgtaatctggaagtgaatgagctaaatactttttactcacatttaaacagaattatttattccggctaacacctattacctttcagagtcctcagaaggagatatccagaacaggtaagtaacgtagaataagacagctacctgccaaagaaagttgagcaaaaaaaatggatggtggaaattaagaaggttgttgatagaaaaaaatggtcaagaaaatacacactatctctttcttcacattggttctcagttgtaaactttgcgcctttattcactatgctcttatctctgtttgactatttcaatggcatttgacccatgaagttgctctcttctgatgcagtgagcctgctgcctgctttctgcatgactgttcgttgccatggataatggtgaagttgggattttctgtagttaatgtgggaaacttgcagaagtaaaatcagtttgtaagcaaaggcagtgagcaatttttttaagttttaaaaattgttatgataaacctccttcccccttcagttatccatggttggctgattggttaccaataaaacaggtagagatcagcactcaacccacagaaaggtaagtatatggacaaaggtgttaatatggtgttctctgcatgggtgaattgtaaatttaagacagaactgggatcggacatttgcaggcagacagaacctgttatagaaccttgaatatcctttaatttcactgcaatctccaaagatgctcgttgattagtttaagtcttggattggaccatttacatcaaaatcaccaaagattttgctttaaatatgaattcctagtttataccccaaatgtatgaatcagaaaatacatgctttaggcctatctagcaagttttgtgggtgataataataacataaatctaatttgagattcatgtcgttaataaatcctgatgctataatgtgagatatgcagattcagactgcaaactattgaatacccactaagcagcaagtatcgtgcctctatgcattttcatacatgttgcctttttgggtaattgaactacaattgatccatgtaagcagtaacaaatttggctgccaacctgaaaatttaggctaggacttgagaaaactaagcctcatagtctctgggacaaataaagtaacaactctgagatggcaaatagaaacagggacatggttttcatttttactgtgtatcttcctatcttggcttgttagccaatgatggttctttaaatatgctatgaactagatatgctatgaactagatgtcatggtaaatgtcagttcatttattaaaatggatgcattgcaacgatttactgtagcattcattgtggtcttcctccccatgattgttataaacaaatttaaaacaaaagctgatataataactaccactccactgtaccacatggaaaacattgtccaaggaattttatatgttatttcccaaggaatcattacatttccagaagtgaggcactttcaccccaaatttatacaaaatagaaatcataagtggttcaaaattcataagcagctagctcaaggttacacagctggctctgtggtggcgccaagagaatttcctgcctctagagtcttactcaatttcaaacggagctgaaatcttaaatgattataagagctagacacatcacatatgtggtgcatgaggcaggtatgtttaataaggaagagtgaagtgtttgacaatctctatgttccaaagccctcaacatatacaagtcctatttttaacccaccatgaaagaaacaggataccttcagtagtccctaagatggctgaatatggaaagtgcatgtctctgacatctataccacaatatatggtatactctatttagcagctaattattggtttggagaaaactgttaactggtcattataactagtgagaaaaaaaaagagagaaaagagcaaagctttattggggggggagggaggaaagacaaaatccatttgtcttcttaacaaaacattaagatgtaccagcctaatagaactctctatctcttatgcacatatcacatatgtaatcttacatacacaacactttatacagttgttttacttatgtaaatgtcacctcgactctaactttccatcagacaacggtgaggtgtatagcaaggatagaatgctaacatggggtcattaatatatatttggcagatcaaaagaggtcttctcagggggcttgctttggagaaattacttaggttctcatatatactccccacaaattggagacactatataagttaagaatctctgaagaatcacctagggtaagatctcctatattttaagagacaggcttagatctttaagccaatgtccaaaagaaacttgtatttttatttgcttgatgttgcagacagacataagcttgatgttacatgccatcgtgaggcactacttgtagcttatcaatagcttgccatagtaagagtgagagcagcatgtcttctcatcataacaccccatttccagaaataagagcacaacacaaataaaatcttgattctcattaaaatagtaagcaaggaaacaatttggtatcctattttcagactcagtcacattctgtcccctgtcactttaagtgttctaacagtaagtagtctgtttcttagttcccttgaggcagagaagacagcatcttgtggcagaattttgctaaccaagaatccttatcagtcagtagcttcaatctcttaggttgaaagtaaaaatcattgacatgtgtagccagtccataaatattggacactacctattcacaaataagaaatttatttaatgaataagtttttatgttaattggagataaatgtctgaagtgcctatagaacctgttcgtgattaaaattttatgaatgctagataactactccaggatgatatgtttctcagtaaaggcatgcctagaatgtcaattaagaccaaccccctacatacatcatcatacaatttactttgaagtcataaagtaagttacagaaaagtgagcagtttagatcccatgtttctatggctttgggaaacaataaaagggaaacagagatttatgagagtgagtaatagaccaggagttaagacaggtacccagttaaagtcccagatctgacatcaactgcctctatcactatagaccggcctctatatctctgcttctagtttctatcatttttaaaatagagaggtctttctggatgctatctgagactttgatcattgagaacctatcactaggtcttactagcttactttatttctagttgaggaaatactatgcaaatggaatccccccaactctttctgtatctagaaagttctattcctgtttattgttctagctcacactgataagtcctgggatcaaactattaaatcataaatctgatggatagtgtttctacctagtcatcacttacccttcccaatcccaacctctttcacttattatgcaacgctgagcaagttacttgatttcatcctgcctcatagtccccaataatgataacccttattgggtggctgagagtttgaaatgaaatcacaaattcatataaaacattcacaatagtgtccagtacctactgcttatcattattgatatcatcattaatttaaaatattttgagctttttgtcctaaaaacagaaacctagtttcctttgaaaattgaaatcacttgtcacttcagaaaccagatttccttcctgaacagctgttcactgagcctttacagttctaagttcttcttcaaactacagatcattttttttctgccaagaaacccatcacaacaccccctcatatttccagcccaccaacctaacctcagacatctctcacccatgcatccaactttgcacatcccctttaactcttggcagcaataactactcaggtacctccatcaagaaactctgtgagttgcatatctctgcatgacctaaggcaaaatttcaaaggaagacctatggtttcccctcccaaagaaactatatattttttcttattcaatatactattaatctcaaactgactcatcttcacagtgtgtgtgtgtgagagagagagagagagagagagagacagagacagagacagagacagagacagagacagagacagagacagagacagaaagaggttactcagtttatgtgcaactccaccaacttcccaaaggcccaggatgcatccatttctcctatgaaaatgattgaaaagaaaacacactggccaagtactcagtgggcttgctctgcagccaggaactaggacttctctagaaatgggtctgcccactgagtaatatcagaaaaagcagcaaaaataaattgtttaggggtctgctagctagttcattcctatggacaatgcattagtgaatgggctttttggtttttttttttttgtttttttgttttttttttttgtttttttttttgttgttgttgttgttgttgttgttgttttcctgagcccgaggaactgagaaaaaaaatgctccatgcattttcctccctggtaggcactgctgtgcacacaagcatttctcatacatcttctctcagccctttccacctcttggtatcactaagcccttgataattctcttaatgcttctccctaaagatggtgaaagccagatacaaccccacttctggtatatttatgagtctaggcaactgctccagtatacaagagttcaagtctactttctgtaattctggatgtcctttggcctcctggtttctgccagaatcaacccactgtccttgattcttccttctacagcctatagacatataggaacacaaggacataaaaaaaccaatgaggaaaacaaagcaacacttccccctggctaaaagtgccatggaactgcccaggtttttatgtcattcattactggttcttgtgtcttctcccttacattttctgtggcaaaagattgttgtttacaaattccttagtagaaagctatttctcctattccatttgggaacacttaacagacaaattgtagctctaaaatggactacaagaatttgaatctcgactctcttattagcagtggcctgaccttgataaatgacttaacacctctgcgaaataaagacgaataaaagaataaatatgctacacagatgctgtgaatattaaataggaagatcatttatgcaaaacatttaccatgatgtgtggcacatagtaagagccaagtgtaatggtagctactattaatactgaatggtgaggtgcttaaaaatacagatctcaaattttaactgatcaagggatgcttttccggtttccaagccctagaaagcaactcaggttccctgtgattgtatagcctagaacaagatggatgggacaatctttgaatactgagaaggctattgagtataagagactaggtttggtggtaaaatatgtagagggagaatttctgtgatacatcataaagccaggttatatatacttctaggcctcaaccatgccacaattaagtgcaattccttaggctataatcctttcttatttactgtcttagaaatgaggatgattttcttactgcccatgttgctttggataaaggatcaaggcgctttggataaagcagcacagagggtggcgtgataacattggcatttgctggattaaaggaaagaacaaactttcttcagatataaatggttttttttttaatgttttagaagtggcagagtagaaaagtgaacccagacatcttcacacaatcaaggagaaaaatgtagtttgagctttctcatcaggcgcagtttatgtggactctttaccttcaggtgatacaggcagcacggatgcttggagcgcttccttttgactggatgccttttccccctttggatggatgatactgtctgagtcaggctggaaagagcaaatgaaggcaatatgggaaaggttaacagaaattttcctaacgtgactttttcctcatttcagtctcctgtctctccagagcaaaggttaagcatctaatttcataaatttgctagggagaatgctgcttaggacccccagacaatgcaggcagctttttccccctgtcttcctgtcacctggccttgctctatgtgcagcctgtctctgacaggctgaaatctgggtgatgaccaaaagcagcgtgtttttttttttcatatcccaagatattcatgctccaccagcttcatctcctctctcattattatacaaggccactgctgcttttcttatagattaaaaaaaaaaagacatggttctcagcaaagggaactgaggaatccaggggctaagtgactgcactaaggtcccacaactggtagcagaactgggttggcagtctggctcccaactcttggcacttcgctaagatgtcttcttaacctgcttctaaggctctttgctacacagtgatactctgtaaaaaaatgacaaccttgtcagttttaaataggtgctagaaaggaaaaccaaagtcacagcaagtcaattagggaagcagcaaagctagagtttcaggggccatgggtaatgataatgtgtatttagtggccccagagctaacttgtcaacattttaccaccctttgatttatcatgaggagtgggcaaaacaaaggctaaaggtgtagagcccacttatgcgtcacataatttttgaactacatcaagtacttctaatccaactacctcattttgtagatggggcaagtgaggacaaaaggaagggattcatcaaagatgatgcaagatgagaatttggacttctcagtgtggtccctcccatcatcttttcaaccttcccaccagaaagctatactaaagcaataccgttgaatctattacttttatttttatttttggtgtctctttctcttgaattatgtcacatttataagttatagtatcccaaaccaattttcaaatgtaatccatcttttagtgagtatagaagttaaaatgtcaacttcaatcatgatcagtgttttaaaaaatacttcaaaaatatatatgaataaaatcagctacattgagcagaaatgaaggctgaggagacagcatcgagatatagtgcttgcctagcaagtgcaaagccctggtataacccctgtcctggaggaaaaacaaaggaagaaaagagaggggaaaacaattagagaacaaggaaaaaaatggaagaaaataaccatggactttaccacattttcaggaccatatcctgtgcttttattatatccttttattatcttggggagactttctaagtctccaaaaattttaaaaatgatcaattttatttatatttattatatcacatagttgtttattacatacttgtgatacataaacaactatactctctatagttatacattgatatgtatacatataacactactgccaaatttggtacattcagggattttgattctcatttcacagatgtttacaattatgtaccaacttgctgtaacatcaatattctaggtcaggtttgagaacatagtgaacaaataataaataggaacttatcctttctgcaatgttcactgttcctccactggacacagcaaagaataaaaatggagtagcacatgcctataaccctagcacttagacagccgaggcagaagggtcatgagttcaaagtcagcttagggtatacaacaaaaccttacttcagaaaaaggagagagatgctattcccatgatacctctactatatggctacataaacagtatctaaacaatgttgacacccataggaatgctgtcatagaaagtaccaatcttacagggccccagtactgatgagacaggaagaatcagtctatcccagaaatgaatcattttattggttaatcaataccaagtgctcagtcctgaaattgtatatatactgtcttagttgaggtttctattgctgtgatgaaacaccatgaccaaaaagcaagttggggaggaaagggtttatttggcttacacttagacatcacaagttcatcattgaaagaagttgggacaggaactcaaacagggcaggaacccagtgtcaggagctgttgcagaagccaggtgttgcttagttacttactcaatatagcatgttcaacctgctttctatagaagctagtacttccagcttagggatggcaccacccaccacgggctgggtcttctcctgtcaatcactaataaagaaaatgccttccaggaatgcctacagcctgttttatagagacattttcttaattgagattactcctctcagatgactttagtttgtgtcaggttaatatgaaactatccagcacacatacaaataacgttatatggactaagcacattgtgcttataggtttatgaatgtgcgtgtgtgtgtgtgtctgtgtctaacaataataactacagagaaataggtgatgaatttgagaggatacagaggccctaagggggcgttggagagaaagaaaaatgatataattatattttaattaaaaataagaaagaacaaaaaagtgacaagggagatatatgttataaaacttaggcagactatatagaaagtgtggttatgatctgaagccaaattcctaagtttaaatcctatatataacatctaactttatatacatctcagtttcaaaaacacttttctatagttttctaatttgatctttataatgctcatttaagacatacatctcagtgtctctagttgcatatgtaacagaggatggcctagtctatcatcattgggaggagagacccttggtcctgtgaaggttctatgccccagtacaggggaatgccagggccaggaagcgggagtgggtgggtttgggagcagggttgggggagggtataggggactttcgggatagcatttgaaatgtaaatgaagaaaatatctaataaaaaaagagatacagctcaggtgtaattgtccccactttgtagataaagaaactaaggcctaaatatgtaaaacaagcaatgccaagttaaagattatgtagtaaaaaaggaaaaatgacccagggttaccaacttcaagtactttggaaattgtaaagtgtataaagttagatgtagtatgcagctgtcataaagtgggattacagtcacaaatgatgctagagactgggctgagtattaagagcctcaaaaacattttgtaaggaaaacaataagctgttatggaccaaaaattttgatcatgtaaaccaacatctttgtattatatatgagagacagacagacagacagacagagacacacacagaggcagacatacagagagacagacagagggagagggagagggaaagagagagagagcagcacacatcaaagtaggactagaactcacttctctcacatttgcagagtccccaaataatcatgactgcattttcttagttgacctttgttgaaaaagaaagagtaaggaaacaatttagttatttgtagaatccacgtaggctggaactacttaattgggatctcatgcaaggaaaaggaaaatatcctataactactatgttttaaaacacactatttgcattccaggtgtgggagagtaaggagccaggaaggtgacagacaagtcaggcaggagagagagctcctcggattcttcaacaatactctcttcaacaatgaccaacacagcaaataacctctctttgattattaacaatcattgtcatagttgttcctctgctatgagttttttgggaaaaaaaaacattggtaaaatggataaaattgccagtttcttgaaaatagagaggactatttattttcttgtagcatccatgatgtctacagcagcaaaggactccatcaccaagagcacctcagctctcactaagccctttggagtttataggtctaggtgctgagcaaatatgtgttgggcactttgatctttccattagttgtttcagctgaggcaagagcaaataaacacttgtgtcttgacaaccttttcaagttcggtgggacagaaagttataaaagggaaaaagaaaacaagaaaagatttttttcaatagcaggctatcaaggttactataaatgccatctaacaaggcagcccattaaaaaatgtagtccaaaatgtactaatatgataaacccaaatgaggtctcgttattcttagctctaaagttctgactgtccttacaaactgcctctgcagcctagatagtggccatcatgatctgtcttctgctaaaatactcctttcttcctccttttgaacaggaccgtagtcccagagggcagctcttgctttccttctctctctctctctctctctctctctctctctctctctctctctctctctcttatttaattatattcatttgtcctgaaagctattgcagagagagactatctgtatctgtcagccttggcttagggtctttggagaaagtgggtagagagagctctatcatgctgcctagataacacctcttgcaccagttgtttttcagctaaagtgcagctaaaatcagggctcctgaatctgaagtgggtggtgaaactctaagataaccatgataaaagagaaagggaagtgaccttttctgctggtgctgttacactatgataggggctcctttatggacccttaaaagggagaaattcctggcaagtcaaagtcagggcaactttacactgtgggaagtaaatatatggatcttcttagcccaggaaatgtaaatactgccagagaaggatcaatacatttgtgactgttaaggcaatgataggttactaaggagaactaggctgtttggggatccatttaatctctgagttcaaaattagtgaggacaaccagagcctctgacagcctcaatgaaatgagtcctgaaagcatgcatactctctgaactgtgtctgtattttccaattaatgagggagggagatatgctgtttatttctgttgtttcaaactgagatgctaaaatctccagtttgctttaaataaaatccttgcatccaggggaacaatatttatatttcaaaggaaaagaaagagagaatgagagaaaagaagagagagagagagggggggagaaagaaagaaagaaagaaagaaagaaagaaagaaagaaagaaagaaagaaagaaagaaagaaagaaagaaagaaagaaaggaaggaaggaaggaaggaaggaaggaaggaagaagggcaagcagaggcaggcaggcaggcaggcaggcctggaccccatcccccttattctgctactacaaactatctgtggtaccaaccatgtcctccataggcttcgccttttcccatttgtgaaataaggccattagagtaagtgagcccccagagtcctttctaacttccataacatttactacttcaaacggctccacaagcttcctctggactgctgaggatgattccttactcaaggctttccaggagctcagaagatgttcccaactccgcccaatgtgtcactcaagcctagcttccacgatacacggacctgctctaaagtttgtatttcatgaacttttgccccactgtctgaggcccctactcattttaaacagagctccatatattagaggcaacatttggtagactttaacaccagagatggccaggcttgctgatgcatactagcaatctcagcacttgggagactgatacagccacatcttcaagaatagactgggatgcaaagctacttcaaagaactcataggctatgtagtgaggccctgtcttgaaagcgctggaaaagaacaacaacaacaaaatttaaactaaccaagatgtaaatctgccttgagtgaggattcctgttctgttattggcagccaagcgatttcaaaaatttgtctaaataagctttgcgttagtttcctcctctgtggattaacagcataatacttcttctgttgtagtggaattatcaggattaaatgaggaaatttataccagttctcagcatgacacctaacacacagtttattctgtcatcaatgcgaaattattctccactaagtaaatatcaagctaaaacttaagattgataaattaataaatattgaggtaataactggttgttgttgtcatccttgttgttgttgttgagacagagtctcactgtacagccctggttggcaggacctcctaatatagaccacactggccttgaacccacaaagatctgcctacctctcactcccaagtgctgggattaaagtggtgtgccaccatgcctggcaataccataaccttgaagcagtggctaatcacttagcttcttgggctgtgtatgttctgcttcctataaggacatgtatatactcatcagaaccattttggaaactggacagacaaacacgagaacattttcagatgagcctggcatttgggtacagaagtactacttacttaaatattactttcacctcccatggagccagttgagtccatgggagtcctaaagggtggcagatacacagggaacttccctaaaatgactccttgatatggctcacgtgttaatcacactaagcagtattttactcttcctgttgaaggtgtaatgtgaaactgtgaaatgagaataagtcgaggtaggttgccactgtctcctggcttgttgggttcttactgtattactaccatgggccagggggaggaggacaaagaaagcagcttagcttggtaagacaaggctaaatattatcagagtgagcccacctcacttttgagacaggagaatctgttctctgggggcaacatgaaatgaggagggtgagatcaaagtcaacaacattgtaagacagattaataaagaagcattaattattcctcaagttttgcatgcgcgcgcgcgcgcgcgcgcgcgcgtgtgtgtgtgtgtgtgtgtgtgtgtgtgtatttgggaactaaaatggaggaatgacaacaaatataaagcatcagttttgacacggaaactccattggtcaccttcaacccacggtttattggtcccttccctttcttcttaggaaagcttagtataaaaactgttcagttcgtggcaagttggaagcaaaggaagaggcaaaaagagaccaaggacccaaaatccacttcaaaggcatgaccctagtaatacaacctcttctgcttctctgagtaagaagctctcaatattgggtggcaagatcccattaattagctggcatctagcagtgaacttagactctaaaaattaatatctaattttgttgtctttgctcaccttatgtttaggcagtgatgttggtgagactttgtgggtttagcttctgccatttctaggagactcaacctcacagtaattttcctcttcctctggtgggttcagtcttttccaaccccctattctacagtgtatcctgagccttaggtatgaggcttataatatagatgagaacaagatcagaaataaagatgatctcaaagctgtatgtcagggtcatgatagaggaaaatatgaaagaacatggccttcgttgataactgacactttgcagaaagaagacctatggattagatcccttttgtattgctataacaaaatacctaagataatcaagttataagaaagaaaggtttgagggggttggaaggtgaaggggctctgatgttgggatgtaaactgaataaataaatcaactaataactaattttttggatgattattttagtagcttcaatccatggttgcttggtcccttccctttgttcttatatcagctaggtacataactctggagcataaagtgaaggaaagttcttcatctcatgacagccataaaacaaaaaaagagacaaaaagagaccaaggttcccaaatcaacctcaaatgcatgcccctggtgcccctttttaaggatgctacaacttcccccacgccacagtcaggtgactagaggtgcaactcatagaacattcggagccatttgcggtctaaatgtaatattccaggaatgaagcctgattttaaaaaaaaaaatctattacacaagaagttggcaagggaagtattaatagtatctacgttttatggttaaaggaataggttaagaaacttaaagcgtcactcccagtaaaatgccagtctggcatgcaaacctaagtctaaccctctgttcttcccattcgccatgctctttcctttttaactagacctatgagggaatgagtagttccatctaagctaattttccagataattgaagcagtcatcttttgggagtgaaagtgctatttttatttgaaccatttttttaaggtctacaatgcgttccatacctctgtgccttgttctgcagaatgaacagatcactgcacttttaatcctccttctacagtcacagccatctacctctttactctctgtggctgacaatgctgactaccttgtaggttcctgaagctagcatatttgaaatggggttcatcaaaaagcaggctactaaaatgtggcaggtgtcagtgagagaagagtacacagaatgaccaactacaaaaattcatcagactgggtctagttcatgtaggtacagatagctctaaggggctaaataactttgaagacaacaaaattgaccctcgaattgaaattcccagtaaaaagtcagaaacatcaataggagcttgaattgtgttcgttctacttcactgatccaccatgggaaagaggtccatcacaggtgggagaaatatttcttccactgatactgttcagaaatccccgcacatagtgagaatgaaaggcatacctgcagcatttaaattctgtacacacaatctaccctttcattgtttgctccagggcagacaactcctcccacctcaccactgcacctccatgtttcaaacgccacgagaggtctatttcagaaagatttctgtttcaagtggtgtgtctaaaaaggtgaatcttcactgatctggaaaccaagtcccttgtgtgacgcatagcaaattattgtgtgcttagcctgtcacttttcctttccttgtcccacctataatttcaaaggggggtggtggaagaagcatcctatacgaaagccctctttaagtttgccaacctattggcctgctgcaagtacttggatcttttcaaattccaatcagaatgggctctgctttgccttctccatctccggcttctctgacccggcaaagtttcccatctttcatcctgtcacttagctaatggtgtgtgtcctccttgcatacatcccatactcactgcttcctttcactagtggagtcgtcagcgagctgctcggcagatggcttactggctgctgctcttgtcccctcgctgcagcaatctgttgttctaaatcaaaatgttaatgaaaaataaaagaactcactgccaatgtctgtctgatttaaattaatatagagtcataccttttgaggcaggtttttctggcacaaggttctccatacaggctaggcatactatgcaggtttttttttctccctctctctctaattaaaattaagcgctttcatttccccgagtctcttgtggcacccccaacctgttctttttaataataacaaaggcctaacaaacattcgatttcagtgttccagggaatggcatctcacctggtgaacataattttgagagatattatatgtgatgtctaattataaacatactttgattagatgctgttttcaatactgaaatgacacgtttactaaatgcttcaagtgcagctctaagttaggctgtagttattgaaatctctttcaatccatttgttttaaaactgctggcaaaatcattgctaatttgctactttatttacaagggcccttcactttctatgcactcagcacagtattcatttctgcagcaccaggactgcgcctctctttagggaaaatgtatgtgtgtgcaggaacatcatcgatgtgaggcaaatttttcagcatcaatttacagaagggaacatgatgatgctaacatacctgaaggaggggggaagaatcaccttgtctcaacttgacaaaaagtgtagaaacccaaagcatgacagcttcaaccaattgtggaagacaaccctgtccatttgtttcccccatgacttctttctagacactcttaggaagagttaccaagaagctcaacagcgaactatgcttgctatagagtgcacaatgctataagtgatttaactttaacttcatcaaaacaccgtctgtttcaaaaataaagaagctagtacatagttaactcttttgcccgaagtcatgcaactagtaagtcacagaagcagagaacacccagctcagctctaagaccttcacttttaaccataataccattctatagtgtaggaaggaccacaaatgtcagcatctttggaaattactgttttcattttgacccctaggatgttttatttgctcaaacttctgtgtaagcaggcatcaacaccaatggggcttacaccatgctaaatgctgagtgtcactgccgccaaatataaggtgaatcaggcatatcaagcgtacaaggcagggcaggaggaagaaaggcctgtgtttgagggtaagaagtactttactaatcactaggtccatcctctcagccctatacactgggtctgtgcaatagcatggacaacagatcaaaagaagcaaggcctggaaaacttatgtgtgaagcagacaaccgatcaggggctccctgctggaacactccaggtcaggtcacccagatacaaactcagtgtttcttatactggaagaggagctgccacacaaaggaaataccccggaagcctagccttcctcctgctgctcagaaaacatacaatcttctcagaaagcagacaagagaaaatggtatgcctagggattcactggattttgggagttgtttgtttctttgttctccgggtttgttttgacacagggtctcagctagtagcccatactggcctcttgattacatagtcaaagacaaccactatctcccctagagctgggagtttaactcagtttgcctaaggccctagatttggtgcaaagcactacaaatttaaaaaagaagaagaagaagaagaagaagaagaagaagaagaagaagaagaagaagaagaagaagaagaagaagaagaagaagaagaagaagaagaagaagagaaaaaaaacccttaaatggaaaggaatggcaaagaaaggcagaatttcccttcttaaaccttactttggcagttatattttttgtccttcccagagactaaaggaaataggaatttggaaaggcatgcaggagatgttaaatagtacccagtgtaagagccaggtttcctgggtttcataacccaccttgtttcttaggtatcccagcccctctggaactcacacaggctttttgtaaactgaaaaggtcctatggaggtctttccaacatcaaatctttaatgattttagccctcactacatgttaataataaatcttgcctttcccactatttaaacaaggaaacacgaggaataatttgaccaaaagaagcaaaaatttgatctgttttgtagtcttacagctcaggccactggagccggtcccagcccgacgtgctagataattattcacccctctgagtcatcaaatcatagactctttgaaaccctgaaataaaagagccctaaaggtcatcttttcctaacctgctgagctctcctttgcctaaacaaagctgatgtaagtagtggagctaaatccaaatttatagcacacctggatatatgttgccggtgctgggttgagcctgtaacctttgcccccaaacaggttctcccttcctgagagttctctttactagtgtttattgattccagaatgcctttaacaagggcctggatttttgttctgccctgaatacaaacaggatagaaattctcctggaagatgtgataacatctaaatgcacataccatccatgatacatgtgactgtagagcagatcatataataagagcaaaatcaaagagatgagaacctgaaagcataaaatacttagaaaagaatgaaatggactacattgagaaggaaggcaaggaaggatggagacactaatgtggtcaacttactagatgtgtttaaagtcaaatctgggtttacaacccaatcacattatacaactagttatctcacctttacagttctcttaacaactccaagccttagtcatttacatactgtagtatgggataatatctattaaacatgaatgttgagggtaaaataggatacatgttctaagctataattacagtatgcttaagtacattcttggcttgtaacgtacagtgttgtactttgatagcattgaaggtgtgtgcccttgactgtgaccctgcagcactcataggaagaaattatgttgatgttcggatcttcagccatttgtaatatgtctaactattgtaaccgcccctagaggtaaccaaaaaattgattataaagaactaatcagaatatcagttattctgatcattgaaagcaatgttcaaacttgcttctttgaaaacttatcatttcatttagcttctttcctccatcctcctccttctgcttttcctttgggattcgtgtgagttgcctccatttcctaccacacattctctttctagcattacgatatatatcttttccactaatctaccaatatttctcttttatgtccaacaataatctctccctcaccaaatcaaggttattttttaaatgtgttgtcctcctaaatctcttcaggatatgcaacatattggtttccccattttttattttattaatttaaaagaatattatgtacaataatggattccattaagaagtttctataacataggatcaatgtactttagctgtccttacttcttaccaccgcttctcaccaccctcctccatataactcatctcctcagtcccatgtttgccttcaggtcatgtgtgtgtgtttaaatctagattccacacaaaagaaagcacacactatttcttaactgctgagccatctctgcagcccaagcacgcactatttcaatgttctcttctttactcctctcccatggtgctctattttttccctcctctctattctcattgttgaggcgctttcctccttagcttctgctgacattacattttaactcttctctaattttcaacctgctccttttttgcctgtgatgtcatgcaagtgccttcattctaggcttggaccatcttcatcaataaaacaaaggtttaaaaacgggatgatatctaatgacatttccatagccattcagtgtctgggagtgaatgagatatccctgtgtttcttgagttgactctagcaggctattacattttaaatattttatagccactcttgtctatgttagcagttgatgtacgtgtacatactacataaggctggggttttgctgctttattcatatttaatctacattttcttcccctctatatttgcatatgcacatatgaaatacctgtatattgcatggcatctttcttaaaaatagatgtaaggtactttctaaagtaatattttgttgtttatgcaacatattagtactttaaatgtatattgcagatattcttctccataatccatttaatttggctattcagaaaagagaacaacatttatttagccaagtgaaggcatgaaaaagtgtaagagccaggactcaccaatgtcattaacaaatagcccgcaaagaacgtatttgagagtttcatactgacatatgttatacagaaatacactgcagtagtataatgagccctcctgtcatttgtccatgtaatatctcttgaaaatactcaaatggatacattataaaatgtttactgatttttattcttttactcacaattcaagtgctatacatgatggtttcaaagggagcttgagactacaaaggaaaagatcggctacctttgtcttaatatctacaccctcccccaaatcctctgaatcagtttttcttgtttcaactgaaaggcaataataatgtatttcctaaatctaaggggtactcagtaaatatatcttagtaatgataagatggaaaaaaagcaaccttcaagtgtacaaagtagagaatgcttgtctctgctaaggaaggtggttgagaggagataagggtccttaagctgctcccaaagcaagtcatgttgtaagaaaagcagcggaggttttgttggtttcttgctattttgccactgaagaatatatgaatttgaaagatcttgcacactaaggagctctcttgatccatggaccataaatgtgtcagtaactcagcaaaacttgatatactgccttctcacacacagcaggagaaactcagtggctgagtcaacaggccctcagatctctgtcaaaaattcaaaatgtatgaatttatataaacatgacacacccttgaggtcagccctctccctgcttttccctctcttctctcctctcaacagtaagccacctaccactaaaacacctctcaaaatctaacagataggctgatttttattgtattgtaaagttttattggtgagcactctccagggccagaatattcaaattaatagacttggctagtcaagttaccagagaagcaccaaatatgtggtgtaaggtttaccaatttttaagagtcagaataaaataaaattttgttcctgactaaaaggtacacttcatgaagttatctttcatatatgattcagcaacactctggaagatcttcacatttgtaagtcaaaattgaagtctttgaaacattgcaccattagtgactgttggaagaaaagacaaacaaacaaaacaaagcaaaacaacaacaacttaccctaacatctctaggaaaagaaataccctggagaataaatgttgctggaatggtcacaaaatactaacacagtaagggtctggagagatggaatggcagtttaagagcatttgctattcttacagaggtcccaaattcagttcctagcactcacatggaagctcacccatctctctatctgccactgcagctccaggggattggatgccctcttctgtcttccacctgctttgcatgcatatggttcacaaatgtatatgaagacttgcagttgtcaattcaaatattctcgacatcttatgttttatttttatataaaaaatcttaattttatggttttaaaaaatggtggtgttttattttgaagtcatatttacttttctctaaacttctttaaggcaattatgatgttacccttagaggtcaattttactatattgcattgccacaactttagattttaaaaggttccacaaaaagccaatttatccatctagagctccaggtgggttagtgccaatgacaaagtgtttgttgctatgcgccaagcgttatatttaagtttctggcatgaattactaattacttataacttttgtgaaaaaaacaagaacctcaacattctctcattcaaagcaacactatttgttcaattagtttcagggattttattgtattttttaggtaaattgatgatgatgatgatgatgataataataataataataataataatatctatccttagtaacagccattaaacattggttcatgctatgtcaggcacttgctaaatgctttcacaggtataatgttgtttaaatccaattctactgttggctccattttataaaaagagacattgaacctacaaaaatgagagtatacacaagtcttcagaattctttattcagacagaataacctcagtgtataattgttttaattgtttattatgaagaaaagatatttagtaagcatgtaccatgtgccaggaactgggccaagtactttatgtaagttggttcacttaatgttctcatcagccttctggggctgctatttttagatatattttatagatgaaagaaagaaggggactggaagttaagttttctcaaggtcttatggctagtgagggcagaactaaggggttagtttagataagttttagactgaagtcccaacatgttctattacaaagacactagaaatgtgtacaaatagacttatgaatgtattttgattgtccattattctcataatcatgaagtcaccctaaagacattgccaacagtaaactatatacagagcttcctttagttccatggcacacaggtctttagcattctgatcacctttacttttcagagaagagagcaggaacagtttgaagccattctcaagaaagctccatcaaggtagcttttgggggagatgaattaacacttctagggcattaggttctctgccgtaatgcaagaatccagtccctctcttctccactgcctgaaagctttaacagcttgctcaaaccaaaacatcatgtcagcatttctcattggaatgccttgaaacgattggtaaaaatagcagattctcaagcccaacctctgaaagcacaacttcgacatctgcattctaacaagtgctccagatcacttgtaacactggaaagtttgagcaccacatacagtgataaagcactcaggccccgtgttctgaatttgggatgctctaacataaataagattaacttgttttcgtgctatgcaaggatgcaatcatgcatgacattaatagaccccatgaaatgattttgcatagtacagtctcctcttaacaatcacaatatacacaaaaatattgaaggctccaagaagtccttgaaagaatgtaagcaagttctttctcaactcataggtaataaacgatatttgcttatctgcttctgcgaagaagaaaaggaaaactcaatgtgtacttggacaatgtgctataatgcacctgtgtttctcaaactacttttagtggcctaggaaagggacatcaggagccccaccttagatttctagtatctattatgtctagagtgctcctcaaatctagtttcctgcataatctaggtacacggctataaggcactctgaaataagcatcagttgtcccaaaggtgatggtggttgagggacatcattatagttgctctagcaaggctaatagaaactaaacaaattctgaatatgaaaactacctggagacaacattatgatacttgctatttaaccatatgactggtcaaaaaatgatgacaacaacaacaataacaaaaagagcggcttgtttatacagtgtgaactgtttgctgttatataaccagagcccagaaattataaacagaacaagttcccaattctgcagccacctcaatgtagtggggatgataggtgggcagattccgtctcccagttgctctatggtaagaaagccacttcaccactctgacttagtcttttctcagaaagccatgtttagaactaaatgaggcatccacactaacctcttatctcaaaaatgaaataaaatatgtgccttcctatttccctctcctctcttttcctggcagagcactgtgatgctagatttgttagggcagcaagtaggcaggaaatgttgctgttgggtttggagcagctattctcttatgagggctgtgtcctttaatgaactccaatgtcagtaactcaagggcacataaagggtactgagatagctcttcagttccactaacaaggaaacaacatggattggggtccacagaggtgaaaggacaagtcctgccctcaagttgctctgagaatagtaacaaaactgagtgtgcctagtggtggcaggtaacaggcagttggtaggggctcaaggaagggatgtagctggtcacagaggtcatctaaagcagtggaaactgtgttaaagctaagaaaaatcactgaggccaaagacacccaatgtcttctttctctacccagaaaaagaaaatagacagtagtctaacctagggatgcagttccaaggctcagttccagcagccagcacagagccaatcacaggctgctttgtgcttttgtgcctggcgttgtactacatatagcacaaaaccagtaccacagaggtgatctctgccctctaggaaggaaagcaatgatgaagacaaacctccagagcacatgaaagtaatcaaaaagccagcactgaacagataaatacctcactcacttccaccattcgggttcctgtccatttttctctcctatggaaaatcttagataaatcaaaactaagtgatcaccaagtccccaaccacccttacctctccatgctttgtccagagatttggggatgcttgtcttagtattaacgcattgatttcatcagattgtatgactgtcggtggtcagatagagctttcctaacatttattcctcctttcagccattatttgttctgtgcttggagtaaggttggtggagaaaggatggagggtcatttccagatacttgcatgaacagtcccatcctgtaaaattttccatttgagtcttaagcatcttcaaccgtggaacaaactcacagaagctgctgcagtccccttcccacttggcatttcttcttatatccagcagagctctggaaagcaacaaggttgggattcctcaggtagagggatggggaacagtggttgagaggcaggactagactcttgcacttccctttaatggtgtgctaagactccaccaccactgaggaaaagccataccatgtttaaagagggctctatatgaatggtacagggttgtttcttaagtgagaaaaaggaatggcagacaaggggattatattaagcaaacaatgtttcccctgattttctttcagaattgtgtctagggagatactacagtgaagaactataacagaataaacacttaggattaaactatgtaagccatctccaagcaaaagcgaggtgtgaagcttggtcaaatcccagccactcagcttagaatccacaggacaactgtgcttcctaactgattcttatctaagtcctcaaatagattttttgtactatctgatgctgtcaaagggcaaaaggtgctgatagaaccacagacaattctgcaatgccaccccccatcagaacaaagagtgttcaaatcttgcaaagccaacaaaactgcagcataggtcagctgcaaagtcccccctcatcaaagacctccctgagccagcaaagtcaaggccatgagctcagggccctcagaaggtcgctggagaggacagtgagtctgcaggatgagtcaggagaattgaaaaagcccagccagtaccaaaagccagacctctagcacagcagccaaggcaaaaaaaaaaaaaaaaaaaaaaaaaaaaaaaaaaaaaaaaaaaaaaaaaaaactctgtaagaacctggagcatcctgataatgggggtggggagagagaagaagaagcaacagaaaagataaactacctttccttcgaaatggcaaaagagggaagcagatgctctttatccttcatatgtcccactttcagtgcccccctcaaggatgccattgatgatgacaactaagcaagcatctcctacatcatactctggtaaccaccaacccctaacaaattcacttctctcaaagcttcccactatctttgaaatggcttccttccttagcatagctctgtcatttcattgtaactgatctggaccactttagcagttcatgagtcagtatagttcccaccggggtcaaatattggcagttaaacaactgtctcttagcaactgagtaattctactccaaagagtatatacagtggaaggatttcagatgaagaggagtactgagagagagaaagatcctgcagaaacctacattcaattctacatgtagcaatccatccattcctccctccttgtttgagcataagctagccatgcgactggcaacctggacaaaagccttaatgcaaaggtgcaacaaaacaccttcttatattagcctcaagacataagaacttcttctgaatcattaccagcagaaacgtgctatgggagaagtacatacaggaattaagggctgtatttcaaactgtggagaagaaactcataataacaatccactctttaaaattattttatttatttacattccaaatattgcctccctctcagtcccctcttccagagttcttcccccttccccctccccctttgcctctgagaggatgcctcccaggcattcccccatgcctggggcatcatgtgtctataggaacaatccattttaaacagtttaaaaacaaactctgtcccataggtgctagataagagagtatataacctgaaaagtctagccatggccccagcttgtgaatctgctatttggacatgagtagagggcatggctttgctaaaggccacaggtaatgactgacaatggaggctttttcttgatgattggggatgagttataaagctaacacttgcattatctcatatattagaagctattgactattgagaaaagcatttgacttgtgaccagtctgatttcctaacatactatgcctcttcacaattgagttttcaaagaaaggcatctagtcaaaagttttaaattctagaacaagcaagcatttgatgatcctgattatttttaatgagacttctctggacaaagaatgctgtgaactctgtgactagaagtagacttgcctgagtagaatcatacttgtctctggttttctccctgtatgtattctatatctcagcgtccccattttttgtccttgagtctcatttctctgaggagtttaggggtcccacttgcatttttcagtccaggtggctgaggatgtcttcactcttcagttcttgtctctctattccatcccatggtaagatgcctcctgtaagaatcctgtttccttcttacacacctacccccccccaaaaaaaaaacagcttggagacttaagagctattgttatgtattaaatttgtcatggcaaataatgacttaaattcctggtccttcaaattagagcagcctgcttaacaagaaatacatttcctgatagccttttaaggcaattttagcttgtggcaataatagtaatgaaaagggggattagtggtgcatctttcatcacatggcagaaatggctgactatttttccctaaatatagggtgggaggggctttggttcatttcagcttacaaaggatgtttaaatcaaagagaatctattcctgctgcccagcatccgtcactaaatagtgctatgcagttttgctttgtcttttgtacttttgtgcttttctgaactgatatatctatccaaggcaaaggaggttgctaaattggtatttcatttttccttactaacgtcctgaaatgtgcctacttataacttctagccctcatttcatgtgtgtgtgtgtgtgtgtgtgtgtgtgtgtgtgtaagagagagagagatttatttttaattaataaagatcagtgagcaaaggtcttaccaagcaagcctgatgcctagggctcaaactctgtcatgtaaatgttggctggatatggcagtcctccttaattccagagttccaaaggcaaagacatgggatcccggatcagcctgggtagctaccctagccaaactggtgagtgtgggggtcagctgaagaacctgccttaatgaataatgcagagagtaatcaagaaagacctttgacattagcctcagttctccactatatgctcacatatatgtgtatgcaaccatacatatacaagctctcacgtgcataaacacatgtatgtacaccacacacacaccgcatatgacagaaaaagaaactcaaagaagttgatctcattttatccaacaactgcattattaaaatatggtatgggtgggaagaatattatcatagctacccccaccgattcaatctgtaatgaaacacatcacaagtaatagtaatctgatatatccatttcaccaataagcaaaatactgatcttacaccaaaatgaccagtaaggaacagcaattcttaaaatattaactcctcctgtaagagctgataaatagtcactggatgcttcagactctccttcagacctccacaagatccagtgactaatagggtaatgcctaagacagtctttaaggctattcctggaattttttctgatttgcttccagtgtcttcccatgtgaacatcacccacaatgccatccaccaagtagcaagtactgtgttcatgaatgtggaccaccatcacttgattaaggctgtagtgatgacactgaagtttctcttagtacagtctgttccatgcatttctatgaagcagaacatccacgaccttcaaaagatggacgactcaagccttgtttccaaaatagcacttggcaagcagcctagactcagatggggacaggagacacaggctgtgggcattatgggccagccccctgtcacatcacctcaggggatcctcaacctcatgggactcactagaaaaaaaaatcttttaaatttgaaaagcagaaattatctagtccacctgagcaccctgggagcaggtccgtattcttagcttcatgcttcaagtaccgagtttagaacaaaagcttccgttcaaggtcatttgatgagtcagtctactgagtggggaaggaagagaactggagaacaaacagcccacatcagggtcaaattgagctgttgagctacctcaatctaccagaaaggtctaagcaaaccatttgcattcttcccttgtagagaacttgagaaattgtcttggacggatgttagtgaacaaaagggaggaagagtaatgttagtggggcatcctttgccaatcagcagtctagaaatgcaaacttgtgatgacctcgtgatataggtgaatacatatgtggacagatgctatgtctgctgtccttatctgagtttcagcaaattcattctttctcaggaagagtctcattctccaaatggaccttttctcctgtcaactttgtactaatgtatcaggattctccatgacaaacagaatcaatgcctatgtgtgaatttcgaaagtctgaatttaacctttaaaaaagatttattttatttacctgtatgtgtgtggacatgctctatgtacatccagacccagacaaagaccacaggagtgtgcaggatcccctggaactgaagtcatggatagttttgagcatctcagtatgtgtgtactaggaactgaactcaagacctctgcaagagcaatgactgctgttatccactgagcctcctcttcaggcccaaattcaccttttggcccttcgagctctcttggtaacattaagagagacaaatacttgtgttttaattttcccctttatgaaataatttgacatagtcacctgcgttatgggttggaataagaagaaaatatttttatagataagaaaaacatttgaacactccaatacactctaaatgcacgaaaatatattgcctgtctttacaaatactcagagggaacatgaaaaatcagttttttttattaagtatctattatgtgtccagcatttctatagtcattagtttccttaatcctgacaataatcctatgaagttgatattacttactataagtaaaataagggataaaattatgataaaatacattcctatgtccaaagtctgatttttatcttacaaatacgtaaattttatcctaaagaaaagcaacagtagtatccaaattacaaatgactatgtcacagcaggtcagtatagcatcaatatgtacctataatgtaaaatatgtgcaaaaaatgtaaagtgtacaaaatatggcacctaatattatttatattacagcagcataacatttggaaaatattcaagataatgatagtcacataaaagaaatgagtatatccttaaaaggtgtcaaataacaaaactccctatgttcaaatgatacatatggaaatatagaactttgttgagataaaagaagtagccctctaggaaaagaatcttcagggcactacagatccaaactttcttccctggccaatggtaagctactgctgtagtggaatgcctgttccttatagccttgacaaaagataggatgagagccctgagagaagggggactcacagaaacagtgtcatctgttttatctgcacattagacaagaaggattggactaaaaaaaaagatttttttctgtacacagaaagctgaaaatagggaaaactggaattcactccaaaatatacatgattttcctatacccatgactcttgactcatgacccatgacgacatttgcagatgaatgtggttctcagcccccattgaggaaacttcttttgtgattagtagaggctactacagagaattgcaactattcaaactgcagaggctaagtggctatagggtattcaacctcagttgataaatctgcaccacaagccctgcatataagggtcaggaaacatcaaataagacgggcaagatagaatgtaagacccagagccaggatgcctgctgctaagtagtagcttctctcttgagaacataacatggaaatacatggtcatcagcaattgaaatgaagtgtccaatcctaactaagacttttgctatgcaaaaccctacatctaaggcttggaaaagagggcagaaggattgattttaagagctagaagaacagaatgcctgttgttacagagtgtactctagatatgagagggggaatatatatccatgaactctcaacaatatagttgccaaaataagaccagcataatgacaccagttgacaaagcaacatgaacaggggtaattttatgatggcttacccttggatgaagaggtcaatggctgctgagtggagaatcaatttcctccagggatgagaccccacaaaggtgttctaataccaagtggtaagccgtgtgtatgtgtgtgtgtgtgtgtgtgtgtgtgtgtgtgtgcacgcatgtgtgcgtgtttctatcaatactaattaaagaagaagagataatgaattgggaagagggcacagaaggagtttagggtgaagaatggatgatgtagatgcactactcatgtatatacttctaaatcacatttcctctctccagtatcataccttgactgatagtgacacagcactcccagccctttgttactgaagtacacctcattatgaccaccactcttgtcatatgtaccaaacttctgcaaatactttgatgcatgctaaatatttctctttaataatgatagacttgtgaccaagaaacagtattccctgctaacacagctaagtgactttccggggacatcaaattcattcatgggctcatcttgccatcattttctctgttaggttatttaaaatataagcattcttgaaagctaaaacctttcatataggaaagattttatacaatggcctccatagcatccagcatgtagcttaaggtatcagacacataaaagaaatgatgaatgaaaagcattcttttgcatgtacaatggtaaaagtatatcttcagtcttgtaatgttgttggaattatagataaatttaattaaacattacaatacaaacaagataaaacaatagattaaaactaatggttagctgctgctaggaaactctcttctttcccaatcactaacttagcaaaatttgctataatgtctcatctaatagcatcaatcaaagaaagtagaagacacctcctgtcattatgcctcagtttccctactttaaacctagcagtattgctctagagtagtggttttcatccttgattcacataagaatcaacttgagagatttttaaaatatggatgccaaattccagcctcaaggtttcagatttaattgacagtagcaaggcctgagctttgatatcattttaaaattccccagtgactctaatatgctgccagggttgagaagcagtgggctagatgatccctaaggtttcttcttactctggaaatcaatatgctgactatagttggatctcttctggtatcacagctaccctgcctgcctgtttcctactctcccctctaatactacacaccacttgatctatcctagctcgtcattgcagcccatttacctattgacttaaaattttatttgctcttgggacttccaagcagtgctatttaaatctgatttctaatgctatgtgggtcattttgccaccagagaagatcccctgatattaggatatgttaggaaagcatgagctgccctgtcctgcttccaggttgggaaaagccaagtagtaagtgtaagcaacccaggcgactactagtggtctgtaagcacaatccccagctttctgtttctctggattctttcatggcaatcagcctgcccattccattcggccctttgtcaagaatgtccttgacactaaaggaattgatttgttctccctttgctttaaataataagccaaccattatgcaggagttttataggatattgatttaacatacaaactgcattatggcccttgaatgctacagaaagaaccaatacctcatcagccaggaacaccaatgtagtgacatcttagcattttctttacttgtcaaaacacccatgagctgtgggcttgctgtaagggagacatgtcaaggatttagaaatgtcagattaaaatattctgggctattttcaaaaagacatgagcatttttaaccagtagcattctatcaacaatgccttatcagaatgtagggctgctaaagaatggtatgaatattatatgggcaacagaaagtacctcaaggtcataagatcatttatttctagaagcaatctgccacaaacatttgcttgatctgtatatacataataagagctgaaacagtatccgcataagaatggaagggagcctagagaggaatctgaataaagaaaatctctctcctcccaagatcctaaaatacaaacctaaaaaacttagaatttggaatggtcatttagctatatgtaattcagaagtcctccacagctggataagaacagtggtgctttgttgtaggcctttggtcaaattgccaacaggacataagtttgttttttgccttcactaccaagttctttgaaagagtagtaatatatccaccttgaatatgttttctttacacttgccccataatgtgaattataaaagctggtcacattaagatactaatggttccttaatagtcacaacctgctgttagctcccagtctcaattctaattgacatgactataactatttgctactgtcaaccacctccccacttcctttgttttgacaagatctctttccagattctcctatatctctagtttttatttccagtcaatggcttacacaaacctttctttatccaccctttatataatgaacatttatcttgatattcacttttaatttttttaatttttaatttatttttatgtgtagaggtgctttacctgcatgtatgtcagtgggtcacatgcatacattgcctgtggaggccaaaagaggctgccagatcccctggaactgcagttatggatggctgtgagctatcatgtggttgctaggaatcaaaccagggttttctgcaagagttgccagtactcttaatcaccaagacattgctccagccctgccccattctcacttttataagttcagacattctatgacttacagaagtgtcaaagctctcattatttctctctctctctccttccttttcactcactctgctcctccccatgcctcttctgcaacaaaatcttcaagacatcaagctcatattgtcacatccctttggagtacctttactacacagtccagtgaacccttatcctcattctaagcccagtacctctcttgtactatttcggttgctataatcattttctaacttgactcccatctctgtctcttctgaatttccttcattttcctggagtcttttctagaaaacacacacacacacacacacacacacacaatatatatatatatatatatatatatatatatatatatatatatatataaagctgagcttccttctgcctgtagaataaatctatgcatcacctctagatacctaataagctgtgtccattttttctttccagttttacttctgttatgtgccctaccatctttcccactcacaaacaactcatccccacttgtcttatgctatattacttcttaaatatgccatgcaagctcaaatcacagtgttttggtttatgctatttccagtatctagaagaagctcccccttcctatttccaaggagtatgttatttaaatatcaccttgtccaattaaaatgtcaattcctgtgtaaaatctttagaattaattatggtcttctctgatctccgaactttctatagatcataattctagcactcatccccattcttcttataattaacaatgtgagagctctttatttaaggcctggaattctgcctctgtcgtgatgtttaatatcatagatgctgaaatcagataaacaaagaactgagcatttgggttcatagttactgggtgcatggtttcaggcaagttcactggtatctcctggtttggagttcctctgttctagatattggcaaacataatgctgcaggaagaataaatgagataatctccataaagccattataataccctgcacacaataaacactccacacatgtcacctgtgactatttttcttctagtgttggcatatagccttgcaaagaatgagcactcaataaatggttactgaataaattaacaatagcaaggaagctctgagaatacttgctaaatgggtactttcttcctttattgatttagcattcctatcagcatccccaaaattggattatgtattgaatttcttttctctgacgtcaacacactgcattcataattgtgataaccaaaagcagttcacatgctctttatcactgaatcttgaacctgtctcatcattattcccaacatgtgtatgttttgaagtatacatttcaaacttttcccccagaaaaatccaaaggctttttccctactctgatgttgggcaaagaggatgatctaattaatgtgatagctattcatatggcaagcattaacttttcaggtacaatggtaattgaaatcagggtgtttaaaactatcattattgcagcgatattcagctgtgtcaagttgggattttggatatttaattcattcttaaacccttcaaccaataaaaatgggttgagtaatgacatttctaatttttactccctttcaccataatccattttgatctcttgacctccattttagttgtgaatttctgaaaggttacctttaatatccaactcacagtaatcagtttaatatcccttgacaaagaatattcttttaaaaagtcagatcctagggctgagaagatggttcagtggatgaaaatgatattgtataagtctgagaacctgaattcaaattcccaaagtctatacaaagcacagtttggtagctcatatctgtaaacccaatattacagtaaaaccaggagaatttctggaagcttgcaggccagctagcctggccttttcagggtgagcagcatggcttgctgcctcaaacaaggtggaatacaaggaccaaaactcaaggttgtcctctgattttcacttatggacacatgcacacacacgcacaaacacacacacacacacacaaatacacatgcacatatatacaacatgtttgtgagtacacacagaaataaagaaaatcaaattctaatatgctctaaaacacttgttatttgagaaaaataatcaggcttcttttgtaatttagtgccataaaaggtccagaggaacatagaaaactcatgtcacttatgagaggtgaatataaaaatcagacacttgaaacattattttcatcaacatcatcactggtgtagtaatcaccatcatcgtcatcgtagtcgtcattgtcattattaaaaccaatacaactctggtttaacaagctctggaaaaatatattagttcatccaaacacaattagaattatttggtgatatttttccattcttacatatttgacagttctgtttcaaatcttgcctcctgagcatccccacctacattggaaggattttaagactttcagggaaaaaatgtaattctcattatatctgtctacaaggcttcttgtggtttcaatttttcagagaaatacactataggagtatagatattctaccacaactctagagaaaattttatatctgtacatattatccatttgaatatgcacatttaaaattagctgacaaacatgtgtattgaatgttagctgataaatagatctttagtgtccatctgaaaccaaccatgcctattacctaccctgaacaaagattggcactagcactttttatttcaatttatattgtaaaaaaaaaaacattgggataaatagaaatggtggttccttaatgataataaccttaatcttctcaatattaaaaatatgtattaaatgcaaagaatactgaaaaattcaattagatacaaaaaaacccaactcagaatgcaaataatcattcttatgtggatttgtcattgattagccacgagaatggaaaggacctgatgttttgatatatgccaaatcatagttgtctgcaacttttagcttcccatgccaccttctgtctgcccctctgcatacacacagctcagaaactaggtaatattttagcacactatatttttcattcttatacatgtatacaatgtatgtcgatcatattcatttcccactctccccccccccgcaaacttttcttagatccatatctctacccaacttcatgtcctttctctcgttatttttagtaactgacaaagtcaaatttttgttgctcatgtagtcacatgtgtgaagtcatctactagaacatggttaaactgcctcaaacttaaagaacatatttattttatattattttttttacgtttatgaaaacctgataggggtgttattaaaagcttggagttggggctttcttgccttttttccctcaaatttatcttcctttactgtcttttgtttcctctatagcctatattcctcctttgttgattccccttctcacttaattgtctagctaactgatttattactagatttcaagattgtgttgtcttgtccttaaatcatttaaggcattttaaagcttctgtccttgacaagaccgtgaagtttttgacagctcatacctattattcccttcctcgctgctcgggtacttgtcatgcagactgtgagctacttcaggaaagcatcacgccatttccatctttgcctctctagcagttattgcagaatctgtcagtggagatagtcactacagtaatcattggatgagtggatgagtggatggatggatagatggaaaaatagtgtgttcaagaaaagttatccagctgattaatggatttcattgcactatccaacaaggaataactagcaagtattaataaatcagttacgaatggtccttgaacacttacctattatactcagctattctgggagtagttgggggtaagaaactatgggtctagaattgaacattgattgtgtgtataagccccaaatgaaacataattatcccattatttgggtttgtgtcaatatctgtgtgccaactcaggtaaatatttttttctagcacaaggggtgaaagaaattggaggcaaagcattgctattttttatgaagcacttgttctaggtttatggaatagcccatgtattagaacttgtcatcagttgtatagtatcttctttcttctcttacccatacttttcatccaataggaaaggagtttgagagacatcatgtcttctagtgaaatttttgaaaccaattggtggaagactagtggggaaagattagcatatgaagcatgagtaatagtcaagtctttttgtcctttccttgttagtctcttcttccattttaaggtctgtagccttccaaattctagtgatattcccctggtacctcttaggggaaaaattctgcttcaataacaataacagagcagcaaaaatgaaagatggaaatgatcataatagcatgggcttgttgccccaacactgtcagcctctcaacagccaaccccacagagttgccctatgcttgtcaatgagaagataaaagggatatggaggagacattttatgggaccatttcagctgctcattttaaatacacccttcatcaaatatagtgagctgggacttagagatcacagacagctgggctgcttgaaaaggaaaaccatattatggcaaattgtattattgtacatttactgagttccagggtgtctggaagggactctaaggtccaagggaacatttcaaagcagtgttttgaaacattgccaagctgaggataagcccaagggcagctaatgggttcagtaacatgaaactttggtggctgggaatttggttaggggctagaatagatatttttttaagatatgcaatacttggcaagcgacacaaaatgcatattttttatgaaaagatttggaaacaccactgagtagactgtctggcttcagtgaagctttctagtattgaagatccattcaaaagcagatgtctaaatctgtagttttatgggagcacatcatatgtccagcatcattcactcagtacttgtggtagcaccattcataagttcaaaggctgagaccaagaaattgccctaacaaggctcaggaaactgggttttatataggagacctgggaaaagcatgatgctactgatggaaggaatttagggttgccagaggaagagggcagatcaacataaagctccataaagcagatcatttaattatgtaatgcatgttaacaaaatggggcacatgctttattgaagctagattgccataggcaacctacttgcttaattgaaaaggaggaatgtctcactgggggtgaaatgttagaaattctgttcaacccactaggaccctgcttatctccatgttaagtagggagagcttgcagtgggaaatttaagagatggaagattgattagataccagagactgacctctcctcatctttacacacacacacacacacacacacacacacacacacacacaaactaaggttgtatcctcaagactaagaccaaagtcactttgaccccctaaatatatagtcttctcattcttttatgtatgatgcttatgatacattcatcatgatgtccttgaagctatagattaccctgaaaatcccaattactacatataaccatagcctgcttctactattaccaccatgctttgattctcatgccattccttgcttgcttgcactcttgtgtctataagaactcactactaactaaaatcctaaattaatctagatggcagtccctaccctgcccagtttgcattttctgttaggaatttctcatcagttgatcacagagccccacagttggtcatgctctcttggagtagaaaagagggtcatgggcttagtaaaatgaacacatgtggcttagcaaaaagatcatatatttgatccaagttgtgaaaacataatatgtagggggctagcatggtctctggcaaagtgttcaagtggtagtcattattatgattaaaatgaaggaaaaatgtgtgccaaaaggactaaacctgtctagatagtctggatcactaatcaaatatcaagagggacataggaatgctaaaataacagggtcagacatcatccatggtggtatatatctgtattcccagcacccaggagacagacaagaagatagtgagttcaagggcagccttgactaaatagtaatgttaaggtcaatctgggctagataaacaccaaagagaacaggaatgtttactaaatgattgaactgggggaataggaaataatgaaagttcctacacttcagtactgtagaagttaggcctgggtctgccttccagccccatgctcccagagataagactcagactcaaatatgtttacaaatacgttgaccatatagctagactctcctatgactatatataacttaaaatatcttaccaattctagtctacattttgctatatagttgcttacctgtgctcaggtaccatgcatcttcacatcctcctagcccatctcctgcctgcctctgtcctataattctttctcctctgggaagtaccaactcccagttcctgcctaagccattggtcataggctttttaactgataagtgatgcatccatatactacacaagatattctttctacaaagcacaacttctcagtgtttttatttgaattgtgcaagacctcttgcctctctgtgtaggagccctagatggttttcagtgccttactgggtttctgggacacttccaacttcaggaaaacagtgcttcatgttgaacactattaaaagggagcttattgggatattgtctgattctcctgaatagtctatgatcttcctaatttacccccaactccttaaaccaaactcatccatgttaaatcagttgttatagtgcatggctgtaagtgagccccagcactgaagttgccaaagtaggaagaaagcctaggaagaatgcaagaccaggaaggactgcatgacaatatcctgttcaaaagccagacaagaacaactaacccatcttatgttccatacccttaggaccgtggccttacataatgcaaaacctagttcatttttaggtagtaatgatcactaatcctagagcatctagatgtaatattttcatttaatgagccctctgtgccaacataattcagtttcatagaaatttctggaacctgagtaggctggcatgggagctattcatggtcatataggagcattttagtagtccttaaaccataccatgtgggcagttttgcttcagatcattctagcaagttaactgggtataaattataaaaataacaaaaatatgagaaaattgcctactcaacctatgtgcagggcctcccagctgtcactttatttaattatgtagacattttgaacacctactctgaacctggcactgagttggctgctgtggatacaaagatgactatgacacattctgcagctcccagttctatggtccagctggggcccaaacaaaactttgagctgctgatttgattggcaaagaaaataaaacagcaggaaaaaaggctagcagctgttcacttatagtcactttccatcagagacttcccttctaggtttaaacacttctttttgtttcacgcacaaaggcaatgaagttcttcctgtgaaagcacctaatcttagaggtaaaagctaaacacagaggagtgaattctgcacagcacaaattgacattctttcctctaagcaaatcgacattacattagatttggaataggaacccactaataagacatgtttatagcatggtcatacaaaatattagcacagtggaaagccctaggaagaacactgaccacagacaccaggtagtatttaattgaaaatgtttctgccatagggaagaactattaacttaactttaatggaatttttaaatgtccacaacaggaaaaaaaaagcaaacaaaaaccttagaaacaaatggcatacctttggccacatatccataaaatgaaaaggggatctgagctgaatgagcttgaataggtattagtaatttctttactcaatcaaatttcttgagcccctctgtttcacatattgtactgtctagattatgataggaatatagtggtggtccttactctcatccttattgacagacactaaacaaataaatttattactagcaatatgctccacactctgaaagtcaagtacaggcaactatgagatcaatctggccttgttgaaggaaataggagagatcatggtttaggctaagaaataaaaaacaaagagccgatctgaaaactgggtacaaagtgccatgtggctgtggatggaggcccatggggagagcattctagacactatgtagaagcccaggcagtctaaagctatcccagctctctcatgcttctcctctccagcatgtacattctttacagtagcaagatctccactgtgcttgtttcatcttgattttcagaatcatgagttacagtcatctaagattaacattaaccattcattagaaagtagaaagatgtttgccagggattggagttaagggaatggatgaggaatgtttaatgcatgcacagctttagttttcaaacaaatgagtagtgacaatagtgttgatgagtacgtattaatgtatttaatatcatagaactatacacttaaaatgattatggtggtaaattccaggatctctgtattttaccacaataaaattttaactatgaatttttaaactacgatccctcacgaatgctatgatcataaccaaagcagctctgtaacagccattatttctattctatgcattgtgacttttattttctcacagatttatttgcataagaacatgaactctggggaggtaatgactgtgtttgttttgctcactcgcctagcctcaacatagagaattcttattggcatggaaaaaatgctagggaaatagttggtagagttggaatccaactaaagcagtcttattctagatcagccaatgggaaaaatgcctccaatatctctgtcttgtaggccccatccacttaggtctttattatctcttatctagaagccacagtatattcctaatttcttatcttcactagcaccattcataatcatctcgaggttgcatgactcttcctggcataagatttaaacataaggataagctttgggcacagcgttccaaatgtcacaggatcaatttagtttacatcctactctaacatttgctttctagccatgatgaaattcatgaagtcatggaacttctgggcctcaatttcctcatctgtgaaatggggagccacttggaaaatgacttcttgtcaccgagcttcagtttctggcttgtcttccaggtctcttcaaatgatcttcatggataacaggctgtaaccccagatctccagttcttaacagcttacctcctgtgaaaggagtcccttacaaaaaaaaaatatcttgaaaataggtctgatagcatgagaatttgctagattttcagcttctaagagatctgttagcatgcaccaaatatgcagaaatcattgatgtcgcacctattttgaaaatccattcctactataggtgcctttgtgtctaccaacatcctttttatgcttaagatctagaaatgaagatgagtgaagtgccttctgccagggagttagtgagcacaggttgaggccatgaatagtaagtaattgttggagaagcgttagctttatagagctgttacctgcttggtaagggctataagagcttgtacgaaaagttcaaagatactcttctcccatgtttacttttgcagaaaagcaatgccacaccaaaattaggtagacagtagaccctgtttcatagtcaaatatattccactcatcttcttgttttcttccatttccaaaagtaatacatagggtgctagaattgtgtcagatagtctcttttgcaatccttcctccttgtgagctatcacctacccaaatgctagcacctaggttctggctagctgtcccataatagaactctaacattcctttgcaagctggctttgtgacctcagcaggacagccaatttctagccacttcattatctctgtgctcattgctgtttcacggagcaacattcttcgacatgacaaatgccttcctcaagccactccccatagtttccgctttgacaggatttgtaccctctcttctggaatcgagctcacaaatattactaactctgaagttctgatggtattattataagctgggtggaaaactgacatgtagaaggaataactctccctgggatgggccagttcagagtgagcttcttagaggaagctgcattctaagcaggcagtcagcacagccatcctggctctttgaaattgaataggtggcaatccaattacagcatgtatctgatcatttcatacattgtggaaacacattgagatcaaaagagccttcatttcacaggcatgaaacattcccttccacacttggcctgctccagatgggaccttagcacataaataagacaacatcatctagtaaaataactctgttcattaagagctaaggtatccactggtaaatggcttatgccatcaaaacagtataccaggggataaggtaagtggatgcaaaatgacaaaatcccttctaaagaggcctaactgcattgcaaactcaaatagcaaatatgcattgaaggccaggataattggtcctttatcttctccttataaaaacaaaggtttatttgccctttaaatggtccaataaaattaaattggcaccctgtagtgtgtgctgaatacataatcagaaataggaagcaataaaaaaaaaagagtgagaaagcaactgcatggaaaaccaaaagttggaacacttagagaaaaacaatgtaggaatggaacattgtttgtactaagaccttgttgttccataaagaatcccagagcagccacttgtgaaagctagacattcccaattgtatccatgatacctccaaggcaaaaagctgcctgggtttgaagcacccacaaaaaagaaaaaaaaatgagatggaggcaaggcagggctagaaaagaagtgagtgtctaagaaggggaaatttataacatgctaaaagtaaatgaaatgttcataaaacaggactgcttccttgtattcagaatgtcttttaaaggatattccctgtaatctttccagagctgcttgtgttaagatcttgagagaaaagcacaacaaaaaagcctcctagtacctaagtatgcagcaatccaacctccagcgaaacagacggggcttgctaactgatgaacagaaaacacaggcaataatagtcatcatcataaaccaattgctttctgatttctaattttgatggccagccacgtaaagatttatttaatgagcatcagcgaggtgacaatacacttaggtattaacagaatggatgggagagatggggaattgtgtcattgttcaattatttcttttttggcatcaaatatattcattcatatattcagagaagtaatcatgcctgaaggatttgacttggaaattgcagaaggctttccagaacttgattttgtacagtggctgaggaggtcagagaatgcttcctttaaaatatgtttgctagagcttcatggtgaatggagagagatctagaagtcatctccctacctccacacttgggatacagaggagttctcctgaatatattaagctcgtgtgctgcttgacagacagtttctccaaattttataggggattctttcatcgctaaagttttattttctctataattttccaagacagccaccaaaggactctgcccttagagtgccagcctcaaatgccattattgctgcctggctgggagtacatccagtgctcccatgccactcgggaacttaactccttcctagagatagaggagaaggggctttgggccaaagtggaaacctcaaggataaagatgacagcattgtttcactgtttgaaggagcctaagcactataagaaaacggatttttaatatcaacttttccatgtaaaagctcaagagacaactagacccaaacagtgtacagaaccaaaaaccacaaaggaataaaagaaatatactcataattgcctaatcgctggcacagaactttgaaccctccccctgaaagggcgttttccatatgacttctggagcatttaactaagtacaactataattactactattcctataataatgggtttcccatagatctttatattttatattcattatggataatacacaaaatatctctttagggtatatctctttagtgtccttgtcagcatgctgacaagaagctggagctcagaaaagggtaaaatggtcatagattgagtcagcaaggacttaggaaatagaactggagaattgtgcctctcagtaccaatttatgtcatcagctctttaagtgcctaaagtatgaagccaagtattcaaaacctgactcgaaatgaacagagcccatttcctcactcgccaaagacatcttgatcaccagtagaagcaagcaaacctcagctaggttcaggcatgtgactatcaaacgtgggcatggggacaagggcttctgtcactcagcaaaagcatggatctcttagaagctgagggaactgagggagcctaacagagaagaggtttcagccgggtttctgaagatgagagaaagtgatggtggcagagacttgtgaaatgccacttcatgcttagtatgcagcaggagcagatggagaaggttggatcagctgatggatcagctgaacctcaaagcacatgaggaagaactttgggagataaatttcaatagtccctaagttttaataatggggagccacataatatgaatcaaacacatactactttctcaatacttattacatgctattgcgtgtaacgtgcttcacactcttagcatgaattttaagatgaaaggttttttacacgacatataataacaaacaatatggaacataggacccaggttcagagtcccaatatctaaaacaagatgcactgtgctcagacgtctgccttgaatgttcttagacaacctccgaggactaacctgagtgtattctttatgactgaatatgcagtttctctagggaaatgccattgttatctgaaaatctgaaacttttatttttccccccatggcaattctcaaggaaatttcagaaccctgattctccttcatcttagagcaaatggacagtactggtatggtcagatatatccttagatagcacacaaaatttacaagttcatacatgactgggcagccaagcactagaggggctacttcttttgtctgcagaagaaactacatgctacaaatttcatgtgcttacttaatgctagctatttctagctatttttagtcagttgcttccccatggagcaagttaggtgcttcctacgatacacacttcctttaaagccgctgaaggagattcagctgttctgtactgcagcaggaggttagagtgggaatccatttaaatgatgttctgcaccagtgctttctcttctcgcttcaccaatggattgagttctaaaacaagatgtataacttggcagacacacatgtggcctgagtaccagagatgctagttaaagccatatagctaggctagaactgaaggatattgccacaaggaacctaaccccatcgcatgcaaatgtgggaatatgtgctcaccttctcaactccacacttccctaattatccctaactgagccaaaagcagaagaaagccctttagctctcatcatcgggtaccagttcgatgagattctaaggctgtgaggagggacgcattcagatggtgctcatagggtctaaggaagcgtgaggaactgcgagaaccgaaaaaggaataagatgtcacctctcccaggccataagcagtgaagatataaatcctatagaggaaagcagtgttcagcttgggacagagtgtggtgagacaatggtgcaagaagataaagaaaagcatttaacagatgtgttcgataagcagcacttcagtttcagaaaacagtatttacttttgccatatagatagtctttagcatttttcgttctacttcatttattttttaaatgttaggtcatgactcactataatgatttcataagccactaatgggtagtatcctgcagtttgcaaaaacattactgtagggagagggaaagaggattagttttcattcgttgttgccattctccctgaactatccaactttggcctgaaacaaaccaaaagtgtggatgatgaatacaatatacacatgcacacacacacacacacacacacacagagagagagagagagagagacagagacagatacagagacagaaagaggcagagagacagacagagaaagagaaagagagacagagggagattaagataaacacagagaagagaaagatgaaagtaagtgtgaggtggggggtcatgactataagttccattcaggaggtcttttcaaggggaatttatgtaaatattcccagcagcttgatactgctcaataaacatatagtttacaaagtctgctgcatgttcatgcttaaggcacataggctacttgaatttacatatctgatctaaccatgaagaagatcagaacctacctggtggatggcagtggttgttgctagctgctttacccttctcctttgtctctaccacaatagcattcagcattgttttctcaggcaaaatgctcctctactgagatatccctaaccagagagacattcttctaggaggcaacctacagtctcagatattttctgattcccctatgtgaactatgttctatttattctcttaatgtctggtctgtcagaagttggctgcaagccaatcatactgtaaaagtcctatgtaattcagacttaaatgttcatctcccaccccacatttacagctttatggaggccttcaccatcctagccaccaaaaatggtattttcaaccttatagtaattgatagagaagacaataaaagacagaaagtattttccatggactctcataatagactacaaggctcctaagttactaactgcctacatattggcagctgtcatccatccttagaaactatccctgtcctcaacaaagaaaaatatgaaagcagccagtacaatgcctaaaacagagtaatggttatgtacatagtaaattagggtgtaaacattgatataagtagggttaggggacaactttaataggatctattagtctagtactatctatgatgatggaaatgtttcattgcccactccactagctgttaaccacctgcagttatggaacacatggaatgtgtctaatgtgaccaacaaagagaatctgactgtatttactttaaactcatttaacattaatattttaaagtgtgtgtgtgtaagagagagagagagagagagagagagagagagagaaagagagagggagagagagagagagagaatgtgatgtgagatagaccacagagcacttatggaggtgaaagggtaacttactggagtcagttttatctctttcaccttcacattggttccagggattaccctcagaccttcaagctgtgtgtccaagcacaagcttgtgtagtacatgcctctacctgatgagccagcttttcaacactaaatatttgagacaaggtctcactttgtagttcaggctagcctgaatcccacaatctatatcaggctgaccttgaaatcttattgactctcttacctaaacttctcatgttcagggactgcaggcccatgcccctacaacacctaaataattatattcatttaagccttaaatagtcacatatgatgagtggctaccagactggacaaaatacatctagtcactcgttataagaaaaacattttgagtaacagccactctttcactggtaggtagcattttacaaaagctagagctttttctaaatgatctccaagagccaaaagttctgtcttctaaggaatgtctttctcccattagtcaaaaggctagagaggatatacgacagccaattttagagaacttagttctcagattaaacctaaagtgactgctcccaatgaagatagttttcaaacagatagcaggaaggcctgctgaggctgctgcctgaatgtaaggcctaaagtaacaatgcttctgcctagacttttgaggtacacaattctgcacagaccccgatggtcaagatagtgaaaaatagcttgcagtccagtgaaaaacaacctcttcacattgatgcaagcaatcatagttacattcagtgggccatgcacaaaaaataaacatgaaagttgcagggactcgtttccttcggaagaaaaagtgtttcatacaaacaggaagggggtgagagtataatggaggtgcaaattactgagacacattacatgtatttaagaaattgctaacaagtaaataagtttttgaaaaatctcgggagtctaattaaagtgatcaaaagtgcctttaatttaaactcactttttcatatacatggaaattttttgggttttgttttgtttgctcccttgcttcaggctgttggactacttttaaattatggagattttatagaattctattgaaataataagttgaatggatttttataaccaccaagcctgggaattgtgaaaagcctaacgacttttcaagcgtaatgttccatcaggcctgcatttgttaaatattacaaggctgctaacttaaaaaaaaaaaaaaagtcttctggaaaccagaaatgttgaggactgtggattttaggagttggtcatgtagcagtaattttacctgaaaaatgagcctacaatttgattcctaacaataaagtgtaatgagtcaacttttgatcttaggcaatgacgccaaaaggcatgtctttcctctcagtatcctctttgttttcctctttttttctgcttcctctgcataaaactccatgaaaaacagtaaagatacatggtcagagttggtaagaaattaattccatctccatacctaggaacaggttgaaagaaccaaagtcagttttaatcattcatactaccaaactgcacatgttagaagaatacatttgcaggactaagaagcactagccagagtatttatcaactaatcttccacatcctgggaagtgttggggtgaagaaagaagtagctttcagaacaaaatggcccttagttctttttttttttttttttttttttttttttttggtttttggtttttcgagacagggtttctctgtatagccctggctgtcctagaactcactttgtagaccaggctggcctcgaactcagaaatccgcctgcctctgcctcccgagtgctgggattaaaggcgtgcgccaccacgcccagcatgacccttagttctgttatcttcagcattttgtctataacttagataacactacccaaaatgatcttatcaaattttcagatgacagagagcaaaactgatttttatttattaaccaaatcacacttttaaattacccccatgaaggtgggtcaaaaccatgaggatatcttaaagaaattgaagtattttaaggacaaaaataaaagaccttgtatatccatatttgtggggcaccagtcatggcagaaatcctttatatgtatgtaagtgtaggagaccatggaggccagaagagggcattggagtccctagagttggagctacgggtggctgttaactgcccatcatgggtgctgggaacctaaatgagatcctctgaaaaagcagtatgtactcacaaccactgaaccatatccagcccccagaaattcctattaacgcataggcttatacattcaagacctcaaagtaggagtatattttatagaaccacattgggggcttgtcaaaaaaaatatcattagcattctaggtggcactgacaaatatgtcttgtgtataccaaaatggaggtgaaacatcattttattcatttacttgtttgctttttgataggttcaatctcactagcacttgtaccccattttggctacaaacataaggttttgacaaaccgtaacatattcagaggaagatgcttagagtgatgatgtgcctggacctagacccatgttatacatcaaaagaacagctggtactaggggtaattagcttgaagaaaaggtgttctactcaaatctatagatgtttggtggtctactattagaatatgaagtaaatacttgacctttggcccctgtctctagaaaagatcaacagttagtggaagttacaaggaggcagatttatgctcaataagatgaggatatttctaatagaatcatctaaaggtagaattctgaatgacatattttatgacagggtgagtttataataatcagcagtatttaagaggatatggtatgaacagaatttcaaggcctacatggatagcttaagtacaggaaaattctgtctcaaagactgtgtgaaagaattcaaacagaatgggaagtatacatgcaaattcctaaccggtaattggactaagtattttattactttatatcatttctaaattgtgaaattttcaaacctatagaaaatgacataacaaaataactatggtttaatttttaagaattgcttttatttggagacctgcctcactttctctccaacagtatgagctaccaagtgaaataaatgcttttcgaatcatttatggcatgttaccaagtttgaagctcttatctgtccatgacaaattctagggtttattctaagacactacgaaagcatcctttttccatctagctatagaaattatttcatttactatgaatggatcactggctcaattggtttttcaattaggagtattgatagctcccattttaaaagagtttcaagtcaagatggacccttactatgtatgaggattgacagtgatatgtgctagatggcagagaccaaagctgaaaagaatgaaatcctgtggagttattcataaagaagttgatgattcctgggaactcggtaccaatatggcctactcactgacactcagtaagcaatctcggtcatttttttctaaaggaatttaagttactttcacttattctcttcacaccccaatgaagaaggcaggtcacatgttacaaatgacagatctggaagttcaatgaagtaactggcccaacgaaagtcacccaaagtattcagggttgtcataatagaaatgtttatcatgcagtgggaattcaaaggtcattagatgaatgactaaattaatgaataggcaaacaaaatttaagttcatatcttatgactgggcttcaaatcttgaaccacattatcttaacataaaggggttgatccatttcaatacattcctggacatttctgacattgctaaagaaaggtggtttacagttaaaggtgtaaaatgaattttccagaatacatgcatttgtatattagcactgtatttataagccattatagtgaagtaggataaaatgttgataatgagtgttttctttgttggcagttagatacatgctatgtaattgcagaaataactagttagactgtcagaaggcagtgcactcctgagagtagaacaaaatgcacagaggaattaaccccaagacagtcattaaaccttagaatcatcatctggagaatggaactgacaccttgttctgactcaaaattacatatacccactagggttatggagctccaaggccaaaggccttcaaggctggtgggaactgatctgtataaacccagggatgctataagctaacttccattccatataagctctacctcatccggttccccttctcctccatccccagattaaatttttagacaataaaaatgcaaggccagaaatgtaagtactcatttggtgggctttgacgtgtccaaaataaatacttttgctaagtttttaccataaaatgactctttggggattttgtagaaatctatgtattatcattagatttttttttccctcctactcaggatggaagtcgtcagctaaatttatgattttcagtgtggggagcagataaaagtcttctgcagatgggaaacagattttgaggcattttgagttatcatcactgtgctgaaatggtactcatggaacccaatgaatggagtccacagatgctactaaacatctgattagtgcccaagacaacttgcacgatgatattccaaacaaaatataaatagtgtcaaggttgagcaaacttgagatgagtcatttgtaaagttgcattcattggtccattaacaactcatacacaggaataatcctcacagaaatggatattgagatgcttataatttgactaatcaacccaaacaaaaaggagaagaggaatctaacaaaggagaaagtactgcaagcctgtgcccagttaaaaacactgttgtcatactataagaaagactgagatcatgaactgaaggtgaacagaggataaacatactttatatactttacagcactggttctcaacctgtgggtcacaatcgaccctctcacaggggtcacctaagacaatcgaaaaacacacattgcaattcataacagtagcaaaattatagttatgaagtaggaatgaaaataatcttatgattaagggtcaccacaacatgaggaaatgtattaaagggtaacgacattagaaagggtgagaaccactgttttagaggccgagtagatggagcattacaaaacagcagaacaaagaaataggagagaaagaagaggcaaatatatgctctcttgggctctgtcttgagtgactgggtgagggtaacatgttagaagaaacatggagaagaagagccgattaataggttgggaatgcaaataagaaaacaatatgctcagtctgcgatgccttagggctgtttaatggggagttggaaatgcagatctagagctcctaagtatctacttaaaattcatccacatggaagtaaaaagaggtgaaatgagctgcctagcacacagcaggacctttgtaaatgtctgttgaaagaccattatgctcggtgtaagaagcaggtcagcagcaatgtctttgaaaacatcttcattgaattgttgggacaagaggaaactgagaaggaggattaagggaggtcaagtgaagagcatttctttttaatttatttaatgtgtgcagatatctggcctgcagaatgtctgtgtaccacgtgcatgcttggtgcccacagaagtcagaaaaggccatcagatcacctggcactgtagttacagactgttgtgagctgccatgtgggtgctggaaatcaaacccaggtcctgtggaagagcagccagtgctcttaacctctgagccatctggagaggttccaagtggccagaagttaatgctatggaaatggaaaggagaattttaagaggcagaacttcatcaacaatatcaaatggtgttcaatagtcaagatccatgacatccattaataaagctgaatgcttcagtaggcatatgggagcagagtataggagaggttgtgcaaactgaggattacaaggtttccatcattacttcaataggcagaatgagagacgagttagaaaaacagtttatggtggtattagggatttgggataattggaatctttcagctgatggtcatcctgacaagacaaagacagtttgtagattaaagatacacatttgcacatcataaacattatgccttttctcagtgtattgctgcattattgaatatcaggttaaaaagaaaatcattgaggacttgtagaattgaagtgatatgtgttgtgtggcacttgagaaacctaaaaggtaaaagtaggctcaatcagaggtagtttccaggtaagacagtgcgctcccttcatactgagaggattgatccagagttaccaacctcatttcactgtttggcttattagcttaatatttgctaccaaaaatcattacatccaattcacagttctaaaacaacatacatttgttactgtccaggtctggaggtcagagtctaatataggtcttgtcatattaacattgaggtgttagcaggactgcattgagctccagatgccatgaaaaggagctcattagaatgccttttctgatgtttagagggccctcacattccttagaccatgcactctttctgattccaaagctagcaatggacacttaagtctttctcatatcactcctttaagaaatcactagtctatatgatctcttcaagtctctccaagtgttgtgcttcattgagctgctagaattcaatatactctggcattacataaagaaacttcccatgatccatctggatcagttccttcatcgctatattgttctgcttcatgcttgtttcccatgttaaatcagcaagagacttcagtttccttttttctgcttgattcaaaggggtatgaaaagtattctgtaaatggtccacaatattgttatttggatctttggaataattaagttgcttggcacttttaattatgctttttgaactacgggtggtgtaattagatgctaggctgtacattaacagtacctgtcccaacctttcagatttgggagactataaataaaagtatgacagctgggtccagcttttcttgtcactcaccactgaagggagcacagctggagaactacaacatagtccctaggaaaacaggatgcagtcagaaacaacatcctcaatgagaagaatttgatttttctactaggggagaggtggagacaggtattcctaagagaaagacaagcaaacaatttcatatcataaaggttcagaggccataggccagagatagcgttttaggaagagttagaggcagaggacagtagctcattcgtgagccaaatcaccgggattccttttgtaatctatgattacccaggaatgagactgggaaaagcagagaaggaatggatcagacaggcaaaagagaaaacaagctgtgctacctagagatgcagtgtgagactgagggcaacaacagtggggaagggtataaaagaacctgcggcattaaagggagcaaagcatgccaagggaagaaaagctgactatttgaaattgatatattcatattttatttacttatatcatctattggattttcctgtcaatgatatataagatgtaagaggacagtttctcctccctctaacagtgcccatctagcatatcgtagaagctcaataaacagtttttgagtaaataaagagctagtgtcaatggagtatctctctatacttccatactagacacctcctataaattagcccagttaaattttcacaacttttctgacataggcaccattgctatcttgattctattaaaaagaaacaagctcagaggcacagaagtaagtagcaagtaacttacttaacaagtgatagatgtcagcatctaggcttctattagctactttccccattgctgggaagaaacttctggcaaaaacaacttaaggggagtttgttttgactcactgttcaagggtatgtctataatggtggggaattcattgggccaggagcatgatgtggctggtcacattatatccatagtcacgaaacagagagatggatgctggtgctctttttactttctcctttttattgagtccagggaatggtgccaccaatagttagggtggctcttcccatcttaatagtccaacttctgaatctgcgtatatagcaatggtctacccaaggctcacagaaactaattattctacattaaatcatgcagccaagaactgaaatcaaaatctgcctgctttgaaagatagtgcccttttctctttatgaatgactttagaacattgccaagacaaatatttctcccatcagtgttttaccaagaacagccttctgaaatgtaaacaaaaaagtgggtacaatagaccaaggattcaacaaaggaaacatattccttcaaaaagcaccaatatcaaaactatcaccaatctgccaccggctctcttttctgggtgttagaaggggaaggtagctgagatctatctatgtgcctggactgaaaattaaaagttgaaggtatgttactttctgctaggcaaatacttatccacactgccctagacagctctggattggggatattgaggaaatgctgagaaggcatccctaagagcctggttcataattcattgtatgaccttctacagatacttttttatattgcagattctttatgataggtagtgtcagaccagtagaaatctgctcaataacatgagctccaattttctcttttatatacttatctttctatatagatattagacttttgtacataaaatttcaattctagcagggctggtgatatatgtctttaatggcagtgtttgggaagcagcgatctatgagacagatctatgagaacttgaggctagcttggtctacacagcaagtcccagaacagtcatgcatacatggtgagactctaatctttaaattttttcatttcaatgatttccaacaccaaatactgtgctttgaaaggcaacaaataatgaaaaagctagagtgagctgtgaggaacctaatgagctttttcattttatacaagggaatttgcatcatttctacccctctctctcccgttccaactccctttcagttttatgacctcttctttttaatattgatgttacatattgtacttaaattaaatgaatattaatattgttgtatatacacttatacagtgtgtgtgtgtgtgtgtgtgtgtgtgtgtgtgtgtgtgtgtgtgtgtgtaaaacagattattctatgagaaagttcagtgttacattcaactgtattctctgcaaccaaggatgattgtaagaatctgctctgagaggcgctgctaaggatccctatgtcccagctgttttcagaagctacttttgtgcctgctgattgtctggtctctgggccttctgttcatgctacctacacttattgccgtgaatgaaacaaagaaaatcctctacaagtgtcagtatttgctgaacctttgctttatatgaagacagtagaacatggagtgaaattctcttaacacttgttgatgtccatcatcatgtgtgtgacttttggacttgaggaaaggttgtcctaacatgtgaaatagtagagaaacatacgacacaaagttattcgttatgttacatttcttggattgactgatgagtttctgggtctttattgtattccaaataaataagcaaatttaatgaagtataaaagctctataaattactcccaagtctcaaaatcatagatataagagcaacacagcacttctttttctattagccagattctcatcgctataatttcttttcacttatttgacaaaaacaaattagtcagaatggggttctccatgctgaaaatatgctgcatctcttcaaagcctgttttatgcagggtaccaaggtcttccttttgtgattactagttgggatggagctgagaactaccagttattctctgaatcattttagttgaaagaccatgatcacttgttcaagccttttggttccatgaccattaatagggacagcttcttccttgaattttaagtaaaataagcattttccgtatttccttaaattttaagtaaaataaggatgaatttgaatttcagataaaccacaaataagtttttaatttgaaacatgcatatgttaaagctgatttattttctgtatgaaatacaaatttaattggatatgtatcattatctgctaaaaatgaaagcagataaatagatatctcatacaagcagatatttattagtgacactgttggatttggactacaaggactataagttttagagtgttcatgtcactacttactaactgaaacatttttgatgtccaaatgagcaattaaatagtaaaggtatcagtatttcttggggtccattcagaaattaaatgagactagttttatattacttaacaccgtgcctaattaagactagttatcactactattgattcttgttattttcaataacttctatttcacttactttaacgtttactgttgtctgtttgtcatcattatttttcagtatttgaccttatatcaaagttctccatttacatgattcaacatagaatagatttttccttagtatctcctttcatgctaacagaagggttgtttgtttgtttgtttgtttgtttgtaagtgttccctgttactttcacctttcatcaactagctgctattctatttttttaaatttttttattcggtatttttctcatttacatttccaatgctatcgcaaaagtccccgacacgctccccccccccacccggactctcctacccacccactcccacttcttggccctggcattcccctgtactgaggcatataaagtttgcacgaccaatgggcctctctttccagtgatggccaactaggccatcttctgctacatttgcagcaagagacacgagctccaaggagtactggttagttcatattgttgttccacctatagggttgcaggtgtccctttagctccttggatactttctctagctcctccattgggggccctgtgatccatccaatacctgattgtgagcatccacttctatgtttgctaggccccggcatagtctcacaagagacaggtatatcagggtcctttcagcaagatcttgctagtatatgcaatcgtgtctgcatttggcagctgattataagatggatccccggatatggtcgtctctagatggtccatccttttgtctcagctccaaactttgtctctgtaactccttccataagtgttttgttcccaattctaagaaggggcaaagtgtccacactttggtcttcgttattcttgagtttcatgtgctttgtatcttggggattctaagtttctgggctaatatccacttatcagtgagtacatgtcatgtgagttcttttgtgatgattgggttacctcactcaggatgaagccatccaggacaacccatttgcctaggaatttcataaattcattttttaatagctgagtagtactccattgtgtaaatgtaccacattttctgtatccattcctgtgttgaggggcatctgggtattttccagcttctgcctattataaataaggctgctatgaacatagtggagcatgtgtctttcttaccagttggaacatcttctggatatatgcccaaagaggtattgcggaatcatccagtagtactatgtccaattttctgaggaaccgccagactgatttccagagtggttgtacaagcttgcaatcccaccagaaatggaggagtgttcctctttctccacatcctcgccagcatctactgtcacctaaatttttgatcttagacataatgactggtttgagatgaaatctcagggctgttttgatttgcatttccctgatgattaaggatactgaacattttttcatgtgcttctcagccattcggtattcctcaggtgagaattctttatttagctctgagccccatttttaatggggttatctgatttttctggagtccaccttcttcggttctttatatatattagatattagtcccctatctgatttaggataggtaaatatcctttcccagtctgttggtggcctttttgtcttattgacagtgtccttagccttacagaagctttgcaattttatgaggtcccatttgtcaattcttgatcttacagcacaagccattgctgatctattcaggaatttttcccctgtgcccatatctatgaggcttttccccactttctcctctataagtttcactgtttctggttttatgtggagttccttaatccacttagatttgaccttagtacaaggagataggaatggatcaattcgcattcttctacatgatatgcaccagttgtgccagcagcatttgttgaaaatgctgtctttttttccactggatggttttagctcccttgtcgaagttcaagtgaccataggtgtgtgggttcatttctgggtcttcaattctattccactggtctacttgtctgttgctataccagtaccatgcagtttttatcacaattgctctgtagtaaagctttaggtcaggcatggtgattccaccagaggttcttttatccttgagaagagtttttgttactctaggttttttgttattccagatgattttgcagattgctctttctaatttgttgaagaattgagttggaattttgatggggattgcattgaatctgtagattgcttttggaaaaatagccatttttactatattgatccttccaatccatgagcatgggagatctttccatcttctgagatcttctttaattctcttttcagagacttgaagttcttatcatacagatctttcacttctttagttagagtcattccaaggtattttatattatttgtgactattaagaagggtgttgtttccctaatttctttctcagcctctttattctttgtatacagaaaggccattgacttgtttgagttaattttatatccagccacttcactgaagctgtttatcaggtttaggagttctctggtggaatttttagggtcacttatatatactatcatatcacctgcaaaaagtgatattttgacttcctcttttccaatttgtatccccttgatctccttttgttgtcgaattgctctggctaggacttcaagtacaatgttgaatagggattgcttccagcttctcaccatttactttgatgttggctactggtttgctgtagattgcttttatcatgtttagttatgggccttgaattcctgatctttctgagacttttatcatgaatgggtgtttgattttgtcaaatgcttcctccacatctaacaagataatcattggtttttgtctttgagtttgtttatataatggaataccttgatggatttctgtatattaaaccatccctgcatccctggaataaaacctacttggtcaggatggatgattgttttaatgtgttcttggattcggttattttattgagtatttttgcatcgatattcataagggaaattggtctaaagttctctatctttgttggatctttctgtggtttaggtatcagagtaattgtggcttcatagaatgagttgtgtagagtaccttctgcttctattttgtggaatagtttgtgcagaactggaattagatcttctttgaaggtctgatagaactctgcactaaacccgtctggtcccgggccttttttggctgggagactattgataactgcttctatttctttaggggatatgggtctatttagatcattaacttgatcctgatttaactttggtacttggtatctgtctagaaatttgtccattttgtccaggttttccagttttgttgagtatagccttttgtagaaggatctgatggcgttttggatttcttcaggatctgttgttatgtctcccttttcatttctgattttgttaattaggatgctgtccctgtgccctctagtgagtctggctaagggtttatctatcttgttgattttctcaaagaaccagatcctcatttggttgattctttgaatagttcttcttgttcccacttggttgatttcacccctgagtttgattatttcctgctgtctactcctcttgagtgaattttcttcctttttttctagagcttttagatgtgttgtcaagctgctagtgtgtgctctctctagtttctttttggaggcactcagagctgtgagtttccctcttagaaatgctttcattatgtcccataagttcgggtatgttgtgtcttcattttcatcaaactctaaaaagtctttaatttctttctttattccttccttgtccaaggtatcattgagaagagtgttgttcagtttccacgtgaatgttggctttgtattatttatggtgttattgaagatcagccttagtccagggtattctgataggatacatgggacaatttcaatattttgtatctgttgaggcctgttttgtgaccaattatatggtcaattttggagaaggtactatgaggtgctgagaagaaggtatatccttttgttttaggataaaatgttctgtagatatctgtcaggtccatttgtttcataacttctgttagtttcactgtgtccctgtttagtttctgtttccacgatctgtccattaatgaaagtgatgtgttgaagtctcccactattattgtgtgaggtgcaatgtgtgctttgagctttactaaagtgtctttaatgaatgtggccgcccttgcatttggagcgtagatattcagaattgtgagttcctcttggaggattttacctttgatgagtatgaagtgtccctccttgtcttttttgataactttgggttggaagtcgattttattagatattagaatggctactccatcttgtttcttcagaccatttgcttggaaaattattttccagcctttcactctgaggtagtgtctgtctttttccctgagatgggtttcctgtaagcagcaaaatgttgggtcctgtttgtgtagccagtctgttagtctatgtctttttattggggagttgagtccattgatattaagagatattaaggaaaagtaattgttgcttcctgttatttttgttgttagagttggcattctgtcattgtggctgtgttctttttggtttgttgaaggattactttcttgttttttctagggcttggtttctgtccttgtattgtttttttttttctgttattatcccttgaaggactggattcatggaaagataatgtgtgaatttggttttgtcgtggaatactttggtttctccatctatggtaattgagagtttggcccagtatagtagcctgggcaggcatttgtgttctcttagtgtctgtataacatctgtccaggatcttctggctttcatagtctctgctgaaaagtctggtgtaattctgataggcctgcctttatatgttacttgacctttttcccttactgcttttaatattctacctttatttagtgcatttgttgttctgattattatgtgtctggaggaatttcttttctggtccagtctatttggagttctgtaggcttcttgtatgttcatgggcatctctttctttaagtttgggaagttttcttctatcattttgttggcaatatttgctggccctttaagttgaaactcttcattctagtctactcctattatccgtaggtttggtcttctcattatgtcctggatttcctggatgttttgagttaggatctttttgcatttttttgattgttgtgccgatgttctctatggaatgttctgcacctgagattctctcttccatctcttgtattctgttgctgatgcttgcatctatggttccagatttctttcctagggtttctatctctagtgttgcctcattttgggttttctttattgtgtctacttcactttttaggtctagtatggttttgttcatttccatcacctgtttggatgtgttttcctgtttttctttaaggacttctacctgtttggttgtgttttcgtgtttttctttaaggacttgtaactttttagcagtgttctcctgtatttctttaagtgagttattaaagtccttcttgatgtcctctaccatcatcatgagacatgcttttaaatccgggtctagcttttcgggtgtgttggggtgcccaggactgggtgagttgggagtgctgcgttctgatgatggtgagtggtcttggcttctgttagtaagattcttaagtttgcctctcgacatctgataatctctggaatctgttgttacagttgtctctggttagaacttgttcctcttgtgattctgttagtctctatcagcagacctgggagactagatctctcctgagtttcagtgatcagagcactctctgcaggcaagctctcctcttgcagggaaggtgcccagatatctggtgttcaaacttgcctcctggcagaagttgtgttccactcacctgaggtcctaagatcccgtggattgtgctctggggaccttgggggtatctgcagactcagtgcccaaggtgacccagtgctagggccgactggaagggacttgtgaccctggtcagtccaagttttctgcttccccaattaatgctgtctcaggccctcacgattggattggaacagaagttgtgttccactcaccagaggtcctaagatcccatggacagtgctctggggaccttgggggtgtctgccaactctgcacccaaggtgacccggtgctggggccggccagaagggccattctttaattaatataaagagctttactatctatatgttttaaggccacttttaattcttgaaatcaaaagctctggtcttttatgctggagatggtgctagagatggtagagtaaatgaaaatctttgaaaagcctccctcaagttaatggctgattaggttactcaatgaatggctctaatcaacatcaatttaaataacatgtatagaaagcaagatattggagatatcaagaactcacgttctcataatgtggtgacaaaatgaactagattggtctctacttgccttcctcctacttttcatgttttctttcctcatgttgtatagtgactttactgtttgtcctctcaggggaggatcctaggttctagagttctcttctctaacctgcttattcccatcaccacatatccttctgtctccctacaactaattggacacattcatttgtcttaacataataatggctttaatgattgcacttcatccctctcccaaactgcagacttttaatttaatggcataaaactaaagaaatgagcctaacactggaatgtatggtttcatagcagatatgggagaccatgcaggacctcttaaatcacattgcattatgcccattaatgtctgcttcgcatgaatggaaggaggcactggtgcagataatcgaaagatcatttccacttggtttgggaatgcaccacacagtgttgttgtagctgatttgctttgctaattatgttctactgaagctaatgttgaaattggttcacattttttaagctcctctgggccagaaaagagatggggtagcagcatggcccactttgaaatgaaggaaaactgacaacaatgaggaggaggtcatgaaatgtctctatgtaggctaatgagtccactagatcaatggaataggatcaaagtagaacttggtcaattacacctgggcacaggaagtaaccaattgcctcctgtggttcaatggccactgaaaggtcagccattcccacagcctgttgacagtctgaaaccctctaaattagcagtctagatgaagagtctttgttatagtacaactgtgattgtaccattcttggacatagcaagaacaacacatttcctggtagatacattagcagttagtctgactcaatttgcatccactgcattggctgagggggaaatgaactgaagatatggaaagacaagtttgccttggtggtggcatggctacactaaggggtcactaggtaaccattgtgggaagataaaagagccttaagtgccttagaggtgagcaggaacacatgtacacgataagacaactatcacctcgtcccttcctcagtttctcggcctctgtaaacacagataatatataactaatgccaatgaagatttttcttaattattttcctgttggtcaactagactatggtaggattctatatatttttctagagtcttgactccttgtttctttgttgttctcatttgtttgtttgcttgcttacttgctagctttttgacatggcaaattcagagattaattatgcattgactttctaaccttacaagttgccacaggggacaactgacctattgaaatgtgtttctttctttctcgttgcagtctgctcccagttctccagaggggtgtatgctatctttggattctatgaccagatgtcaatgaacacactgacctccttctgtggggccctgcatacatctttcgtcacacctagctttcccactgatgccgatgtgcagtttgtcatccagatgcgcccagccttaaagggtgccattctgagtcttctgggttactacaagtgggagaagtttgtgtacctctatgacacagaacgaggtaagaagaaacatctatttttctctgtgggtattcatgtgatgatgattttcacactttatcacacatgcatccatttcttctaatagacaaagtataattctcttttaaatttgtttttagtacttagtataaatcaaacattaataactatatcaatggtaattttagaacctaattttccaaatcatatacatatatccccctaaagagtgacttaggttaaacccgcagacattatttttgcaaaagagcaagcccagcaaaactttatttgatctaaaatatataaaacatagaatattattagataattttttatctaaaaatactaaaatttccatgactgctatgtgtgtacatatgtgatctactatgtcacttagtaatgaaagtccaatctggaaagttttagaaaatgaatctagtgagattattattgccttttcaacatacagtaattaatttgttaaaagatacacatcatgctccaactaaatgtattcccaagtccagttgtctatgaggattttctcaatgaaactgagggacgttatcatcatgacattccatcaaacactgttcttatattagtcatttgcctggagactaaatgaggatggtttgggtctttctgactccaggtttcagatttagggaaggaagatacacatgaaaggtctgtcttctcagtcctgaccatacctacagggaagctctttctcctcaacataatttgaaaagttcatttgtccttggaaccccttggttttctttacattcctcttatttagctacagcaccagatcatgtcagggaacacataaacctgtgtgtgcctaagatatataccagcaaaggggattgaacttcaccaatctggatcaagatttgagtgttataattcaagatctgatactagctagctttctgatcttgaccaagtcatcaaggctcacttgaccttggtctcctcacctaaggtgaaccccttttaatgcagaattccatgcctctgtgatttttttgaaagtatgccagacacaagaaactttgtatcttggaacaaattgtaacttgtctattgccagtgagttaatctagtgattctgaaagctgctatctaccctttgtggtgtattccacccctgggacagattcatataaaatatagttccaataggagagagcaaaaagaaaaccattcatgcaacaattcatgaacaacccagaacaatgtttaattgaatgttatactagcttctggttgctttaaagactgtaaaaatgtatcattctagaaatgagagatttcagagacaactacttgtctctatggtaggaatcattgaggaaagaaaaacaggaacaccatgaagtctcaactttaaacaaagaacaacaggtaattggagaaccctgaaaatgggaaaaataatcttctccaaagaagactcccacctatccaatatcaaggagtcagcactgagatcatatgcataatattatattgactgagcaggttgtattcatgtatttaggaatatttttatatatgtcacaacaattaaagaaaaagagactgtatttgagaaacagcagtggataagagtacatgcgaggggctggagggagagaagggaaggaagggaggtaattatagtttcaaagctaaaaaattgtgtgtgtgtttgtgtgtgtatatatgagcaaagggcaatgtaagaaagaggctccatgtatctaagcaaagcaatgttgtttaagtattatttaaaatttctaaatttactcaaggaattttctctggttcaaaacacagagagtgaattagctcatttccatatattgaatatagttcaatatggatcattgtaatttagttttcagaactgaaggttgaaatcagcagcttctctctcgaaactgtaaaaattaacgattatttctgctaatgctataactgcatgcattccaaagaagacccagctcatgcattctctcatcatcatctatctatctatctatcaccatctctgctcattaggtctccaatgtgaaaaagaaggctaacatatatctatgtctgcttcttatctcattaagtagtatgggcaactgttttgtctggcagtgaaaagaaatctccctgactgatataaatctgtttctctcctctgtagctacttaacaggaaggactaacctaatatgtttttgagaaattcattacataaactttaacattaattttcatgttggaaagtcttctcaaggtattattccaaaatctatcacaaaactttaagaattttctattgcccatatgggaaatgaatacagtttgttctttaagattcagtatccttataactcagacaactaaccatccttttctccctatgcaaccttatgagactctcatactactcatttttcattgttgtcaaaacgatccagatccaggactctgatttatcaacttcctttcctctagtactgcttgaaatactctcctttattttgataatgaaaatcatttcagtttttctaaacctatagcaaattgtacctccctcttcattcatttaatagttgtttaagtttacagtgataagcaagacacatatggttcctactgtcataaagactactttctatgagctagtgtgatggctcaatggttaagagcactggctgctcttccagaggtcctgagtttaattgccagtaaccacatggtggctcacaaccatctataaggggatctaaggtcctcttctgacctgtggatgtatatgcagcagagcacttatatattaaatgaataaaatttgtttaaaagattgctttctaataagagagacagacaaaatcaagtaaataacaaattataattatacatttagataatgcactataaaaaaggattataatgtttagacctaatttataaaggatgccaagtgacagccttaatgaggagtggcattataatctgcaactaaaagaattgaaggatacaggctaatgtggaaatagtctgtgaaaaccatctgtagaaattaatgaaagtcaagtgtgggtaacaattagtgagaagaggggtggatggttggaggatggatgtagttggaagaacagagataagaggagagctgtattttagccaatacaaccagggtaaggaaagtagattctacagtgagaaggcattacaagattataagcagaggggtcaaatgacctgatttaagcttctacaattaatggaatggttaactaaggaaaattaacaaagaaaaagagccattgtggtcctgcaggtcagaatgataacaacttgaccaaggctggaggtaaagaaaagtccgagaagtagaaatggtgatgttttaactataccagttttgaggagcagaaatcttgcccacctctaaacacccaaaacccacttttgtccacactattcatttggtgcttaacataacatatttgatctggtatatagcaccccaacccctcatctccaatgtaatagtaaacagttctttaaattacaccgtacagtatttgttatgcttgcttttatacatcaatgatcacctcttgctttggtggtaaaatggtggggagatattataagatcaaaaacaattgtagatcttggtccgggacccgccgaacttaggaaattagtctgaacaggtgagagggtgcgccagagaacctgacagcttctggaacaggcggaagcacagaggcactgaggcagcaccctttgtgggccggggacagccagccaccgtccggaccggaggacaggtgcccgcccggctggggaggcggcctaagccatagcagcagcggtcgccatcttggtccgggacccgccgaatttaggaaattagtctgaacaggtgagagggtgcgccagagaacctgacagcctctggaacaggcagaagcacagaggggctgaggcagcaccctgtgtgggccggggacagccggccaccttccggaccggaggacgggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccagccaccgtccggaccggaggacaggtgcccgcccggctggggaggcggcctaagccacagcagcagcggtcgccatcttggtccgagacctgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggatcggaggacaggtgcccgcccggctggggaggcgacctaagccacagcagcagcggtcgccatcttggtcccgggactccaaggaacttaggaatttagtctgcttaggtgagagtctgtaccacctgggaactgccaaagcaacacactgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaatatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaattccagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacacaatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaattccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcacttttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacaaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacaccatgcccctccttagaagtgggaacaaaacacccatggaaggagttacagaaacaaagtatggagctgagatgaaaggatggaccatgtagagactgccatatccagggatccaccccataatcagcttacaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaatgaaaaaaaaaaaaaaaaaaaaaaaaagaagcacaaggaattctgtagggtcatctggtggtgcgtgacttctgtgttcttcagatgactaaagctacacatctcaaatgaataaatttcattctttgtactttaaaaaaaaaaaacaattgtagaatttttaaattatatgagatgaggaagataaagagagatagaaaggaaccctgataatcactttcaaataagctaaatataccacaccatgactgttctgtttaggtccagggatgaataagaaggcaagcaatgggttaagcttcagaggtcatttaaaagatatgttgcacaaacatggccaattttctctctggcgttatcaaacactgaataaattggtggaatatactgactctgctctaatttccgcctacagacaaatgtctgattcaggatttgcaagtcactgcttcacttagttaataaaatgacatcttgcttcattaatatcaagttagaaaaatatgcatttggttctacatacataaaaggtcagtgcttaagaaaattatgaggttaactaactgtgttacctaccccctctataacctttccttttatcgacttctctgttacttgtttacctagtctttcccacagtacagcatctctatgcctgccctccctgtcgggaataaaaccacatctttgcctacccttcctccacaccttcacaaatcttcatgtcctgcattttgttcccgttgattaatagtctttctctgctaatgacaacacctcagctcaccaatttattcatgccaatttatatggttactaatgacttcgtgtatccaggagaagagaaatttctattcaggcaaggaacttctatagaaatagaaccttaatccaaaaatggttttctttttattattatcgcctttaattggcacacattagttatacatattcatgagatacaatgtgatattttgatacatgtatacattgcgtagtgatcaaaatcagggtaattagcatatgggtcacatcatctatttatcatttctttatagcaaacacactcacaaaatccccttgtggttattttttgaagcatgcagaatgctgttaactatactcatgtttctgggcaacaggatactaaagcccatttcttccttctaaatataactgtacccattgaccaacttctatccatcttttgtccctcagtctctggtaaccaccattctactctccacttttataagtcaactttaatctccagctctcgggtaccaggaatccaattcgggaggttacgtacatacactgattcctctgcatagaagattctaaaaccattccaagaaaatggccacatctttcagttattacacacatggggggggtatatgtgaaagtgttctaaatagtaacacaatctcctccacaatagtgacttacctgagaactgaagccaggctttcttgagtacatgaagccactccttggcttcaatgagcagaccccatggagatgaaagaacctggcctagctgtgagcttagataatgagataatagtctgggtggcctttgagacaactagtggaaaccttctttccagcattcaataaactcctgctgtctccccttctgaatttgaaactccctacccggttctcaagtaagtctctgaaagtcaatagccctttaagagacattgttatcttctttgaaaggttgtgatagaaacagagaaacctataggaattattcttttggtcaacatcaaactgttgagatttctctagcattagaagctagctcagttgtcctagctcagttttaaaagaagcacagttggtctctgactttgacaaattgacaatcctattgtggaaaaaaaaattgaaaccaactgttgccatccctactggtgacatttgcattcatttcagcatggaccatgaaggaaaaaaaaatagagtttctcagagagctgcggtgttggggaactttgagcaggtccttgaggtcttaaggagtaaggagatcccccaagttaaggagggagggagggagggagggagggagggagggggctttcctggggggattatgaatgcttccagcttggttgggttttaattctcctgagatgggcagaagcttcctgttctcacacctgtcagcatgctgacttccacactgtctacaagtcttaacttcatagtgctcttttaccaaataaagcccagattctctctcttccacatctttactgcatttctcttatttttcttcttcttcttcttcttcttcttcttcttcttcttcttcttcttcttcttcttcttcttcttcttcttcttcttcttctcctccttcttcttctcctcctcctcctccttctcctcctcctcctctttctccttcttatttcttcctcttcacaaacatacacacagacttacacagagacagacatacaaagagataaatctgtaattctcatgttagtgtgtgtgtgtgtgtgtgtgtgtgtgtgtgtgtgcgctcgcgcgtgcgcgtgcacgcatgaatgcagtgcaaaagaatttatgctaggcaaacttctaccacttaggtctgtgcccatatctcgaaaatgttttgtttaggaaaggtcacattaagttgtccaggctggttttcaattttctctgtagcagctcagatagaccctgaacttgcaatcctgctccatcgtcttcagtagctgggattactgacctgtgcactcatgctggggtatatcatattttaaaaataagagcagctgctatttcttaagtatttaacatatatactaggtcttgagtttatagattatcacattttatcatggtagcatttatatacttctacacctgatggaaccaaggcagaaaaaaaaatcaaataatggttcttagacttatacaacatcaaagtaaggagagaaaaagtcacgtatcaccctaggtctgccacattttacagactatatgctttgctctggctagcatactgcttcccactgtctaaacatttaaaggcagcaagtaccccttccttcaattttctatagcagttcttcaaaggacactgtacttagacctccatacttcaattgtatctgtgtagatgcaatccagttctcaatttacttcttatattatagtgatcacaaataagtacaatatcttttttggcacaagaataccagggatcaacataaacagatggtcatagacccaagttcaagggcagatgagtcaaaacgatggaagcagagaaaggacaatattgttgatgcaggcagaatgcaggtttggaatgaacagctgtggtgaggcatgcatttaaagcaaagagaactcacacatccctctctgtggctaagatagtttctggaactcagaaaaacaagaatctaaaagttcatactgccaaggggctatatgcctagttgtgtcaaaaagcaaggaatgaccaacggtggattataccaaagattatctttccagccaagtgctgtgagtagcaggtgcctccatcaaaacaaatgctgttgctttgttttgctttgtcttgtctttttctcacccacttcaagatttaatgaaaggatatacgaaggtgacagatggctccaattctagtcatgtccatttgccttctgggaaaagtgaagtcaagagtgtttttattgaaatttaagttacttttttatatttgaataaattaggaaggcctggagagtacattatcctgtgagagacagatactaaattcccctgtttgagcagcagtaatcagggttgacaggacctaagacagttggtagtttttgcagcctgcttaatctattgtgatgagtcttcaactatgagagcatctcgagagcctgtacaataataccagtgaatgaatatttggactgggttgtgaataaaagactgtgcatatgtctataatgagggtttcattgaaaatgaaaatactgaagctgtcatatttttaatacttcgatttgcacatccttgactgctttggggcataaaaagagaaagtgccgagcaatttgttgtcagctcttgaaataaattatcatttaaacacttcctctccacagaggttattagcttagtagctccttcattcctggggttggactatcagtagggggagaataaaaaaaatcataagacattaaagtatcctttcaaaagctggatattagttactgtggaaattgttctcttagtagcttaacatacttttgctgtagctctccaatgctgcagattaggctgcagcaactattaataaatactgtcatattttacagctgtcatgcaaagctgaaaaaaggcttcgctgtgattagatcctgtttactgtaatatttccagctcagactcagaaaggcagttttcccataaaggtatttccataagtagaatatttttccattaaatgacacgactaattttaatatagtgttaactccttgatcacagtgaatttgaggtcaaattgatttcacagccagaggaacgttcatctccaaagacacattaaaccaaaccatcgaattttctctcttgggttgtccttcctgtgtggagatggtactcctgtcacaaatgtgctttgaatagccccctccctcttagaaggagaagtctatagagccctgcttgatttcttttcctctgccttcctgtgcccgactgaactgtttgcaagacagctattcagggtttaggataggggtgccttcagtaggctaactagaattgtgttttctgtccgagaatgtcattattgcagcaaaagaaatcaatcttttttttttctcaccacaccaccatcatgctttagcatgatgtttagaactgtatttgcatctttagggaaagaaggtgacagctggcagagttgctcttttgctctgaccttccattgctttcattaagttccttgaggaattaaccctcagtgagctgaatatctggttcttaataaataaatgttcctcatagtattaggggctagctgcaatttgctactatttctaggtttgagcctgattgattgttgaaaaggagacagattgtgtagtaatcttgcaactgtgactttaaggtttgtctcttggaaccctatagacatcaattcaagtgagggtaaagtatgtgaattgcaaaatacagtgtatatagtctttagtatcaagctaaacagagtaacatgtccaattaattttagttcttgtgattttattatactttcaaaacgttacccctcattggagggagaaacaaattctgatccctcaggggacatatgacaatatatatacaaattttagtagtatggaaaaggaatactgttaaacatcctgaagcgtacaaagacagcatcctctcccccagcatggaagtatctgctacaaaacgttggttgtaggaagacactattgagtcaatggactggtttctggaactcttcaagagaccggttatgaaccaatataccagtaattgagagtttcattttatctatgttgtcattaacaacaaagttcaatatccactagtctttaattatgaatagtttacatcattgacaaagagatgagttaggagtaatgcacatgaaacaagtatgaactagcacaaggcaagagctatattgtgtggaatgaatttcaagccccaagggatactaaagaagagagagttgctgatggacaggctagagctatcagggaaggcttcatggaagaagctatatttctgagccctcaatggaactgcttcacctagaaccaaaacaacatggtgtttccatcaatgctctccaacatcagagatcaggacaagatgtacaattaaaaaaatgaaaagagagcacagtgccttttacaaaacagaaaacaattacagagctgttgaaaatgggcaataaacaaagaacgggagggcgctactggcaaaattccattttctcaactaatgctccagcaagagtgcaatttccagcaaaatcaacagagctctctccccttgtctatcagtcaaatgcattgtttgctagcaccatggctgcacaggatgcctcaactgaaaaaaaaatttaaagagcaatacagaatatgatatgccaaggaatgggggcagtgggggcacgttagcatggagcccagcttgtccattccgaaaattgtctgtggagcagacaaagaagaagaagaagggactcaaatagtaaaaagtaaagactactttacttccccattttcagggatccattccaatcaataagttgccagtgtcagttttgtcgactccacaaaggatctgatgaattctctggtgctaactgcctcagcgggctttctcagcagtagaagggaggctaattaagatcatgtcaggcaagaaggctgacaggttaggttcctgggccacattgaacttttagaaggtgttgtttcaacttcactgccgacaggcagcatttggctaggcactgatttcatagtaggtctccagttcacttccacaggtccttgcatcaacaggcctccgttttgttaaggacttacatccttctccttggggtaattaagcgccagtgtgtttgctttcaattgcattactctggctctctttcatttgaatttttaatatgcttgtaaacaaagacaacaattaatagtctggtcattttccctactaaatcatgtgtttgtgtgctgagtgtcttaccaacatacagcatctagaggtgagcttaggacaaataaaggtagctccgcatctcacagaaggtagaaaatgggagaggcatatggaactcattataccaagttgtagcttagactgaaaatataaatagcttcccctcccccaaataaaggtttccattatttcacagataacggatctacagtgagttattaagaacaagagagatatttggagggttttttgaactaaggatttcacaaattacatagtagattgttttttgagcccatatttatattctcataggcatacaatcatatgcaatgctggcactataacccctaagatttaacgttaggagtatatcattcatctcggctgtataaaggaaaggaaaggctcagaaatagatacatgttatccaggaacattctgtctcctctcacataatcagggtttctaaccactgtcaaaagataaacacagctggacacccgacacttgagcagattttagtcagtaacatagtattgcaataagggaaggattcagcataaactgaagtcatcttcaattcttacaaaagttcctgggtacttgagagaaaacgtgagtaactgggagaatgtgagtagctgtcctcaattaccgtgtatgtgaaagatccaaataactaagaaagcttgctccacagcaaacccatgcagttttgttaagcagtacctactgaactcagcctccggctatctaatagagactgggccacataggcattatacttaggtattgactagatcaaatactaaattcatttttcaaccttgaatttctcaaacagacattttagaatgggctatgatcaccatggaatgtggccttgaactgttggaaaatatgtctgagttttgctcaagttctactaggccaagcttgagacctcctcaagtagaggtcttagaggagcctgagcagagtttaattaaggacagaatctttgtagccacacaccaagaacaccctgttctaagggatgagtggtccagttagaggcatggagagaatgactcatcaaaccggaactctggttcgaagcccatctctgtcttaaaatatcaaattcaagttgcatgtccttttgagcccccagtttctacatctgtagaatgaaggatgaattctgacattctgcaattaaaattgtccatcagtgcagggttatataagtgaaggaaacagggtgcctcttcataataaactcacagtttagaaagacatcccagatatgtaaaccaatagaatctaacacaaatgttaagtgatgtaaaattctggaagctattatagcatgtcttttcaaatgactattcttcctgggggttgaatacgcaaataactatctacattgactcctttaactagtcagagactacttaaggcatccaaatgtttcctatttggtcatctcttagtggtcttaaaacatagtctcacagtcattttcaatatctatgtttcctgtatatgaaagaaatatctcttagtagaaattatacaagaatttctataataagaggtgaagaagctttgttgcttgaacatatcatttcccaaagattcaaatgcctcactaagcagaagagttaaaaattcatctgagttttacagaggctatgacccattctcagttctggatctctgcatttaatttcccctcaaccatttatcttgatgctctatctagacttctttttccccagaaaacccttctgttccatgtactttttttcagaaatcctatctttgagtcttttagattcattttaggcatttgaatgtttttgactagatgcatatatgtgtactatgcgcctagtgtctaaggatctcagagccctttgaactagagttatggatgattgtgggacaccctgtgggtgctgatactcaacctgtgtcctctgagagaatgactgctcttaattactgagtcatttctacagccttgaaatctcgtctttgaatgttccactagcatccttcacattccaccaccatgaactctacactagtactctataattgtgagcgtttcaatgtgccacatggaagacaccctttatggctttagtctcttgcatgtagcatttgctttctgtcatttatattccttactcgatttccatccaaaacacacacacacacacacgcacacacacacacacacacacacacacacatgtatgcacacatgcacataatgaacatatacacatctatataaaaatctggaaaatatcttatccttcaaagtcctgctcaaatagtagtccctgcttactgccctctgccctcctagttatttgcctatacttctagcacagcattaaacataaaaaggtattattattaatattagtagtatttatttgtttacgtgcttatcttctgaacaataccaccagcttattgaggatggggttgctgacttgttcatctctgcaagtgctatattaactgctgagtaaatcatagtgattgattgttactattcagcaaatgaatgagggaatgaaataaccttagctataaacaagatgcagaattacataggctttggagatataatgaaggtcattgacatgtgcttaccatacagtttgaatagaacatgttctcagatcatgcgttggatagttgtgtgcctcctgtatactagcctaaacatgattttgagtcttcctgtgacccaacctccgtaccaaatatatcacattcctacaccaactgagaagcaacacagatatttgaatgctagcgatcatagttagaggctctaggtaatggacagattttcaaaactcttcatggttcctgaacctcagccaagccaatacaatccattcattgaggactctcaagggctaggatgtagctgttgcactacttcattacaaacttcatgaattctctgaatatgggagtaaaatgatattaatctccacagatccaactataaaactaaagaaagaaaattactttaaaatgtttgtgtaggtaatgctacaaacacaaaatagtgacgtgagagccaatatagtccattcttggttatccacacaagaggcaagccagacgatgatcatctaaagggcattttttgtcagaataaaagagtgtcttgtaaaaacagatattccctttggattccaacatagtttgattttcctgagtatggaaagtaaaaaagatagtccaacaaaagggattttttaggatgtctctttgattataaattccccatgtatagaaaataccatcctgattgagtaacaggatgtataggatacaaaatcatggtctatgaaaccagaattaggagaagtaaacacaaaaatgaggtagtatcaaaatctcaaaagaaagagaaaaaaaaaaaacacaaagaaatgctgcacagtactgtacctgaaagcatattggctaaggaatacaaataaggaacaaagataacgagcaataaacacttgtaagcttgataatttttgcagagaagatttgatataagacattctactccctaagaaatttgaattctgtcaactgtaaacttcccagttcccccaagcagagggccgacatattccacagatgcactttatgctactgaaaggctgagccaaggctcgcaaagattaatcaggttgctttcttggaaagctctcagcaggagcatgtacttcctgaatatccgaagaagtgttgcttgtttccactggacacagatcatagaggggaacaggatagtactatttactaaggctacccattctttcatagttttttatgcctttcaatagcaaaaaggagtcatgatttatcgacaagcgggaaattttcaaaagaaggaactacagctttattaagtgactttttatccacctagcacagagtgaaatagtaacattaaaaattttattagacccattaagctggaaaggctttgaaagttcttaggtctgaagtttgggattctaaaaaatgaatcagctccatattttgtcatgttcacgagtctcttaatctgtaattctacttaaaaagtattattcttttaaaaaatctaaaggctattcccagatctatcacattgagccttttgatcctgtttcaactattttatctgcataatgatagttatatatgtgcagtgtatgtatatatatatatatatatatatatatatatatcttatatatataagaatgacatgatgtaagctaaaatcaaatgctgagtataagcaggccatttcctaagctaaaataacagctctgtagatgagtggttagggtctgagaaaggctcatccttttgtgtccccagaatctaaaatcctctttgtaaggttctacctaatcaaattgaaagagttagcaagtgcaccttcccgtgttcttcaagcattcacctacactggtaatccaactagttctattcatctcttctgttgattagcaagtcaacaagatagtgcatcaaatagaaaaaaacctacaaatgattaccaagcaagtcattcctatagtaaacatctcgggccacatcatggctgctaagaaaagccacagacactaggccatacattgcatgtgtgcttactcaccttcaaaatggatgccataattgtccctaactcataggattgctacactggttacacatataaaagatacctaggtcagttcctggcccaaagcatctgtaattgttagccattgttatgaagggcttaacagggctataggcaagtgatgctgccctagtcttggattatagtgccatgatgcccatcctttcattgtgctaattttgattctactctatcagaatcagaacgtgttcccatgaaaagaggttggaaacacacagtaaatggaagaaatggctaatagacaatgggctcagacatgacatttctgtaagtgcagagagcctcagccccccccaaaaggaagccctgtttgggggatggctagactggtgatcaggaagtaaggcttgttttcttcctgttgtcctgacttcatagccaaccttccatctgttcctcatatgactaattgtaaatctattgattaaaaaataatattgttagaaaagcttggaacaaagcttttttgagggtttactcagtatatatttaatagaataatagagtagaaatggcattctcttcatttatatccaatagaaatgtttaaaggtaacttaacctgagcagataacttctttacaaagtactaaagtcactgacacgatccaaaatatacatatgcattccttcttaactaagctgtcacagctcagtgtgtgtgttttctgattttttatatttacttattcactttacatcactatcatggccccctgcccctcctcttctcccagtcccaaccttacaagtccctcctcccataaccctctacctttctcctcagagaaaggggatcccaccccccttgagtaccactccaccctaagacatccagttgctgcaggactaagtgcatcctctcccactgaagcccaaccaggcagtctaggaaggggaataggatcgaatagcaggcagcagagtcagaggcagcctccactccagttgttaaggggccagcatgaggaccaagctgcacatccgctatgaatgtgtaggggccctaggttcagcccctgcatgctcgttggtcgatagttcggtctctgtgagctcccatgggcccagactagttgactttgtaagtcttcttgtgttatccttgacccctctggcttgttcaattctatcccccactttttcataaaatgcaccacatgatgtttagctgtgggtctgtgcatctgtttccatcaatagctggatgaagcctctcaggagacaattatgctagactcttgtttgcaagcagagcaaaatatcattaatagttttggggattggttcccttacatgggctgtgtctcaaattgggccagtcattggttggccattccctcaatctctgctctatctttatctcagtatcttgtaggtaggacaaattttgggttgaagttttctgacatatttttaaatcttcctagactatagtacataataaaccctagaaattagaagcaaagctcagtttgcagtcttgcatttgtttggcttaagctgctgcatttaaattagaaagatagacaggtgtggtggtatttaatcccagcactcagcaccagaggcaagcatatttctgtgagtttgaggccagcctagattacagaaagagatccaagacatccagggctgttacacacagaaactctgtatccaaaaaaaaaaaaaaaaaaaaaaaatcaattaaaagaaaattaggaggaaataaattagaatgtagttccaagttcccttccggattctccctgtgactacagatcaaaccctgaagtcattgccaaacagctgcatggacacagtcatccggctgtattaacctgaggggggaatataatttgaaatcaaagaacagatattagagaacatgtaggatatcattttgtagaagataaaaagtggattattttgtggtttaaagtgaacagatacaaagatgtgttattgcataccttcattaataaccctcaaagatctgaagccagtgtcctccagactatagcttctctcacttgtttttattttattctgtttatctgagcctgggttcttgctctgcagaccagggtcattttctattcacaatctttctgcctcagcctcctgagtgctaggattacaagtgactaccattatgcctggactattcctaccaagcagattttctgaaatctacagtctactagccatcttttcttaatgccgagatgagacaatgggtctggtaatagcttctttttttctctaaggcaaatcttacaattcggttttcgtggtggcatacatcagctagctatatgatattgagctacaaacctctttgtgtatctgtaaaattgaaatgtttattagtatctacttcattgagctgctataaaaattaaataagatactatgaacatgattagcagagtatctgattaaaagaaatatgctcaataagtggtagctatattgcttatgataatgcttaaacttctttaaaggcaccaatattaaactactattactataatcaccaaccatattcataaataaaaagaaggaagacacacaaaattggggctgtcactgaacattctaggtgttttatcactatatctatatgtgcaacttcctctcagtttaacaaacgaagaaatggggaaaatataaaaataggaaacaaaggcaacattcttcaccctataattccccatagcctctaataaactacttgaagctttggggatctgatttctattcttagcatgtatatattttgctctctgtgtgttccaacacagaattagcaaaatatttccatacatatttactctcataacctcacccaatatgtaactttgataccaagaaatggtttaatgtgagtctactgaaagggaagaacattcagttattctaattaatactgttcaaaagaaaacctaccgttctaaatacttcaaggtactgtccccatgtattgttggtttggaaatgaaataaatctatgttcccaaagaagagaatggtttgcccaaggttatacagctaataaaaaagtaaaagcaagctggactagagcccaaactttcagacatcctttcgagaaatcgttcttctccatcagactgctacatacctttaaggcaagggcttattttcttaaggactatgaaagattccagctttaggggaaagtctgagtgctaatgaataactagttcctcagactagtatctaccctggatggaacactttttatgtgccaggctctgcagtaagcctccaaaatgtatcacctccttcgatcttcagagtagttttagcagagactgactgccatggtccttcttttacagatgagacagtagaggcacggaaaggttaagcgatttgctctcccatcactcttggaggaagtggtggagctagcggtgtgcattctgcctcctcttctgtttaaaatgttcttcctagcactccacactgacagccaccttcagctctcctattcacaaggaagaggtgttatttttaaagctgctttgaggcagaaagataagtggtactctctcagttcctcatactgatagaagagagaggtacacaaagaaagcacatcttgcctaatatgaaaggcagaaatttgcaactctgaaggagatgtggagtctagtagagaggacttggtaggggaacattctctctcctcactctccggtcggtcgctagtcacagctggttcttaaccaaattgaaatgtgaaatcacagttgccaatttttagctttttcccactcctaagattctagccacattcctacttaacccacatccatcacccaaactgccctgtttccttttatcaagaactctatcagacagctggagccacatccaatgcttatagctaaggagcacaatggcccccattttagtgttattgcctttctttttttttaattagatattttctttatttacgtttcaaatgttatcccctttcttaagaagtacctggctgctcttccagaaaattcaagtttggttcctatgatccctatggtggctaacaatccactgtaactcctgtgtgtggtactctgatataaatgcaggtaaaacacccacatacataaaatatcaaaaaaaattgtaaaagaagtcccttctaggctgttacctttaagcatctgaagaagaagcagggccagttagacgagaaccagccagggaagtgttgtcatagctaactcactaattattgaagtcgaccattttcattttcttgccttcatatatcttccccctgaggatacaaatcggtgcaaatcatcctaaagacaggaaaggtgaagctctaagtgaacacttagactgggaaagggaaaaatcagtccattattttaagatctcttgagatgctgtaaatacacaggcaactcagaacaaagatcccttttttcccccttacattatttatgggccatctaaaaattacattcccgttctctttccagcactgagagagaaacatgcatattcatgatctgataaatatttaagtgggatttatttaaatgagagagaccatttacaaacattccctggctctcagatcttatcctgggcacacagagggaggataaatcccactggtagattcaaaacctccgctggccacctgtccccccaaacttggagcttttccttgagaactggtgaatgccacccgcaatattttaagggagccttgtgcaccagctccctccagtcctgccttccttcctgttgtgagtcctgcttccatgtcttagcatccatcattagcaaaattctgtggctggaagtttatatgggggcagcaagtctggtcacagctttctttgcctgtacttttccttatacaatcctcaagtcctacagcaacacccaccactaatagtcactctgcctatggatgtatctcttcatactccaggaagatagttataagacatacctggtaacttagactagttgtctattaagcaagcattttgacattttggaagcatttcagaggtagactagcaaaatggatcagcaggtaaacacgcttgctgtcaaactcgatgacctgggatctatccctatcacccatggtggaggagagaactgacacctgagtgttgtcctctgccctccacacatgtgtcatggtatggaaacacctgaaattatacatacacatacacaataacacatgtgcacacaaataatacatttttaagaattatttatttaaaatttattaaatattaattatataacatttaaatatttttaaataaagcaaagaaaaatacatgttttgttattaccctgtttcccaaggattttatacataccatgctttcatgacctcctcacaactgagttaccaagcatgttgacatacctcacatatcattactaggcagggtctcaagtggagggattgaggcaccaacccagacacaaaacctttgatctacagagtgttctaggactggaatctgacagaattgtcatcagagggaccagagaggcttcatccaacaacagatgggagcagatgcagagtcctacagccaaacattaggcagagctcagggagtcctgcagagaggaaagttcagaggaaccagaggggtcagggacaccaggaaaacacaaaatcaactgactgggattcatggggtttcacagagatcaggggtccttagctgtctgacctaggttttccacatatatgttatggctaaatagcttagtgttcttatgggactcctaacactgggagcaggggccatctctgacttttttgcctgcttgtgggcccttttgctcctgctgccttgcctcatccactgtgaatgtgatagtatgtgcctggtcttactgtagctcattgtgccctgttgggctgatgtccctgggaggcatgctgttgttaaagaggaggcaaagaggattgtatatgggggacagaggaggtggagaagatagattggaaagaaaaggatgggaaactgcagtctggatgtaatacatgagaggtgaataaaatttttaaaaagtagtacatgaaacaataaaaaaatgagtcatttttccagtctgaaagattaaaacaaacaaaaaaaaatatcaggaagatgttgtttgcccaaaataaattttacagtttgtaagttgcagactagagacttgaacacgtgtctgactctaagatctgggatctcagactacctttgagagtgctgggagataaagcaatgataaccaaatggaaagccaatgctgatgtatggacagtttaaccacaggggtggagaagctattgtaaaagagatattctttgtatgagacaaggtctggattctccattccaatatccattcttaggtaccacctagatattgttgtagcacacagttccttctttcccaaaagaaaatttcatctattttgtgtctcatttccacagtttatccaataatcattgaactgacctactaaattagtctgggtagggaactgcttgcttgttaatatctcaagatgcaactcatcccaggtaatatatgtgttttgagagaagtttctaattgcctgatagagggacactgtacatagctaggactgcatgtaaggagccaggccagtgagagataaaactctgagtttctcaggttaactagtttgtactacctaagtgactatctaaactacctaatttagacttgccagattaaaatgtaggtgatccgtcaaaattttattttcagataaacaaaaaggcccattcttatgagtacaacctaaacagaaaggtcatacttaaactagaataccatcattttaagttcaaatttacttagctttgtctgttttgctactatatctggcaacccaaatttaattcaaagtcttattctaaggagaatcaccatccagaagtgactttgggtatctgtttgcttgggacacttgccagtgactaattccaaagcacagggctgagtgactgaaggctgtgagggaggaagagagaaaggacagaggaaaagatcacatggtaagagtggcccttatcgcctctataggacagaaaaggtaatgtcattaaagcattttacacaatagccttatctgcttcttaccaccaaccttcctgttggtgtgctgttttcctctaccatttgctgcccactgatagatgaaaaggcatgcagagtgccattgccaggctctgtgttctcagggagtgaactgggcctcagaagacacatcacaagcaagcagcaagacaggctgcaggctgcagccaaagcactgcacagacatcagagctgccaaaatgtaattaagcgccaagcacagaccccaagggtgatggtgggaagtgtttcatgaccaaaatacagagagagagagagggagagagggagagacagagacagagatagagaaagagaaagaagtacaagcatagatagatagatagatagatagatagatagatagatagatagatagatagaaagaaagaaatggagtgaagaatgcttataagcctaattaacaatttttacaacatcaaaatttaacatgttgccaatatcagattcatactacagaagccaagctgcacccaagggaagggagtattcaaaattcttcctacttgggctagtgcagtggatgaggcacctaccaagacgatgaaattgagaaaatgaccaaattagaatagcaaaagggggctggatcacatgcaagacaattaattacggaggctgaggagtttgaactccagaaatgaagccattgaatggtaatcataacggtgatgatcatgacggaaatagcagaccttactgagagctttgtatgtgcccggaactgcactctgtactttacacggcttgactcactttatcctgacaacaaccctgtgaggcttgtcaccaacattttatgaggtgcagaaagattacataacttgcctagagtcacgcatttattgaatgatgaatcagaaaattcaaatctaagcagtcaggcaccaaaggccatgtgcttaactactaggctctaccagtgctctaatctgatcttgtttgttcacttgcttctttgtcttttttgtctcagacagggttttgctaaactagcccctagctagctctgtagaccacgctaaccttgatctcaaggcagttctctgctttccaggtgctagaatctatctgttcttgaatagactttcccaaaatagttacaaagtcctttcaaacacttaagccttcttagcacaaggatacccacttgtcaaatgggcaaatgtacttttatgggcctagaacagaaggaggctttgggggccttctcagcctcaccatgctctcaatggattaacaaccactggtctcttgtcagtatagcagaattaagtttttattttcggctttgactttggtccttgtagagcaaactggagcatacatgtctggtggttctttgaatttcttgaagaatccttgagatcatgtgagtcttctgataccttagtctataacctctgagactcatagtaaatagcatcccatgtctatgaggctgttttcatttgtcctggtggaatcatttgttccttttagaccccaactctgcctttccaccattctatccaaaacatatctgtctcttccacaacaatataagaaagttggggctgaagataatttacatgtgtatgtatatgtatgtgtgtgtgtatgtatgtatgtatgtatgtatatatgtatacatacatacaaatacacacatatatggtggatagtttcataagatacacacaaatacttatcaaatgagtgaaggtattccaacttgtcatttttacacatgagaagacaaagtactcatcctaaagtcccacagtagttcattggctatggcttcacactcagcccggtgttccatctactctcagagaatgtatttctggagactctaaacgagtcttttccagtctttcatattccttttcttctaatacatatgcttttactccaagaacctcctggtcccatgcattcatggtttatttggaaaatgctgattcctcttcccacaatgtattcccttcccttgagatcacatgttttagaaattagacagcacaggaatggattattgctattcttgtagcaacttccattgggcaatgtttctgtagagacagaaatttcaacttctatgtctagtttgtcaagtccattgtgacatggtaactactagcttttcagcacaaagacaaaaaacagggaggaaaaaagtgtaactggagaaaggtgtgggagtctgaggatggaggccctgccatgctacagcaaaggagtctaaatcctattgtatacaatggattctgccccgaaatagagcctggtgcacattgataccaggcttaaacgtgcctttataagaaagcctgagagaaagattttaacatcacactagtgactgagtgctctccagaagtgacaagaaagattctggtgtgtacagaaaagacctgacctttgaaatggactcacagaatacatagtcacatccccactctgctaattatcagtcacaactttgctaattattagaaatgtaatgttcacactgctgcttagcgttattgagtttgcttgtctgtttgacaacaaagtcagtaatgctttttcttctgagttttgtgataagtatgataatgaggcaggtgagagaattgtctcagcataagcttgaacacacactcgaagtgattgcacagagcatatatagttcaaattctttgaaccgggtgacctctgaaggacctctaagctttgaagttcaagctttgacccacactaagtaaggtcagtggtcagtttcaaatacttaggaaggtccttacagcatgctgcaggtttcataactaagcagtgttttggtcatcatgaatagctctaatttctacaaaaagctgcctttgaaagatcccttcccaccaaacaatggatgctcccagaatcccatgcaacgatggatatttatttgtcttgtgaatatttattagtactccccctaaggtcccacaatagttcatgggctatggcttcacactcagctcggtgttccatctactatcagagaatgtatttctggagactctaaatgagtcttttccagtcttccatgttccttttcctctaatacatatgtaagtaatcatttaaaagaaccaaaggatttagggcttgggtattggctccaatgttgttcctctccacgtaattgctttacttcagggaaaaagaagatataaaacagctttcagattgaagttcagagatgtgggagatgaagaggacagagaggggctggtaaagggaaagagagatgggaggagaatattctgattcactcagatagcatcttgccaagccccggtagagtacagcaacctcttgtccttcccagtactttaatcctccaaagatttctctaagacccaggttttcttctacatcaacaatacatggagacctggcattccacctcatggctcaagaatttttcaaggccctgaagtatgtccttatattactgaaagggatacaattttgctcagcccggtgcaatattattatttatgttttgcttcatatttactccacggaaatcacaaagttctgtcaaaagcatactggtgtgctatttaatggatcaaggcactctatatcccactgggcccaaaactaaaactttgcaagactgcaggtgcatgtaactccatctttcaactgaaggaaaaacatcacccaggagatgaggagtttttcactttcacaaacaagtgtcataattccaaataataaagctccccgagcaaagcaatcatcgccagcttgattcccaaccagagtgcactcctgagttcatcttgaaaaaacaggccacggttgcggatgcccaaacccaagcaggtcttacagccctttcttctttgcactatgctttcactttatttcttgtgtaactgttgcccctacactgtacagaggatgctccatcctttctgtgaattttcagtcaagctgttgaatcaattccatggctaaaagccaaattaaaaacgcacacttctttttattaaaaagaaggcagctgaggattagtccatcaaaattctcaaggaatgaactgttctaattaagagtcttctaaaaaatgcttcagctgaaacaagaaggatgctgaaataattcagtaagttgggactaattttgacaattttttttctgttgtatcttgttctgtgatctgcacacaaaatactactgactcttgcatgggccttgagttactattttgaaaatgtgtatttccaaggttcaggattacaagtgaagggaggtatagctaaaacttgaactaaactcaggacacagcttggaaaaagtgtctaatttctgaagtttatagtttgttacttattttaataagccaatggcatggtgtgctagtcacttttctattactgtgataaaacaccatggcaagggcaatttcagaaggaagggtttatttggcttatgtttataggagcataagagtccatcatagcaggaaagggcagcaagcagcaagcatgagcaacatgaacagctgagagctcacatctctaaccaccagcaggaaactgaaaatagcctgggattgccatgatgcttgaaacctcaaaagtctacctcccttgacattatttctccagcaagatcacaactccacaacctacacaaacagcaccaacaactcagaaccaagtatttgacatctgagctatgggaaacaatctcattcaaaccaccacacatgaaaagggaacaatattgttaataaaggttctgattacataaaatgcaatacctctcacttcttcatacattttcatgactgatttcttgggagataaatttctgatttataaactgaggcagaaagatgccaaggaaattatccagtgatgatattagtcaagcttctgaaactccagtctactgattattctgtccaccacactgtgatatctatgtcacttcttcatttactagatttctattgacttcctctcaagcaggccatactggctaggctcagttaatctcaccacagtaggaattacatctgaatatgtactcagcgttagtagcactaagaatagcttaggtgaaagtcatgggtttgataataatggttgccataataatgtccttatgcaccccagttgagagccatttattttgcataatatgatctttgcatactaaatgctcgtttgcatcttttgaggacacttgtctatggcataattttttcagaaaggttctaatgtcttgcaacaatatactgatagacttctaaagaatattactttaaaaacagttgaatgtgtgttctgagattgtgtggcctttagataattaaaaagtagtaatcaccactgttttttatttgtttgtttatttatttattcactttacatcccattccttgaccccttcctcctgaccctccctcacacagtcctttcccccacatcttcctccccttctcctgtgagagggtggaggttccccctaggtatcacacacacacacacacacacacacacacacacacacacacacataccttggcacattaagtctctgcttggctaggcacatcttttcctactaagaccagacagggtagccttgtagaatgagctatacatctgctatatatgtgctgtggtattggtccagcccatctttggttgatggttcagactttgagagctaccaaaggtccattttagttgattctgttggtcttcttgtgaggttcctatccccaccagggcccttgatccttcccccaattcttccatgaggcttcacaaattcagtccaatgtatggattccactgtctttttgtttgtttgtttgtttgcttgcttgattgattgattgttttgggggggggtgataagctcctaaggtatttttattaggtatgtatttcatttacatttccaatgctatctcaaaagtctcccacatgctcctccacccactcctacttcttggccctggcgttcccctgtactgaggcatataaacttcgtcaggtgacagaagatgctggcgaggatgtggagaaagaggaacactcctccattgttggtgggattgcaagcttgtacaaccactctggaaatcagactggcagttcctcagtaaattgcacatagtactaccggaggatcccgcaatacctctcctgggcatatatccactattttttaaattactcttttaagttgataaagccaggaccctctttcagaaaaatgggtcctaaagttcccttatatcaccagggcaccttagcaggggccacacagtcctgttccctatggtatttaagaaagctcactcattgccagtatgccctagaagctctttacaaacctgctttcccaaattgatctttaacatactgaaaattgcccaccctgtcaaatttaaatgatcactataaagatcaactcgtacaattttatttctgggactgagggcattaagatctcagagactggaagctgcttcaatcaacaatttcatattcacctgctctgtagatagcagcatatccttggttagaagttgagttggcatagagacataaaaggtgcagaagacttcaattttggtaattttataaggtaatcacttatatagataagtatgtcttaaactctaacatacattagaaacatctggacaattggcttaaactcaaactctgcttcaataggtctagaggaagttccccaacaatctatattttcacaagtttccaggtagtgccaatgataattgtccaagtagtgtactttgaggcacagatattactgagaatctgtgactatctaaagatttaaaagaaagattgcagactgtgtacgggaggaaatcaaacaaaaggagctggatagtgttatctgtcctcctccccttctcctcccccccttccccttcattgcccacacagggtcatatgtccatgcttcgcagtcacagaagaaatctccctgatgcacggaaaacactcacattttcttaccacaattgcatatgctggagccatttcaaatggaaacatctgcttccttcctttctctagaactaaaaggggttctgttttggagtcagccagggacatcaaaaggggcccctctcttaccactttaaaaaatagtgtttctcagagtcacattcccagtggaacagtggttgaatcacttggtatattatgaggagtggacatgaaacggtcacacacacacacacacacacacacacacacacacacacacacacaatcagtttcctgaagtgacacctaagaatttaatttgaggtatgcccaattagataactcctcatataaggaaaaacaccttgagcaaggactctaaagatgatctcacttctctcatctgacctgtagttgccctttcctgcatttacatatcattaagcctcctgagactaggatagggaagcaggtttttccatccttcagtttcccacaggattcctcacctcaaccccaccccacgggaatctctgcctgggatatatctcaggtggttaaatcacatgattctaagtgcttaacaagttttacccaatagggaaaagatttgtatttaaaggatgcttttaatctagtttctctcggtgggttttgtttttgttttctggttggttggttggttggttggtttggtttggtttggtctttggtttgtttggggtttttttgttctgtttgtttcttgtttctttgttttatgactaatgcttctttacggcacagtggaggtacttcaaagccttcgaagctgttgatattctctagttctccatatcgatttttttatttaattttatttgtaattcattttttacactccatattccattccatgcccctccccatcctccctccgactgctccacatcccacacctcctccccaccccaccctgtctccacgtggatgcctccataccctatgccacctgacctctaaactccctggggcctccagtctcttgaggattaggtgcatcatctctgaatgaacacagacccaggagtcttgttctgtactgtatgtgtgttgggggcttcatatcagctggtgtatgctgtctgtttggtggtccggtgtttgtaagaccccaaagtttttatctttttaatattctaagagttccatggtgtgtgtgtgtgtgtgtgtgtgtgtgtgtgtgtgtgtgtgtgtgtattgaggcagagtattgctctgtagcccaattcactataaaaataactaaatagcccagattagctaagatatcatggcaacccatcagtcttaatcttgtaattgtggtgatattataatttatattgaaataatgagagagaattcaaaaatatggtgaggaaagtaattgaaagtgacattaattagaaagatggctagataccaagtttggaactccccccgcccccgcccatagcactaaacactgtctgttccattctcttcctgtatttctagagttggggaaagacttccagcttggagatgaaatgcagccttttcatgggttgacagctatgtctgcctgtattttcactttttcttttgttgtcaacttatggcaaatacatatattgtgtcccctgagatagtgactgcatatcatgtatgttctcattatgggcttctcagaataattctgcatatattgagtgcacaaagtaaacagaatttattgtgacacttctatatatgtagatcatatactccaatcatatcatcctcctctcttttcttcttccaaatctgttagcagccttccttttataacttgcatcagttagtgtaaatcatttctgtttttgtttgtctgtacctcatatgaaacccaatctggcactgcaataggtaagagtcattggactctgtagctggaaagagtgataagagatcacagtgcgcatggaaggtacggagggagagtaggaaaacaaactagttgagggttaaaggtaataggcagagaaacgagaagaagcaaaagaaaaacctacaaagaagacattggatattaaagtaattaaaactaacactaacaataaataacatttatataacatcacatgccttataaactgtgctggaagcacttcccacacataaattcatttaaatctttgcaataactttatgaattagatgcatcatcattattattgtactttatacacttcagacagtgaaggcccaggattgtttatattaacatacagagtaataggtttcctgatgacatacagcattcttactgatcttccccttccacttccctctctcatcctcttgtccctcccttgatccctaaagaaacacatagatttaagtcaaaattttgtatttgtaaagcagagccaatggaagaagaaagtgtgatcaccagacgtttactttacgtaagtcaataatccttttttttttccaagtcagtttaagccgggtttctgtctcctataaccaaaggagttctaagttaagtgaaatgttcaagttcacgtaatcttgacaactcaatgcattaggcactgctattattattcctggtttgaaaatgaagaaactggggcacggagaggttaagtaacttaccctgagtcatgcagctgataagtagcaaaattgtgagctgaactcctgcagcctgacttgagactctgtatatgtacagcaagtgtactaagtgtatttagtgaaaaaaaaatagagcatgccaccagtgaatagtggaaagcaaaggtaacttcattctaagaccatgctttaatgagtaacctggcaagcatatagctaccctttcatattttaaaggaatcaggaactacacaggttgagcgtttacttagaggttcctcttcaatgggaaaccagaatttctggttgtatgcagcttagactttccagcaaggaaccctctactgaaaccaaagctcgtgccaggacctcctgtatcctatggcactctcttccaggatggtggtgtaacacagtggtggatagtttgcctagattatacaaagcctgaagcttaatgttcatcacacacacacaatttttaaaggaagaaagtccctttgagacaggaaaaagaaattaagatgaagacgtctctgtcactagaactggaaatatttcttagaacagcaaaacagcagcatgagaccctgggaagtaccttactaagatgcacaaagccagcatcaattgagcaaagcctacttttgatccttacatgtctgcagcctctccccacagaggcccatagcatccttggaggctttcagacaatccctgtgagctctgtttcttccacaagtgtcctaccgttctaactgcagtagattcactgcagaaaaatgtgagaatgtttgtaatgtttttgttgttgttgttttaatgtgcagaaagcctgtctgctggggataaatgttggccaaagagtgatcatttatccatcagaaatcaagtggttaaagattacaaataagctttcattgattttaaaactattaagtggctcccctgataattctcagctgatttatattagtcagtcacaatttgtggatagataacattaaaaaatgttatgttaagtaattttatattaaaacaaaatcaggatgtacttcacttaagaagcaaagagtaatttttgtcagtctttgtgaatggctcttgtttcccattcattaaatgcttaacaattcttagagcttaaataattaaaagtataggagagatgtggagatttttaaaaaatcaatctttgcttgtagtgccattccaaaatatgtcctgcatggcatagtagatcttctctatacgactacttaataacaagcattctgcattttttataattatgtgtgctgccaacagtgtgtagttggatttattgtgcactgaagcccccagattgagagttatgtcttacacactctattataatgaatggcatggaagggttctttgtgtcacgggatgctgagttggatatttaaatagcatgccccagaaacgttctacattatggtgatgctgagagagggacattgtctaaagtacactgtgatttaagttgtgtggcccatagttgtaactgcagctcattgacaggggattaggatctataaaataggaagaaagaattgttccaataaaaccccagttgattagaaggacatttgggagaaatattaactggttctgattttttttttacatgcaggaagcaaatcatagtaaaacataattctcatagtattattttgttgtttttttagatgaaaagatctttatttcttagatgaagtcttatttaaacagcattataggatattaaatatgaactatgattaaagcacaatacatttaaagcatctatatccaatcatttctattttttcttttgttgtattcaaagttagtcatgacatatgccttgtgacaaaatctaaataaagaaataaagtgtatgtgtgcctgcatgtgtgtgtggtgtgtatatgtgtgtggtgtgtttgtgtgtagtgtattgagatgtgggggtgtgtatgtgatgtgtagggtatgtggtgtgtgtgaaaaaacaatacattcatttcctccaattcatttttaaagaaaactagtaaccaagaaaaaataatgcacactctggaattcatcttgttttaaaaaacctacacaaagaatatgactgacagaatttgaagaaaacgatctaatttcctgtgcctctattttgtctccatcctttatgatgttggaatgtatcactaagataagccatatgtgagtagaataaaacgtgtcctttctgtgacacacacaaaaaatattcaacaagcggagcaacatattgtattaaataaattatgatctcaacaaaaatcctaaaaatgtcaagataggattaattattattgggcacacatttaaatactttttccaactccctatatgtatgctggaaaacaaatgtcttctccctccattccaaggtgagagggaaatactaaaggtgtttaccaacatgcctagctcagatctttaattgttgagattataattgcaatatttctccctacccttttcaaaacaaccctggcctcttttttcactgttattgtatgcctatctctctctgtctctctgtctctgtctctgtctctgtctctgtctctctgtctctctgtctctctgtctctctgtctctctgtctctctctctctctctctctctctctgtgtgtgtgtgtgtgcgtgtgtgtgtgtggtgtgagtgtgtacctaaatataacctgttgagttcatataaatgtagttgtctatatgtctctaggggtgatgatttaatgctgtgtatgtgttctccctgggaaagcgcgcctcccctgctaccttagacaaagtctttggatctgaactttaacaactggtatgagtactttgtcaggcatagtggggtgagacaactctcccataatctcccaaccagatgaatgtaccagatgtatgtagaggacaatgtaagttgtatgttatctgatttctggcccaatgtccttgttactcaattgtgctatctatttcttgtgctcctctggttaatttactttgagaaaagcatatatttcttggatattgttctcttatagtatatgcattaatcttttttctttttctctctcctattcccgctactgccttatccaccccctacacacagatttgtatatatgttctggtctctggacactatgcaacacattcaaactctcagattatctaaacaggaggagaaacgtcatggtgtataccctctgaaattactttggcacaattatgccaatagtatgcaatagaaaagacagtgttaactacaaccagcaaaactaaataggcataattggcattactaatttgtgtacacaaataataattacaccactttccatccaaagttcaattaggacatgcaaagttctcatagtttactggatcagaaagtggaaaacttcaccaaagctaacaataaccacagtaatgtacagcctgcacctcagacatatctttacatcgttcgcagagactgtaagcacacagccatgcacgggatagtgtgcttaaggatagcttgctaaattagtgattgttttccagtagtccctcatttacatattattcctcacacaaataaaatgctggatttcactccacgcagcaatacataatcactgcttatcaaatgtagtcagtcacacgtctccaaaccataccagctataaagaagattctgatgttactagaatatatagcctggctactatggagtccataagacagaagcattgccaccatctggatacttttcagatgtagaactctaggccaacagaagtagagtccacatatacaaaattctcatgtgattcatgtataccctacaggagtatctgttcatcccatcgcacaatagcagcagtcacactgtatgctccagttcaaaaacatctcctatgcccctctgactctatagaaaatataagggaagaggcataatgatcgcctaggataatctataatctaatcccaaattgtgttatttctattgcaaataatgtaatcatagagaagatttgtaacttactgtgttattgatagaagactattgggacaagggatcattaataagctactagtcagtatttttggaatataggaaaaccagtaataataactaatatttatcaagtacttattgtttgccagtgcttgttacttggctttttttttttttttgcacataatccagtttagtttttcatgccaagtcaatgtgctaggtattatatagttgctaaatatggcagatggtctggctttaaatcttgtatttaatatttgctggctctgtgatcatagacaagatgttttagttgcatgtgccttagtttcttcacttataaaatagcatctcacaagcagtcacgagaactaaaggaattaatatgcataaaacagttatatgtagaattaatacacataaaacaggaacagtatatagtaagcatccaataaatgtctgaggttactatctacatgctattaatgaatacatttatacacagaagttgaaaaacttttccaaagtcacatagccagtgagtgggtagagacagaacacaaaatcttcttggtaagatacagaactcatgctattcaactctgaatttcatgatagaaaatctttctcctcactcatgccttatgtgatagaaatttgaactagacatatccttagagttttgtccttgtctatagcaccatacctctctatgggtttcaatttcctcctacatacaataatatcctcacccacaatcctcagactatagaaatgtggaagttagatgtaattgaaggcatttgacttactggtgtagatcactccttactttctgaggaccattacatgtctctgttactctagctgctctgagacactcttgtatgtctcaagagatgctaaggtcaacacaggcccatgccctctcttaacactgatatcattccttataaaccagaaagttccactgaaggtctttaatctcttgacaaggttaagaaaaaagctgtgaaaatagcttctgcaaaggtcatggctttcccttggctgttccaccctctgtctaaaccttaaaggaccagtgttcaatattagacacctacaataggatttcttttctatggcctaggtttctaaggattatttcatatccaggtttggaaccaaaaaaatttccctagtaacccttttacaatttttcactttcaagagtagcctattacttccaaggagtcatgaaaaattttatagataaaattaattttaatgcattcatattttattgtgctgtatcttataagactcttttgaaaaaaagaggcaggctgaaggaccaagaaagggtgttttctaagttcctgggcaagcacattaaatgtaagaattatttagattcacttttgatcaaccaaattataaaatcattcacttgtgttctgagcagtgttttggtccaggtaagatagctttttttctctaccaaggatcattcaaataaataaaagaccatgtccaggaaatatggtacctaggtttgaatgacagcatagtgtgcataggaaattatattaagaatgtataatttattcacaggacatctactgttagcaataaattctcagccattgatataaatcacattatttgtcacttaaacatccaaggaaacatgtacctagagaaatactatgatttcaaaactttcatcccttccctgaaatctccttgatgattcaagctttatattggcactcattgtaaataggttcaccctgcaacaaaatagcatttattggctgcaaggtcactactgtaatttctgacttccatacaccaagaatatactttaatttctttccctggcagggcttgctcactagtcccaaagacctagttttagcacaaaacccacggaaatgttactgaacttctgtgatgtgtcttcctagttttaagttcccaaataatgcttgtctgtttttatccattaatgtttttcatataatatattttgatcaagttcttacccatttcccaacatcttaccccaactatatttcatgttctctctctctctctctctctctctctctctctctctctctctctctctctcctccccctcctcctcctcctcctcctcctcctccttccctccctccttccctccctccctccctccctccctccctctcttcctccctctctgaaacaaaagtactgggcaggccccatgcctaatagtagttggccaacacaaaacaggcaccttgactttctggctttcgtttgttcttaagtttaaataaaccagaatctaatgagtcaaatgaccagaatgtctgttcatagtccaaaaagaaaaaaaaaagcatttactatgatccagcaacatcacagatttagtagaagtgagagtttccttggattgttccagggtcagtgtacacttggctgattgcctccaattttgacttctccagacctgatatattaatatctatgttgaaatgataatcctaagacactcaaagcttctcaggcaacaaaacaattatgtgctatttatctgatcatacttacgatgaaagaaaattggaggtatatgatttagagacacagtagcatttcaagaacaataaaataactacaaagagatttccatttagtaccgaagtgctcagcaaatggtctagatgttaccgtaagatctgtttctctgcctccctactcacatgcaatttcctgggtatgtcatatatcccatgcaaaataaaaatattagactaaactagatgatatctaaagtcttttataattctgatgtccaataattgtattgtctttgtaattccttgattgacatctgaatctataacactaaaactaatttgaacatagaatgcctcaaaggaaccataattcagtcactgtccttctatcatcgaaggatagggagcagttttagggttatctcaaaggctagggagcagtctcgggactattagcagaagttgactaagatgtttttcttaacctacctatgaaaggctacagaaaggcagtgaagtacatctttgagatgatgaggacttctcccatagaagatcaggatgcatttgacaagcatggggaagtggcttagagaatttaataaaggagtttggcagttgcttccaaagactacattgctctcaagatactttgaaattaaatttgtattaattgaaaagcaagaagagaactttagaatatatcagagagaaattacacagatgagtttacttgctgagaggtacaccacaggcagccctggcacttggcagcagtcttgacaagtaccttcatatttcctttgccagtaggttcaaatgtatttctataccctctctctccaaaatgtatctataactaaaatgccaaaaacaatctctaaaagctctataagtgttaaatatctctaaagactcaatttgttccccaagtagaggtagcccctggatgcttcctcccacaataaaagaaattttccagcatcttacctgaacctcatctattaaatgtaggacttagtgtggaaaaaaattactttcaaatcaattggatatcacctgacctgatttttgaacccacaccaacccaaacgcaaaggaaaactctgttactgattctgcctagtgaacagtgacatatctgttctggttacagaaaagaataatgtcaaaactagcaaaacaatagcagtgaacaaagcagccaagatatttttaaaaatctatagccaccttacagtgtctatatcacttctctatcccaacatatgaatctctacagatctaaaaaatacttcatattccaaaaataaataccaagatgttgtaagccttgtcttctgtatcatacttgcctggttatgtgcagtttcttcaatgtagtaccaatatgactgtgatgcatcgcctatttttcatgtccttatttttaaattaaggcctatttcgcatggcttgcttatatttaagcataatataaatacaggcggcagtataaaacaaatgcttaagtaaatgaattataaaatatccctaaaactactatcagtgaaaaagaatcttgctagttacctcagaagtcctttgtacattgtcaagcacagtttctttgtttattttggtgaagatatgtataacttaaaagcttcatcggttgtttgtgagcatggtatgtgagagagagagagagagagagagagagagagagagagagatttccaatttgtatgaaataagatctctcttgttcactgtaactgcacataccagcccaactggccagtgtggatatgaagattgtactgtctctgtccaccatctctccattggagtgcaggaatttaaggtgtatgcaatactatattggatttttatatgggttctggagatttgaatttaggtcatcaggcttgtgagacaaatgagccatctcccccacacatcaaatgctattatgaggccacaacatttctgtttatttcttacttctaaaatttgcattcacagttttggttgattgattgcttcatttttgtggtattaggggttgaactgacagccctgtggatgctaaacaagcactttgacactgacttataccccagcccttcccaatcagtgctaaagctgacaacaatcctgtctgccccagagaggattggaaggaagcaattgcacatgggcaagtattttgtataagcttaagagatggagatgaagagtgttgagagtcaaaggcaaaacatgcatgaaagttaagtgtaagaagctgggatcatctccgacttcctctagaaccttttcagctaaattaacatccccacatcatgtagatacattcaaatacaaaatataaaaagcttgtaaaatgaaatataagagaatttaaatgtatgcattattcagtactgtccataccctgaatttcctatccttcctgcaaataatcaaaagtaaatctcaagactgaatagataaaatggatagagaaggaaaggcaggaggaagcagggtttgatagtctgtctagtgaaacttcaactttctccagctttctgccaagaggcattgatgttaatgttcttggactattctgtatgaattaggcaaactgtcatagacccacagattaatcactcaacaatctaaggtctattttgaaagatggattttaagttctttccttattcatcccatggtatgtggataatttaaaagcataactgtctgactaattggccaatttgatcttcaatactgaaaaatcagtactttatcattacctaagactttatgtttccctatatcaccagaacacaaattgaacagatagcatgtataaaaatatcagccaggaagcagaacatgttattcttttgtcttgatcacattcttatccagtaggaagggagggggtaaatcagcatgagcaagcacctactgtatgacagagatatctcatctaaaacatgttttaaaaagagagctgggttgatctattctaggaataaatgtctcattggagaccacaaaggtgttgcctctgtggatcaagaaatgcagcaacaaaatattgagccagaaaatcccagtattccctatcaggaggagcatgctttgtaaaaaatataccatcacagccttagcaacctgaattaaaaaaaaatgtcgagaaactgtgagaatgctacacattttttgaaatgctcacaacagtagtagttccccaagctatgttgagccttcttggcatccaaaacaaaataggaaggtttggggttggaccaacccagttatcctgattgagctatgccccctgcctgctacttccagataaccctctgtctggctctggggtacagactgatcatacaccgtttcctgaaaaagaattcccctctgtcatgctccagggactttggcagaggactggagaggatgctttgtgattcctctggcattcaagtaactctctaatgcccaaagtgcagagcagagggaggtttgtccaaatgtctgacctaaaaggaccatggttttacttcttttctaattaggataattaacctcctctgtgcattcattttattccaatccaaatggctcaaattaaagtggcacaggggactttcaagctctggggacaggaaatactttataaatacctttaatattcatttcagccacaattatggcaaagccagaacaaagttggcatagcaacttcatccttgacacaatctggagcagtttgaaggccgctttcagaatattattgatgcaaatgtctcatcagctataaaactgtgtccttaccccataccattccctgactaaactggagtggaggttcggcagggaggatgcttgtaaaagatattatttctctttgtattttcatatgagtttttgtactttgtctaagaaagccaaaaaagttatatggcttataagtcggtagaaattgatataagattgacagaattttttctttcaaaataaccatggaagcccaaactttggaaggattctaaaaattggagtccagcagtatttcacataggacagaggtatgttgctggagttttttccctaggtggctttagttactcattctccacctctgagcaagtttgaaggatccctagcaggtatctacctccttcatgccacctatgaagagacaaataaatgaatacactccctctagattgtttgcctgttctacaagatgcaatctgcagatttgtctgcatacagcccttctacttgtacaggaagctgctatagtcaccagtctaactacagaccttgtgagtctccataaatgataaagacaacagaatagacaaaattaggatgtctgcttaaagtgcatacagaagtatctattttattctagcgatgctggaatttcctctgatatgccttggttgtagccttggactatccccagaagatgtgctacttggtatgctacaagttcaactgcatacatttctcaacatgctgttaaaaggctttttgtggacatattcaacaagctggccattctcaaaactttgccaatatatgacctggtttcctcttaacccatccttctgtaaacctttcatgcacctgaattacccatctatgttaactagctaacctgttgatttgagtaattatacagtagtgacaagaccattactactcaagttatggtgtgctaatgtaccacacgggaagattattttaaaatgtattctagttcattaagtgcagagaggaactaaagggtctgcatttctaacaaatggccttgataatgccaatgttgcttatccatatggcacttataaagttgcaaatggacagcatatatcttatttatgaatgagttaagcctaactagtgtatctagaataagagactggcacaccaaccttttaactaacaatagctgcctttcctattaaggctaaaagaaacatagccagatctgccagaggtatggcaaagtaaaccctggcatagactacccttctttggatttgggtcattagcataagccatcctaagtaccttctctgctttctgaagccaactctgcaaaccaaattcattctgcatgcagacactccattcatcgcatccactttcacagtggctcagaatggctgctgtcaccatatcactcatgctgtgatctgcatcagtggttaagacagaagaagcagcgagatcatccaagtcacaagccatttatttcatactaagaaataagtcttctatccaagtggggccagctaagctgggcagttgtcatggttctaaggttgcaggaaatgttcggtttacactattgagttcctcagtagagagcaaagtaatccttgacaatggcccaggtgtcattaatcctaccaataaaatactagacaaggaaaatctatttctcttctaaggtgtgaattgcaaaaacgtgtgcttaattttttcaataggaatcaactgccttgtttctctcctaaaccaaacccccaaatcactgtctcatgcattgttcttcagtcaaaatagctcttaaggaacatttcaataacattatatggttcagcttattcaaacattggtacaatatgtatatacattgagaagtagttaaagttaaataataaatacatagtcattgtgtggtgagaatatttaatattcattctatagttttcaagaatgtattgttattagctgtagttgcttttatatagatttcttgaaactaattccttctaattgtactacatgtcctgtcaccaatagtaccttatacccatcttagctcctagtcacaactattccactctctacttccatgggatgaacatttttagaatccatatgtgaatgagatggtacgatatattttttttctataccttgctcatttcaattaagataataccctccagattcatccaagttgtttcaagtaacaagatgctcccttgttgatatttggagagttaaacactacagattggaaggtttccctaagaagattccagagcagtatgattatccggcttcaatccaaaatataaacatgttttatggcctaagggagttgtcaaacagttttaaaacacactggcaaattgaacacagatttaaaagtaggccagcttgaagaaacagaacagctccacactttcatatcccagtggcttggtgggaacaagtgtttgcctgcagatccattactgctcctggtggggtctccacactaaggaaatgaacatttcccattaactgattcaccgtgttctttagctcttttgtctctgggtaaatactgaactcttcatcagatcaacacttccatgtacctatgatattacaactctatctctcactcaaaatcatacagaagagctaaaatagtggctagcaaagtcaaacttctagctaagaattcagcctgagtgagcacaaacctttgaagtcatggctgactagtctctcaactaatcctccactgtgatgactaacgttatcatttctaagtgcatttcattcaagtaaatctctagcccgtaagctttctcaacaatccaataacagatatggaaccttaattgctagtggccatggattccccctctgtaaagcccctatatagtctagttgactggagcacttctaaattcagtcacagccatgtgcttgttgatcctttgcaagaaatgttagcccagctggatatatcctctgactaagtgaagtcaaagccagatctggtattgtcagttagcttctccctgtcaagtctatgagtctagacactttcctccagatcggctggccaaattataaactggcttaaactttcactgatttaaatcctaatagctctagtcaatggaccaatttccaagtgagacagtaagcaggaagtgaaagggaaaatgaacagaaatatttaaagaggtaatagattagcaatcttccttattttcccctcctgcatctctaacttatggcctccatttatctcttagtacagttgcattctcttcatctaccctagaaatagattatcattttacacttaagaagaaactgctttctataataggaaggtaacacacatttttaatacctgcaaagaaatacttgtgtgttttttttttaagaatgaacttggctgtaacataatcagaagaacaagaatcttggatgggagggggaggattattgcaatgaccgaagcatatactaataatagcttcaagggagctagctgtactggggatttaaagtaaaacgcagacaaacgaaacatgaattaactttccttcacatatgcttagggcaaagaagtccaaggtaacactcagaatttctaactaggaaattaacaaaaaataaggaagtcagaagaaatagctggattggaagcagggaaggctctgacataccaaaaagatgtcaaaactcacctagtctaaaaaagaaaatgacagcctaatggcttcaagtcagttctgtaagtgatgagaaagatatcactatgcaaagaaatgtatgttagggatatgtacaaagtcattttaaattgattgcatcatatgtgttctattaggcccaaatacccaaaggggttttcaggtagtcacaaaactctgcattctagaactcttcctgagtaagagaaatgtacagtgtaaatacataatttcctgtgctacatctactaaaagcacactgaaatattccaaggtcaccctattttaactcttcattttatttcaattaggtttgtctagaaggggggaagtgcatttagaactgtgaatgaagataacaaactaatgtttcatcttcttcacatcttggcctccagacaaaattattgaattgtacctaagttgcaagaagtcaggctctcagaggtagacaaaagtcttccacgtctgttacaattttcaaatataagaaccagaataaatgataacctgttctcttcattgtacatatgagaaactgtaaagcagaggaaaattctagtcaacaatagatcctatactcatgtattttgcctgttatttttaactttccatattgatataaaatgacatttctgctattttctggatagtgataaatttcgataaacagtaaaaaaaaaaaagcttacattcaacagaagtgttctgacagatacattccttttagctttgcctgtaagtctttcatgacatccttgaagaatcacttcccctttcatttaatacccttatatggagaagccatagagtccacagcaagcctgaacattaaaaactatcttccttctcttacacactgggactcttaatcagtaccaaggcccactgtaatctacacacgtggtagagtttatgacttgcttcatcattcttagttgcacaaattcttgagcactacctatagtctgcacatatctatccaccaatttttttttccctgctgtcctcttagtagggctttacctttcatccaatcgtcttctgttcattaagactcaggtcataatatttatcaacgaaaatatctgcttgagatagtttttctgggctctcacatctgtcctgtagacaatgttagtttgaccatcatctctaaagggctgtggtcaaatgccatgtttaaattattgcttgtatgaaatattttctttacatattgtgataaataaagttttagctttactccttaggtatttttaattttctatttttaagatttgtttttgcatatgtgtgttttcgtgcaagtattatgtatatgcaccatatatatatatatatatatatggcatttcctctgctatcatccaacttcaactgtcaagaacatttcctgattgagttctatggcattcctcctctgcaggtacccatgaaatgttagtccacttaccagttttttgtaaaagagactacttgatcacagactcaaagttggaaattactacttccaaccgggctaagaaactaagtgagaaagtataagtgaacaaagtgatatattgaatgctatctacattttctcattactataggcaaatccctgttcaaaagcaacataagggaagaaggggattgtgttgtctttggcttatgggtacagtccagcataatgaagaaaacagagcacagaagtgtgagtctgcttgctctcatctgagcagacaatgaaacaggaacaggaacaagatttcctccaggcactctgtctctagctagtctccctctcctaaaggttagagaacctctcaaaacagcaccaccagctggagaccaaagtgttccaaacacaagaatctgtggggaacattgcacattcaagccatgacaacatctattaagtgttcaacagtccacagtacagcttgtagttgactcttgctcttggtgaatttgcattgcaagtgatcccagaacaattatctaagtagcatacataaatataaaagaattatacatagcactgtaggagctccttttaacccaaagcccagttgcttttatatttttattttagacctagagtggctggctgacaatcagaggcttgcctattctgattttcccagacgttgaacacatctactccagatggtcttctaaattcccttgcagctgataatgcgaagcaagtgtacattcactcagtgaaactgacatatctctttgggcatattttctcagcatagggtgaggaaagtgaactacataattcaccagcagggagacaaggttcataatgaagaacagaatgaatgagaaaaatggaaaatgtaggattatatgcactgccagcttcagagccaccctcaaacctgacaagtagcagttgcctcccttggtgagatattagggtaattgcaatacctgaagttgacaaacagtaccccaccaattattgttgtctacaaattctcaattaaaacttaattctttaagacattttattcccagtttgtaaaatataaattctccatggacgtgggggcggggatatatttgtaaaatataaattctccatgctctagcacaagagcatgctctgagttgaaggaaatatatttaaggaaaaggtaaaggacacagagccagtgagcccctcacatttattggttccacaaattagccaagggccatcctaataatgcagctttaaggaagagaagatttgaaaaaggtcagttcttaattaaagaatgacttaaacaaacacagttatgaagaacagaggctccagagaaatcttaatttgctatgggtaaattggattgggtgtgaatgagtgtttgtttttatcatgttccataaaattcgcagattgtcattcatatgaaaatagagaggggttttcaatcaaagcttccaatcgaaagcttttcacatactgaacattttctgtattaacatcttaagtttatacattcactctattgctttttatgagaccaaactttaaatgaagctaaagcaaatactagcaacagcagaccaaccaagcatgggtccaaatgtgctatgggttatttttaagggagtacattgtgtgaaatgaataatcatactcttgagttattggctctgaggtcagatttttatacatatggcccccgagacatggcaagttgcaacacaaaatgagtgggcttgccatcatctcctgcctctgcttctatgttttcccttttcacctctgtctctgaaaccacctttgtattctatcttaagcttgtctgtgtccttattttgcttcagcatttaagataaatgtatttcaaaaatccatgctgatgaaagatggttaagaaaaagagagtatgaggttgtataaggttggagtttgcagcccgggcaaccacaaacataagaatagaagagcaactttcatttggctagtttcatctgagtgaacaagaataccaatttcataaaaatgctagacacatgctcatcaaaatgtaatagaaacaacactaaaagtacaataagctgttaaactagacattgcatatgttatagatgcaataaagacattaacattattagaaatattaaaaaagaaaaagccatactcaaggaataagcttgaatcttaaaattaaaagacaggggtgctggagagatggctcagcggttaagagctctgactgttcttccagaggtcctcagttcaattcccagcaaccacatggtggctcacaaccttctgtaatgggacccgatgccctcttctcgtgtacccatatatatatatatatatatatatatacacacacacacatatatatatataataaatctttaaaaataaatttaaaaagacagaaaggaaagaaggaaggaacagaataagagcaatattgccagataagatcttctatgcctgtacttctagtatttgttgatttctgttcagcatgaagtagttttacattttgttggaagagtggggagaaaagaagaaacctggccttgttttcctgggaacatgatttcgacagtataggtctgagagctttttgtatctgttgtcataccttttgtggggtcaaactaatagtcatggattgagtactcctaagaacagatgttgaaatgtcaattcatatgccaaaaggctcttggtgagtcttcattggcagcacttgtgcagagaaatgggaagttggctaagtaaagttgtggtacacccatgccaaggtattaaagctctgaagctgaggttgcccattagttatcccactggaagtttggaatgatcatgtttttatacttggctgctaccagacgttggatacaggatgccctggagaggaggcccacccaaccttaagtcaggtatctctcttctaccaacaactctcccatcagcagaagtaagctctttggtaccaaagaatgatctagctgcacaaagcagcatccctgcacagcctctaaccaagatggttggcttgtttgccaagtgatgctcaataaacagtgcactagaatttaactggtcctgactacgatccagttccttatacctaactgccatgtccctcctttattgctatcctcccatgttactttggtcagatgcagagggtaagctcccaatcagccagttatctatatggtaactcccaccatttaaaatgaggagcagtgagggcaagaacagcattggtggtttggaatccagttgacataatttgctactcaaatcaaagtagctttgagacttacaaagctgggcatgtgaaaactcacacagggcagatgacaatcctgaagctgctaaaacagcaggctttatttttacaaacccaggactttgttgcaaacctcacctcctacaaacactagcacctggttttgctctgccaagtcaaacatttctttctttctccctcaagcttctatttatgctttggtcagctggaactgagtcagtgaaacgatgataaatcgggtatgaaaacaaataaaaagctcgacttggatcgctcactgacatctactgaactgagttgaccattcccctcaagttctagattgcagcagtcccatgctcaagcagacactgggaaactgaacggaaaagaaatgtaaagctaagccacagttgtgacttgctcagaccaaaaaaaaaaaaaaaaaaaaaaaaaaaactgtaagaaagactcataaccaacacactcatcaaaaatcagtgtgctgcttctgctgagtttttgattaggtaacacatccccatggttcaaagaacagaagtataaaaatatctaggaaaatcattgcttattaagaggaagcacatagcagagtgttgatctgtcatctgaatattccagcaccttacactctgagaggacaccatgaaccggacttttaaggtcttaacagttttatccttgcagaaaataatacctgcctctttttaaagaactaaacattatataaccaagtgggatgtgggatgtcttcataattctgtgtctctgagaaaacactaatagttcttggagattttccccccagcatatacaagcatgggctttttagcaaaagtaaataaaatatgatataataataatgccatattatacatgttaatttgttagttctgtagtggaaatctttccttgttagtgtatgcacattgttgacaactaaactttagcatagcatcctgtgtgatatacttaatacactgtattttgcatttttataatatatgtgatacagttattcaaaatgccttttcgttgcttttgattgatttatcttgaatacaaaataaggcatatctgggaaaattaatgagaagacattaaaggaacctttatgggaagaacagaaacacccagaaatgtctacaagtagcagggtatgcttggtaaagggggagatgtgcagttacactaaataggtaacaaagtactaagtgagtagatgataccatttttcgggtttgaaagaacatgaaaacaaatgataagtaaggaccagtccaggaagagggattaaagaaagaaagacaaaagcagggtagaaggcaatggccattaacacgtacacagagagctgttaaagctttatcagaactaaaaagtttctgcagaatccaacctaaatacaaattaatagaatttgactatttaaatatataatcaatccagactagggatacatctcagtgatatggtgttagtttaacatttatatggccctggatttcccccacccccaccccagaaactctatgatgctaaaataacttacatcaaaataaacagtaaccctatagccatttacacttactgttcagataatatctcaaatattaagaccaataaaatattgacaagtcaacaccctgttacgaatagagaaagtccatgaagatccacccctccccaagggcttataggcatataatagtatccagcatggagagacttgtgaagctacatccttccctgaatatctacagtcaattaatcattactgaatgtgagagagacatttttttcagtagcatagccactggtaagagtgttatgctcttataaataatcccttacccatgtccctgtaagcaactgtaataaagctcacagatcatttttaaaaaatcctgaaaatagaaggaagactacttaagaagaaagagatagtaggaataggaggggcacaaaacaggataatggaagatgaatataataaaaatgctttgtattcatgtacaaacgtgtcatcatgaaacctgttattatgcaaaattaacatatacttagaaacattgaaaattatccatttaaaaaaagatagaactgaaaggaaaatagttatcatcacataaaaggaattgttgaggattgggacatctttaacctggagaagaaaaggttaaagagagccatgttaacagcccttaaaaatgtggaagattgtcccatggaaaagagattaatcttcctccctgtcatcttaaattgtggacaaggtccattaggcagagatgacaagaatttggattttctactaaaggtgtgaacacttgtgttttgttaaaaagcccttttaaaaagaaagtttactttaaatatatcaaagaatccctatgtaatttctttactgttattattaagccaatattttcttcataaatagcccaaaaataaaattcaacacagtccttactgaattttcataaattcttaattagtggcattcaaaataatgaggccttattatacactgcttaagaaagctttccacatgctttaatctctttcttcctatgtttatttcttaatcccatgccttggcccactatgtgccctcaactcccactgaagcagagagtacatctaaaacccacatgaaaatgtaaatctgagaaataaatatgcacggttggttttataagagtaagaattaacatttaaagcaatggtaatttgctctgatctgtaattttgagctcctgtgctgaaattgctcatttggaaattaccaagtgcttgggtctcgtttgtgatcttcttcctgcacacacccagcacacaaaggagttataatgaccggctgagtcactactgccatctccctgaagcatgttctccaaatgccaataccattttctatggtacagtggaggacgacactgagccacagcctgcttacaccacagcagacagagaacccaggagtgtgttcaaaaggcatcgccacctcctccatcctctgcttctgtggccattgaactattacatcacagataattgggatttgcaaatcatatctatcactcctatagggagaagggagattgttttgataatatcccaataaagttgtctattcttgatgagattatactcattgtaaattcatacaggaaacacaagtggagatatgatatattattagaaatgtgactactctaaaagaagtgatgcataaaaagtttgtgccattgtactttgtactttgtatttgggaggttgcttgcttgcttatttgtctgtttggtttggtttgggggttttggtggtggtgatggtttggttgggttgggttggttttgttctattttgtttttgttttttgagacaaggcttctcattttaacactggttgtcctcgaactcactccttagagcaggctggccttgaactcacagagatccacattattctgcttcccaagtgctggaattaatggcctgtgccacctctggctggttgatttgggattttcaaaatagaatctctttgtctacctcagggtggtcttggacttttggaatcctcctgcatcagtctctcaaattctgacattagaattatgagctgcctataactccaagtagctctttcttttctttgaacagagctccaggaggttagttgctaatgtttgtcggatctaaattacctaatgcaggaccaggaactcctggtaaatttggttaggaaaaggaaatacttcaccaaaaaaaaaattctattgaatatttcgtagagtctctatataaccaaaaaaataacagtctatattgaaggctgtcattcacaaaatcatagtgactttatctgtgagacacaatttatcttgttcaatagtcacatccacatgtggttcagcttgttttaataaggctctagcatgagtagttgtttataatgttttgctgtgggtttcttttaacctgtaattctgaagaattaagtgatagatgaaagaaaggaacttcaaatgcaacagagaaaattacagccagacctaagaggttcttggcattcgttccaaagatattttgataatgcatgtcaagacaaaagggactcgacaaacacctctccccatggtgctcacaaatgagagaatctccttccctttaaaacaaacaccaagatggaggtgccaaccatctggagagttgaggttggagctgtgagggtcacttggtctctccagtgaatacagtatgaagagacccaatgggctgttaatagaaactcagtggaatcttcaacacctacagaaataattttccaagaaaaaaaaattagtatagctgtttttccttccttcagggttttccatcctgcaagcaattatggaagcagcagtgcaaaacaactggcaagtgacagcaaggtctgtgggaaacataaaggacatccaggaattcagacgcatcattgaagaaatggacagaaggcaggaaaaacgatacttgattgactgtgaagtcgaaaggattaacacaattttggaacaggtatgtctgagacttagcgctctcccagtctgcatgttaaatcattatcccgaggcagttcccgtatctgctaataaattaagtagccaacagaataagcatgccaacagttttcatagtctctctaatccctttttcctcctgagtggctgcaggggggaaaaaaaggaatgaaaagaaaagaaaattctaagcttataaaaaaaattgcatcgcatgattaatttgaatgtctctgcaatttgatgctacatatcagataaatctatggctccactcctgtttaatagatagctggttatttcaaagtaatccctgtcctttcctatatcttctggcccaacagggaacagacaatagattaggcagggctgacaggtaggatttttgtttctcattactggaatatgtactgccctggacccttctaggaaacaccagctatagttgatgaatgtggggagatactacttgccaaggtcaaattgtctatatcattctaaattatccttttgggttagtaggggtaagagaatacattaagatatttttaatttcataaactttattataaaacaaccctgggaataaaaatattacacaccaaaattcaccagacccaaaggctatacagatcaatgaacttctatactagaactggcatttggaacagaaactgtgaagctttacattaaaatttacactttggtatcaaacattttatacatttacacaccaccaaaattaaaaagattcaatggcagatttagaattagaaaaacgattagctttaggttctgtcctactcatgtccattacctgcatcccgtccttcctcgtccccttaaatttagcctttcttgttctaatttttggatgttatactaaactttttatactatatatttaaaaacataaggtgatatattaaaatattttggttttaaaagtgtgaacaatttttaaaaagcaggccaaaattacgtaagacatgcacaaacaaaccagacaaaaccccagtgctcagaaggggaagtgaacacaaaatcccacccttaaccaaggagctatttgctatagatacctgctgggagaggaagtaagttttcttccatggagagacactgggtgtatcagcctccctaaggggcaggccctatacccaggaatagttggtcaatactaattggattccatgtgtatttgtggttgtttatttccctttggttgattgttttgttttctttgaggtggatagggaggtgggagagcatctgggaggaggtgaagaagggaaaagggtgggagcagaaaacattgtatgtaattctcaaagaataaaaacgtttttaaaagtggaaacaaaccctccaacaaaagaaacaagataaagaagaaaacataatccaatgtgccaccatgttttcattatcaagcatcaatatgtaaactttagaacaaaattaccaggaatattgatcctaagctagatggacactgtgtatgggatagaaggccaaattgaaccttgaaagtttactgtttccttacaagtctcattttgccacttaataacaaagttcctgtctctaccattgaaggaaactataagggaaatcttctaatttaaccccaatgtgcctagataagccaaaagagcagaaaataaaatcatggtgagcagccactgcttatgggaggctttatataggaaatgaaatattaaaaatttgttagatctatccctataaaaagaaaagacaaaaaaaagagagaagaatgagagggttggggagacagggactgcaggtgctacaggttagaaatacaaagctactcccttgttaagctcagcattgcttttaatggatgatgattcatagaaaatctagagcgaaagcctggttagttcctcaactaacattcacccgagcaacacaaatggtccatgctctccctcactgaaaaactttcctttgattttttcagatcttaaaaatgaagaatcaggtcagtgatgcggctctatgtactacatgccctccaaaatgtttagactgaaatagccttttagtgggtgacctacttagtagccccaaacagaagaacatctctcttgtcacacttttttggttttcttctgtttcattagggactttggcttctcaaataaccaatattcttttaaaggtctggggatttgcaggaacttagacttggactgagaggtttttcagttctgggtaatggaaaaagtggtgggtaacgctttgacttctatatagttctgaaaccgcgggcacttaactttctttaccccagtttcctcatctacatgatggaaaaaatattttgctctacaacccctcaaaaagccataaaattttggagagaaaaatcaatatcacaggaggaaaatcaagctgtttaccaaaatccacatttctggtttattttatgtcttacttttctgtcttcctttctcctagatgtactttgaaaatatccctcagaagtagcttttatgcaattttattcatttatcatctttcagaaaatcataaaaaaaaactctcaacacatatttgctttctctgccattgagtagctcctgtaagacatatgttctacaaagtaggggctagaatgagctacaaactttatggtacatactaatctaggtcagatgggcattgataaagtacactttagtaagttgaactgagctttggctacagctccatccaaaacagtgcttctcaacctccctgctactgtaaccctttaataaagttcctaatggaatgataaccccccaaccataaaattattttcggtgctactttataactggaatttttgcttatgttagggaattataatgtaaatatctgatgtgtagggtatgtgatatgcaattgctaagaagttggaacctacaggttaagaactactgacccaaagatgaaaaagtacttctagcaacataatgtgattgctaaaatatacatttttaaatttttaaaaatgattctgtttatttctattctaacaataataaaattgctcttatttatcatttcgttttttaaattttttaaattaggtatttatttcatttacatttccaatgctatcccaaaagttccccacaccctcccccacccactcccccactcccccactcccacttcttggccctggcgttcccctatattgaggcatataaagttttcacgaccagtgggcctctctttccactgatggcctactaggccatcgtctgatacatatgcagctagcgacacgagctccagggggtactggttagttcatattgttgttccacctatagggttgcagatcctctcagctccttgggtactttctctagctcctccattgggggccctgtgatccatccaatagctgactgtgagcatccacttctgtgtttgctaggccctggcatagtctcacaagcaacagctatatcagggtcctttcagcaaaatcttgctagtgtatgcaatggtgtcagcgtttggtggctgattatgggatggattcccgggtatggcagtctctagatagtccatcctttcgtctctgctccaaactttgtcactgtaactccttccatgggtgttttgtcatttcttatataaaataaatgtcttattaaacaaattgcttaagtaaccaattttaacatgatatttttttaaaaaaatactttctaaaagaaagtgaatgctttttatcagagtttattcttctgaaaaacatcctgatatactatacagattttagttccatgataacattcataattcaaggagtattaagttcttctaaaagacagcctcattgtttgttttcaatattatttagggattttttttcctagtaaatcttctataatcttacaaaatcatgttccattcgactgcctgagataaaagagcctgtgatagcattataacactatcattaacaccattgtcaatagatcagatttaagcataaagttcatactgtagtctatatccaccaggtattaatgaaaataggtagtgtagtacaattgcccaaatataatcagattttcagtagagtattatataacataatgtccacactatgttatatacagtcttttttgctgtgaatattcaaatagttatataattaataaaaattcttctactattccttccaaagatcttttttaatttatttttatttttatgtgcattggtgttttgcctgcatggatgtctgtgtgtgagggtgttggattcactgaaactgatacagatagctgtgagctgccatgtgagtgctgtgtattaaacccagatcctctggaagaacagtcagtgctcttaactgctaaaccatctctctggctccccaaagttcttttttaactcttgaggccttcatatgttactggagaagaaaatcagttagaagttgaccttcctttagtatccctgtataccaatcaatttacaagaaatgtatgatagatgtatttacaagtgtgagaactaccatagaaattaacagagggtcaaatgagaccatgataacttcttagggctcagagacgatttacaaactgtagatcctaagcccaagatttagagcactacctgtttcatttcttccaatttcaatagttatttctttttctcttatctgggaattacaatataatagaacatgtctcccttccctttcctactttcagcctttcccatatatccttcccacttttcaaattcatggccttcttttttcattatttgctattgcatctgttatgcatatgcatgtacatgtgtgtgagctcgtgtgtgtgtgcacatgtgtgtgcatgtacattgtgtgaatgtatgtagagacccaaagttgatatcttgtttcatcctccatcattctccactttatttatcatggtaggttctgtccttgaacctaaagctcactcactctcgaggcaatctagctagttcctttgtccaggaatccagtctgaatggattttgtcacttactagctttctgacaaggggtaatatatgtgtttgcctgtatttccatttttctcaaaagaaaccacaaatgaaacctttacgtagatgagttaatatgtacaaatcatttggaaaggtccctgatctatagtgttggtataccactttgatgtccaaaaaagcactgtcatacaaatgatctcatgtgaacttcacaataagatgcctgcaggaaagatatgtttataccgaatttatacatgaacattgaagattgaagacttctagatgacttgtcaaaattttacttccagttcaattatcagtacgtaacagaggaagtgtgaaacagaagcgggtctgctgacccctagtctagtgttcttgctttaaacagcaccatttgctttaatttctacactactcattaaataactcatcaaacccaaatgtggtctactcatcagactctatcttaaaatgatggccaagcaattagagatgatccaaagaagaatggcaagaaaatgattaaagcattaggaaacagtaccttcgaggaaaggctataaatgagttaaggttgtttatcctagggaaagagagccaagaggcagtttaatcaccatgctcaagtataaagagttgtcataaagagggcactgaccaactgttctgcgtgcctaaggacagcactggagcaaatgagcttaactggaccagagagacagtcagcactaggaaggactcattataaaggaaagaggaaagtagaagaaagggcaatcactccagttcacactgtacgaaggcaagactctgttgaattaggaaaaggttatgattaacacatttttcaatatttgtttttcaaaaatgcacaaaattgcaagtttacactatgtgctagcaagtaaaaatctttaatgaatagaaaaataaagtatactattcctgggaatctgtggttctaggactcactacaggtagaaaactccacaaatggtccttttataaagtgatatcgcatatgtatgtatggtctccttgtggatttttcaaggtgcctttcatttgaggtcatattgctttttgatctcactgaattcttcatgttcaaacacctccgcttttctcgttactgtaaccttaggtagtacatgtggatcaatcaactccctttgaggagcaactagattttcagcatcatgtaaaataattacatagaaattcataacctattcataaccacctatatagtataattcatatctaaactattgataatagtggatagaatataagtgctacacgtgggattatccgtgggataatggcaagcagaggctctgtatgcatttagtaaagatgtgggtttttgaaagtatttttgatcccatgttgggtgaatttgtaggtacaaaaccagaagttacagaaggctaactgcaattcttaacgtccctgtctatcatctatccagaaagttatccccttaaatagatttacatgatctccacttgttcttcaccatattttctctttttctaaacattattattagtatattctctgcctgagttataacatgaactaaatgggatgaagcaatatgtttaagttttctacccagcaaaatgctaaaatgtatggatttctcccagtactctctcatgccaacttatctcttcatgggtgatctaatagagtcccttgggaaaacagtctaggagcagatcaacccctagcctttcctctcaatgctcccagcagaacagcacattgacttactaccacataagacaatctgagttagcctctactcttagaatagctttgtgcatggttcagttgaataaacataagtttgagaagcataaacacgtgagttcaaatcctagctctctcacttctctattggatgatattgaggaaaatggctgtttatttaaggcttaatttcacaagtatcttactagcttttctttgctcaggaaaagaagctatttaagaattgttactcaaaaatggtctccatgtggatttttcaaggtgcctttcatttgaggtcatattgcatttggatctcactgaattcttcatgttcaaacacctctgcttttctctttaatgtaaccttaggtaatacatgtggatcaatcaactcacatactctttgaggagcaactagattttcaacatcatgtaaaataattaaaggcaaaaatcttgagccatatatagcaattagtacttttaataacagatatgtactaagtgcttatagccatctcgtgtgtgtgtgtgtgtgtgtgtgtgtgagagagagagagagagagagagagagagagagagagagagagagagaaggtaacctagaagtcatacagctaatagttgatgaagctagaatttgaacccagggaatatagatgcagatgctattaatcacagcattaattggccctgcatctgactgaatttttcagttggagtttattcaaccaaaatttataagataagcatcctgatgaggcctgaagtggctttgtttacacaacaggcatttcacagatattttctccacttgatgaggagtcatatcccattaacacagagaattgaaaatacaccctcaaatcgacgctttcgtgaagtgctcctttgtaacaaacaggttcatttacttacagtaccaaaataacccagctttgaaatgagatccacaaaggcatatgtcgtgaaaagaacttccccaaagtgatctgtatataaatctagcatagctaacgaatacctaaagaagtgtggcctccattgtcttaccatagtcttctggtgatatccgatcagcaatgccccactcccaccctacctcacccccaccttaatatctagaaaaccaagcatgaacgagaaatgtaaatatttatagcagatggatttcagatgggtgcttagacttgagagtattgcaagggccatagttatcctttctcccactattaccaccagactctaatgggaggaaatgttgcctttaagcatcaaccttcagcggactccttatagtacaaactctgaaacacaaggatcttttctttccttgtggccttaagagcatttgaaagattagtactgagcttcaggaacaaggtaagggggaaacagacacaaaaaccaaactgggcaagccaaatcaaagcacacactatgattcttaggtaacaaagggagtccttgaaaacaaatcagaatgcaattagaaataaacttgttccctaacatgtaaagatgtttgtcctgggaattggtaacaggcagcactattctacattgagggactttagctttggttataaaaaagaaaagaaagaaaagaaaggaagagaggaagagaggaagagaggaagaaggaagaaagaaagaaagaaagaaagaagaaagaaagaaagaaagaaagaaagaaagaaagaaagaaagaaaggaaggaaggaaggaaggaaggaaggaaggaagaaaggaagaaacaaagaaagaaacaaagaaacaaagaaagaaaagatggcttgattatctggtcatacctcccagtagacaggcctggtaaatatttagaagcaaatcctctctgggaaaatataaaaagaaaaactcattcaagatcattactttgaaacagaaagactcttttatgtttcaggtagtaaaaatgttgatctcaaaaaggaaatgttcctattagaccaacagtttcctcttcttattttttaaaaatccattcacttgattatttcctaggaggcttggaaggatatttttaaaaatcaacaaaaattcaaattacttttcattaactaactttagagttccttctgaaaattctcaaggattgagacacttggagatgaaggaaaatatccaagagttttataaagcagaatacagaagcttgaggcagaagatctggattttagccccaagccataggacttcacaatgtatcaacatttcctaatccctaaagcaaccgtgttatatgttccaagagacttctagttccaagagacgatgatacctggtgctttaaaaaacaagatagagcgtttgattcaggagatactggttgagaggataggggtagtgtgcctcagtggtaaacgtgcatgatacaacaggttaatctccagcactgcgatgaatggaacagaagaaagagggtgaactgtggcagggcagattgggagaagggaggaagggagggagggagggagggagggagggagggaggaaggaaggaaggaaggaaggaaggaaggaaggaaggaaggaaggaaggaaggaaggaaggaaggaaggaaggaaggagaaaggggaagggaaaaatagagaaaaggttcattttgtcttacctagttctatacaaggtaagtggaaaatagtaaagcgtccttactgaagaaatgtacagtctagcaggctgataagaaaacacaataattctggaaggcagaatatgacaactatctccgatgtgtgccgaccttcttgctttctctgactgccagctagtgaccatcattaaatgttttttgctgactgaggtgcttgaaagcctgaacatcggggagcttttctgagacctgggaagatgggggataaagagaatgagataatatgcccttaaggccacaacaccactaggaaattcatttacctctatccttagagcacagaacaacaaacattcctggtaataggagtttatgtttgatcaaagctagtaccacatatgtatatacataaatataacatcagcccttccagaaaatgcctagggaattattctattaattaaaggtttctgatagttggattctgattaaatgagatttgtttgttcattacaaacctatgctaagtccctcgctgtatccacatcagctactctcctccttcctgcttgcatgccctttgcatatacaaacatcaaggagaaaacaggaaaaaaaaaacagttttactgaatcaagacagactcactccttgtcttaacatcagaatcttaggactaagcctggtactttatacccagatcttcaatatgtgaagcaatacaagtgcaacaataaaactgatgtaaatatcacctttgtttttagttaaccctgttacaaatcaaaaggaaattcagaataactacatttaaaaacaaaaatagaataaaaccgtaaacaattatagctttgttatccctctgcaggaaatgcatgtattttctgctggcacagaaagaaagccccccagacacgccaagcatgagtttgtgcggcttccttggtgaacatcttacttaagtctttgcaggcactgagggcttgaccgagtcctgtggattttgattactggcttgtaaacactaagtcttttttaaatcaccattgggctttattaggaaattgtctcagattaagaacaacaaacatgtagtaattagaaagtttgtcatgcagctgcatgattacaggagcccgtctctagattctaacagatgttaccaaaacctctttcaagaaagctgggagaaccacagttcgtgagagcaacacaaaagctacttattgttcaaacccacaatgccacagatcccttatatttaaaatgacaaggctcccctacagagaggtaccaagcaaatacaaaaaaagaacagtaacaaaaaattaaaataaaacatgtagattcaacttcttcaccatgctaacaacgaaaggcaaatgcaaacaatagtgccatgcaaatatcttgactttttttttttaaaatttttattagatattttcttcatttacatttcaaatgctattccctttcctagtttcctctcggaaagtcccctataccctccccccaccctgctccccaacccacccactcctgcttcccggccctagcactcccctgtactgggtcttcacaagactggctcctttcattgatggccagctaggccatcctctgctatatatgcaagtagagacacgagctctggaaggggaatactggttagtttagctccttgggtactttctctagctccctcattgggagccctgtgttctatccaatagatgactgtgagcatccactcctgtatttgtcaggcactggcatagcctcacaagagacagctatatcagggtcctgtcagcataatcttgctggcatatgcaatagtgtctaagtttggtggttgtttatggcatggatgctgactttgatgccactgaacatggcaaatagcctgaacacacatgatacgattatcgtgaaatgttcacttggcccttccagttgaaggaatcttctttgtgggaacagtttcgcctcagtccagataaaagtaaccatgtaatggtctatagcaagggattaagtagattggtgacaactcttatcacatcactaggagcagagctaaaatagaagatagtaagtagccaagcaccactagtttattatcaatcttttttttttttttttttttgaggtagggtcttactgtgtacctctggctggcctgcaactagctttgtaaaccaggcttgcctcagactcatagatatctgcctgcctctggctcacaaggataccgctatgcccagcttacctacttataataaacttatagctaccaaatagcctccccagtacacaaatacaaccccctacaacccctatttcactctgaaaatgaatatcaatctgattaagtgtcttttcaaggagcacagcttgaggttaaaggttaagactctacctaagttctttttcaaaaatcatgtctgcccttgcacagcaaaccccgccccatctttttttgttactttagtgacagtcagccataaaatgtaaaaagaaaaccatcctaccagtacaactttaggatgaatcagacagattctctaaggcattccaagatgctcagaggacaagtctacaatccaaggcattataattagaattgtgcaccttactttatgatgaggaattaatgagtgggggaaggaacttgagatcatgcagcctgaaaattcaaacaggaagtatgcacctaaaggagcccagccaggctgcagtagaagcacatgtgtgagaactgcaaggcatgttcccagcccatgactttactgtttgccttagccagagttgtgtacatcaccatggtcatcgttaagtattagatttgtgagtggcaccggaagagcagcaattatttcactgttttttattggactgtggttcagtaggcaaaacccaccttgcctactatagtgagatgaactgatcatacatagtaaggggcatgaactgaaattgttttcatgtcttcagttgaatctcttgtagaaggcttagctgtaactatacctaaactgtgttttgtaagaactggagaaggctaaacatagtggtggatgcctttcatcctagcactaggaaggcagagtcacttggaactctgagtcccaggcccgtctgttctacatggcaagtcgcaggctagccagggatacataatgagacactgtctttagaaggttggaccaagaatgtgagacctctaacaaaattcactattagtagtgatatgcttgccaattttaagaccatgaacactaggaagggggaaagtgagtaagtgatttccacgttggaacctgcataagagcttaaaggacacctacccctttagaggcaaataacagaaaatagtcacaatatggtgtgacctcagcactaccgtatctttgaccaagagatgaaatccagacacattgaaggaatggactagacagtcaaagaggatactcacagcaagcttcttaatgggccctcctaagtgacttgcctttgactgatatcacttcaacacttctgagagtcctttgcacttctcttgacctatttcagactactgcttgtgcttaacttgagaacctgtgacacaataaattgctcctcctccctctttcttagccaatataaaattaattgttgcttaatagactgctttgctgcagttttctcaaatgtgcaaagcaaacacatccattttttccacatacattaacttaatttctgtctcacccactcaagcacaacgcaatccttccaatgctgaactaaacaccttacccacttggtatccatggcaaccaccaccaagctgctcagagagagctgcaagtagtggcaggaaagtacacctcccagtggagctattagctcttctgctttagccacatcgataagaggtggcgctaggtcagcccctgaatcctcgggaattttctttcttcagaaaggagtgttgttcacacccttgtctcaaggagggagagttgggatcagctttcagttttccattctcaacctgttgaaaataaagcagtcagtgtccatgttggaagaacaagacactttgcataaagaggagcagctcaggctcattaattgatggtaaggaatcatcacgtaagcatcctcttcctaaattctctacaaataaggatacgttaagaagtgggaggaactaatacatagctttagcttcttaactgcatcaaaggaaggaaacgggaggccactattctcgatgctttccagtcgatctgctgaaacataaggagatgcttcaacaaggcaacattccttttcatattgcttctctctgaagttcttaggaaaggactagccatacatttacagaaagggtggggaaaaaaaccaagtatctctcatccttcaaaagtagagatgtaacccagtgaacagatcattgcaatccatcctgataagtgcattgataaaggaacacacagcttgtaacaggaaggcaaaaagaaacataattaactcagcctgactcagccaatcaagaatcctgacacctcatgattgtgctaagtggggaaacaagaacccagtgaaattcatatggtgttgtggaaggggacatatacttctatttacctatgtatgacgatgttcacttaattgtcagaatgagtgccaataaggagcaaatgaaaacctaaggctggttaggatgtcataaagtagagtagtagaaaaatactactaatatcatgtactgtggaggctggagagataacacagcagttaagagcatgtaccgctctttcagaatataccagttcagctcccagaacccacatatttgcaaccccagctctaaagcatctgagaccattctctggtcttcataggcataggcataggcatgtgcacgtgtacacacacacacacacacacacacacctcaaaaaataataacatgggcccaattggtcagaacacaacttgcccctttaccaggacctttgaatcctctagaaacaaagttttttttccacctgccaatagtgtagcatgctatcagaaaggacaaaattctacttaggcattcaactaccctttaattttaattgaggtgttgaggggtgggggactagcatgtgtaatggtatcacgactagagaataaaagaaccaggatttaagaatttggttccagggcccatatttttatagctaccaaacacaccagtacaaggaccctatgcatgggttcccttgactaggccatatgtcttctccattccattctgcccactttccacccaaacacaagaaaccagtgctaagtttaagataggactagtcacatgaaagcataccacactagaaaacaacatgtcaagagagtcccagaacccatccttctcctcctttctgtatcctcttcattttttttttttttgtccataaacattcattgaatacctacgtatagagcactacactgaaaaacactcacaatccgaagtagaaaaaacgggcttctcccctcaaggcaaagtagaatggcaggacccctatctgtactgggtaaacatttagtagactggaaaagatgagaatatgagaccatataggaaccgacaaaacacaacaagaagtgatccttagaaaactgaagcagaagataggattaatggagacatgtttttgtgctttgtttaagccgaggaacaacttggtgaatactaggtattgataaacttctggggttggtaggttaattggttggttggccttttctctttatgtagccctgactgtcctagaattagggatgtagaccaggctggcctcaaactcaccgaaagcttcttccaccaaaatgcagggattaagtataggtaaccccattttcagcagtcaacagttgttgaattaaataaactcgcatcctgatatttgttctaaggatggaaggagcatcatttgaggaacatccaggcttataagcattgcatgcacagtgtatgtagcttttggttttggtgcacaacaggagccttctagatgtgtagaaattgtgatcactgtacttatgacttaaacctttgcaaatttccaccaacgcgttaatatggatacaggcatgatccttagaaatgtctttcaaaaaacaagtcttgctactagctttgctcatctgatgaggctggacttgaatgataatattaaaaataagacttttaagtatattttagttagaactgaaggagaaatagttatgatttctgtcagtaggcataggttgtaactctctgttttaggtgcttatggtctactaggagtagagggagctcagcttgtatatgcttcagaaaatcaatttatttgatgaaaacgtaagatcaggaaagaaagatatttccaaataaccattttgtacctccctaagtagtccaattactgttcttctaaaactttctactacagtacaatttcttttttcacttatttcactgtgagcattccactaattctctagtgaattttggcttccaaggcttttgaagataaagacaatttgatgacattgggcttgtttaggatagtatggccatagacataagacatgcaataagaatctatgggaacactcaagggagacctaagcattcatacacaaaaagtgagaaccactgtaactgtgacctggtaacctcaggaaccagactgctgtgccagcatgcagcaccaagtacaatatatttcaaatatatacttaatatactagttaatatttgatgaagttaacgtgtacattattttaattagtatgttagttaatgtgcaatatattcaatactctctatattaaatgaattgggtctgacttcacaatgttagggtaaaaagcttaaacatgtgtgcactctgctttgacttcttccaaagcctccaaagtcattttcagctctacggatatacggtctaagcattagaaaagtccaactcaccacactaaatggtactgaatatattgtccactgtggcctggttaccatcttccaggtgtagttccgaaggcaccttcttctttgtggcagagtctaaggaaatggtttgaaagctcatgcctagggtagccttatatcctaaagcccagaatctttgattgagtaacttttctgtaataccttcctgagttttccatgtttaaaagatttccacaagatgattttgaccctccaacgtaggtaagactcgtagtgagtttattttctccattgcaacaagaaagtggcacacagaagttaaataacttgccaaagatcacacatttcagattgcttcattcttctccttatttcctcaaaagctcatttttttggtaccacatcataagaatgtatttgggaaagcagcaatgggactcttgctatacaacattaactgtgtcctgccagagtcagttcccttgctttccaaagctatgggtaagaacgtttactttgggcttagtcatttctctccccaccccttcctctgtttcctgaaagaacaattaagatccatctgggactaattataatgattcttgaatttgaacttgcaaccattacccaattgaggtcacttattttaaattaacttgcctggtcagaacacaggtttggttatcttcagaacacagtgcagagaggccctggctcactcagacttttaattaactagctaaataacatgcactgtgacaagctgcctaagatttgatggagttgtacatttgcattcagacaaggatcaaaatacactgttcagcgcttcggggactaagtcccagaaactttcgcactgtatcttgttcaaggctgtgtgcttcttccctttggttacctctaattattttcctgtgcttttgttctgattatccaacattcatcacaagtgcagcttgtgattcaacaatgacaattcatgtcctatgctgatagggaattgaaaattggaggcatgtgcatatgagccaagcacaaagcttcgtgaaataattagggaaaccaaaaggagattcccgggatgccccggggtgaaaaacacagactttctaaagagtcagacctcaactgctccccacttaggtaatcagacataataacactaggtaatctttgttgcatagaatttgtgatgggagctaatcacagtgtaataataatgacagcaatgccagttcttatcaacagtgattactagtagtaatatggctgctaacagtgactaggctttggagttagtaaaacctaattttgacctctttctccaaccccatattctttttttttttaattttctcatacatttaatttgaatgaacgagcacagcaatcctcaaagtggacatgggatcatttcccatgtatgtgagaaaaacaaggctccaaggaacaggcaggggcaattcagaacaaagccagaacctaatctcaaataatgagagctggtagcagacaatttgagttggattttgactctagcacttaaagatatgtgactttgaatatatactatctcaaagcccaaatattctcacttgatgtgaggctaagggtaatacctaattagcagaatagctctttagttagaaagaacttgaattaaaaactactaatcagaaaattatattacagagatgtagtaaacagtacagtaaggacaaaagcagacttaaagcagtaggctagagcccagaatttagccccgacatacatatttgtttgatgtgcagtaagagccccaggaagacataacatgcaaagaatatttttccatatgcaaaacaagcatgtgttcctttaccttaggccacactaacatctattcaaactgatctttatgagttttaagtgcaggatgataaaatgaaaagggagatcgtcttcaacaaatagcgcttgtctaattggatgtcccacaaagccatcctctgttacatatgcagttggagccatgagtcccaccatgtgtgctcttttccaaccctatattcttacaacttcaaaccaagttgctaaacctttctgagctacagtttcttagcctgaaaggattcacaatagggcctaccttaaaggattgtgctgtggattcagagaaataaagccaatgacacagtaaagtgcccactgagttcagatcccccaaagtcttgtttaaataaagtcatgctctacaatatgtacctttaatcccagtactaggaagatggagacaggaggatctctgagacttgatggccaatcaatttagctgagtcagtgcattcccagggttcactaagaaaccatatctcacaagaataaaatggaatagtaattgaggaagattcttacctgtagcctacggacacacacacacacacacacacacacacacacacacacacacaccatggaaagagagggagggaaggaggagggaaggaagagagagagagagagagagagagagagagagagagagattttaactggtagaggtggtatactcctttaagcccaccatttgagtgtctgaaataggagaattgctgtgagtgcagggccagcatgaactactgggagatttttaagccaacctatactacatagtgccattctacttcaaatgaataaatatatgatagatggggaggcatttagacagatggatgggtagagatagatagatagatagatagatagatagatagatagatagatagatagatagatagatgatagatggatagagatagatgatacatagatacatagatagattcatagatagatacataaatacacagccagacagagaaatgatacataaatttaagacagtacttggttgtattagtcacttttttgttgtggatagaacaccatgaccaaagcagtgtataaaaggaagagcttttgtgattgggttacctcactcaggatgatgccctccaggtccatccatttggctaggaatttcataaattcattctttttaatagctgagtagtactccattgtgtaaatgtaccacagggaatgcaagggccaaaaagggagagtgggtgggtaggggattgggggggtgggtatgggggacttttgggatagcattggacatgtaaacgaggaaaatacctaattaaaaaaaaagaaaaaatttttaaaaaaaagaaaatcttaaaaaaaaaaaaaaaggaagagcttatttgtgtttccagttttagggaggtaagactccatcatggtggggagacatggcaactatagcaggatgctgagagtttatatcctttaccaggaggatgatacagaggaagcactgagactagtatgaggctttgaagcttcctagcctgcttccaatgatgtacttccgaacccagcaagaccccacctcctaaaactctccaaacactgccacatacctggatcccaagtgttaaaatgctagaacctaagggggatattttcattcaaactacaacacttctgtacaagtcatcttttatataccaccgaaatgccttttgtccaacttttccctatctgggatttttttttttttgcccttttccctgaggaaggggaaactagaagggtcattattttgtggttgatttactaccgtcttctcatcattttgcatctgcatctctaacacccaacttccatttgaaaacctcagctggttctctcatcttcccagtgctatcctaataatcagcaccagcattcctctgtatccaagcactaagttatcttcccattattctcacccaatagctgcaggttgtttgtttttaagttggggacatgaaatcaaggaaggctttatgcaggaggctgcctcaacttggtctttaagaatagataggagttttccagggaaagatgaagacatagccaatacaaggcaagcactagacaatgtcttaagaattgaagacacatggtttcacacatttctttcttcagttttgtgaaatagctattagtgatagatgtcttttccatgtaggctactcagacctagaaagcctaagttaattgaccaaagttatgatgaaaagtagtctctaatctatcaatctagccttcattgttaagtacactactttatttttcccatgattatatcccctatatttattattttacaaatgaaaaactaaggctggtatgtaatgtaacttgtctgggattataaagctaataaatatcatgggaggtaggtttgagggtagaaagggagaaggaaacaaaataattgtaatttaattttgaaaactacaaaaacatagatttatgtgttgatacatgcctataagcctagcactagggaggctgagatatgatcatgagttcgaggctattctagactatagagaccttgcttcaaaataaataaataaatatttttaattaaaaaaaaacctctcctttagcatttaagcactataaaacagcaagactcttgaaatcaggagaaatagccttctagaatatgtctctcttcattttcaaaatagcattctatttaagttacctgtttgtcaggttcccatttataaaagccaaaggaaaaaattttttaaatttctggttggagacaaagtactttctatctatagcaggttgagttaatcattctctccttggttgtactttgttcatatttctgttctcgcacttctcccactgggctataatcatctgttaacttggctgtctttcccattcaagtgtgacatcctccagactagggcccagattcttgtgacctctgtctccccatgctctatccccatgattggcaccgattgagcactcaacaaacattcattaagagaaggaaaaataaaaggtggttggtagaggcagctttccatatttaaagggccttcaatccacattcttcctgattccggtggtgtgccagaaagtgggctattgttaaaaggcaaaagtgttgatttgtagtaccttgatttctgggttaataattctaacattgctggtttgaagcgacccaggattttattaactggctcagaagattctgaatagttaacacgtggctttcagaagctctctgtgcttggctggaaatcagcagttcttcctggggtacttgaaccatttgctcgccagtgtgatcatgaaggtggatgagctggccaggagggcaagatgatgccagatccaaatagcaagagtgaagggccaaaggaaacatttctgagtttagagaattgtatgctttgccccccatgaactaagcctcagtcatttgtcatccatttgcaaattgagatccacttaaatgacatggctcccagaagaggaacaaagctgccaactaagcaattatcctgaaaatcacatagagttcctgagagacagttatttttatttgaaaatataaacatggtcattcactccaactatcaaatatttttactgattagggtgtcagatactgaaaacactgcacaaatggaaaattattaagaaaggcacaactaagaacttgaaaaagagaccattctattctctgtagccataccagctgctttctttccactctccgcctgaaagcttcatcagctcgagctacacgagggtctctaatattatgccctactatttacatttcaattttgcatataataatgaagctaataactaaatggcaaaatttgaattgaaaaataccacacatcagggttcatgtttcttggttttttttttctaatacatcaaatttaatgcttatcaggcaattccttataaaatgacgctatttattgtcaagcactgaaccttttcttgaagttcctagtttagaagacatgttatagtatctgatttatggggagatatcttacacttatttcatcaaaggaccggtggatattcctccttttttattcaaatgacaaggccactcccattgaaatgcctgctactcatcacctatacagtctcttcagaatgtcaatgagcatgaaaatatataaacagaaagcaaagccttggttgaacttttagaatacattatgcatattaaaacaaaactctctgtgaatgtagctatgaggattgccacaagctaaggccagcctaaactacatagtcaattcctaggccatcgatgattacatagtgaaacacagtattttaaaagtaaaaacagggaaactaattaattatttaggtctattttaaaatgtgtgtgtgtgtacatgtacatataaatatgaagatcagaggacaacttaaaagagtcagttctctccttccacaatgtcggttccagggattgaattcaagtcttcaggcctattttcctaacctactaagccatcttgatgaccctctcttgtgatttgttattaaatcttccacatattgcattaagctacaataaattgaatatgaaagtcttggaagtaaagctaccttcaaaggataatctctggtaaaattcttaccctctaatcctctcatcttagaattgtatttcttgccttattcatttcctttctttccacgtaagcttccctacagtcagcataagcattgacaagattcctttattgtatgaccgtttgtcttgctgacaaaaagcttcagtcactctccgtgtccgcaacaccccaccccccatcccaacacacacactgccataggactgactttggtatatgtcattgttctttcttaccacactattccagcacactcctttgggtaagatgactgcaatttaaagccctgccattcagacatatgagaacaaatatgtgcaccttgaatttactaggaaattatgccagtggaattggcttgtgttatgtttactaagactcagacaaattcattggggtcttcactaaggaaggcaaacacctacaattggattgaaaatctcttctggaaggtatggcacgataacaggctggtttctgcagcacaccatgcattcggctccccacactgctgaaattacatacagtgccataagaaaacaatgtcttttttttttttttactaagagaaaggggaaggcagatgtgagcctaaaaaatcttttctttgaacagaaaaatgtgatctaataggtttttttttccttacaaaattcaaccaaaaatcctccccacaaattcaacctttttttccccagactcccttgcccaaaattttacatgatacttaaatcaaagagaaacaaattagggtgaacatcaaggcctgttctgtactcaaagcaagatcaatctttctccatagatccttttctggcgctgatgtagaaaatccaaacatggagatacttaggtctgcaaataacctaatctgcataccagatggatctaaggggggaaaacatacacacttcttcacacacatttttttttctaaaatgtgagcatagaaaagcagatgcttttgcctcccaaaggatacgtgggcctctctcaagtagtcttgtggaacaatttcatttcaaatttctaaaatgatgaaaatatctagattaaacatgaaattgggaaaggacgggtctccttgagagacaatgaactgaatgtcttataaatcctttttaactgcttggagatattcggcctgcagtttcatagaaagatgcgatgaggggctgtttagaaagggaaaatgacccccaaatgagtaaacttttattccatgacttctttgacggaaagtttgacactgtctacatgtccaagtgttagtatatatgagatctttcttatgcaaaaaaaaaaccctctgctcagtgaatgagatttgtagctagttttttttcactttgagatgctatatgtgaagataaaaataattttccctaaaaaaatgaatttcatctatacttgatacattttccccttattacatttatcgtgtctgccatcatagcaggccatttatcatccctagcaaatcttacaaaggcaaaatgactgcagaacatggatgtgggaacttggtatttcttccttaaatgtcacatctgagtgtaaaaacagctttttatctgtgaagttctaaaactaattcagaaagatctattataattactataaaagcaaagttgaatattctcttggataccagagttattaagtaagtgagggtagaatttatgtctctttcatctgtaacagattgaaagaatggaggttgagtattaactgaacaagaactttcctattaactatccagttctctggtgctccatattatattcagtatccccagcccttccctgttttcacaagcttttcctagggaaaaaaaaagttaaagggaaggcgaagagaaaaaaatatagcacatttctcactgaagcctcagttagctcccatcagtaggatgatagcagccccacagcagatctcaagacaacagatactttctctctaacaacctggagatcatttctgatggaagccttccttgaaacatattacatggccctgatattttcatcagaagtttctgatcaaagtaaactattgtctgatgactcaggcactcacagcaaacatccctgattatactgtgcagtagtgcattgttgcctgcttttctgttgtttcttccttctcctttaagccagactgtcacttcctctagtactaatgcacctctcccaaatatcactcccagcctccccacacaccccttctagcttgaagtgtttaatttactgggaactggaaaaaccaagattggtaagaactgtatgctaaatcagagttaagaaggcactgaaagcaagcatgaggaattaattatgggcttcaaggcagcagctctgtgacacctaaatgctcctatctttagataactttcccatctcctccaacttaaggctaactctagaaagggtgatgagagaactaccttccagtatgtctatttgttctgagcacaccatctgggcatggaccaaaacagttattctaacagcttcatcttttcctgaagctgaagatgcaatgtcttaatgaacaccccatccctggaaggaagtaatgtggcatacttcatcattctgatctcaaccatgtttggagatgttctctcgtttaatcaacgcaaccttgttaggagacctagggccaaatggtggatacgtgaatggaaactcagaaagttgagtgatttgtccacagccaagcagtgagtgcatgaccaaatcctacctctggattgtcattcaggactcagctaatggcactaccattgtgtattgttccttctggactttcttatgtgaaaaaagcacaataaatatggtctccactgaaacagccttccttatttttctccgagtttgtcatgtgttcatttttcatgaagtattcaaaaccctctagttttattatgtgagggttgtccgtgaattaaaaattcaacaaatgtatggtcccaacttgccaccaaaagttaacaaatgtcaccagcaaagatgtttctcatgagcagacactgaagaatacatcccagaagacacctaacagcttattttgtgtcatggcaacatgagaaatcacctcctcaagatattcattaacctttcttttccttcatacacaatcagtctgaaatgtggctcatattttaaattaattgaaaacatctctctgtactctctcttatacacacaaatacacacacacacacacacacacacacacacacatacactggcttgagtctctataaaagcaagaaagtaaacatgatactcaaaggtacaattccatttctatgggccaacctaacatgtaccctctatggcgccttccctttctgcttcatgcctttaatcatctcgccttgctcctctgcaaaaattgagaacaatcatcatcacttagcataaataaaatgattggaaattgaaaatgtattaagtcatattactcttaacctacctcaaatcctagcttagcctaatctactttaaacatgctcagagcacgtgcattagcctttagtcaagtgaaatcatctaacacaacgcccattttataaggaaccactgaatgggtcctgtcatctattgagttctttgttgaaaggagaaaagaactaacatggtaaaagacctgaggatgggagtgtgcagtaaagtacttccctgcaatgcatacatccctggcttccatcactatcacttcacagaaataaagttcaatctctcctgcatgtccataatttagataccaccataaagttgaaaactcaggaggcaaattgaaacatgtcatacagtcataccaaggggactggttctaaagcagtactccaactcggatatttgccaatatagaggtgtgtgtcctttatacaaaacagcacactattcatgtctttctatataccttgaataatatgtacattatttatattaactaatactacataaatattaaacaaatagttcttgtactgcactgcttggagaaacagagacaagaaaatagtctgcacacactctatttgaaatgatttttcaggtgttttcgatgtgagcttgtttaaacatatggatgcagaaaccacagatatggaggatctaattgtacctccagtccttccccaggaagaaagacccagcttctaatcccagctatgtgaccttggagaaattatttaaactacctttgggctgtgattcttcatctgtaaaattagacttaaaattttatagaaattacttacacatacaacattgagtacaaggcctgcatattttagacataaaaataagggcagttgtaataactataacaattaacagactttcatatatgcctccagtttactatgtataaaatcctgagaccttgccagttgttttcaaacctctgacatctgcactcagctgtatccagaaggaattcctcatgaagcttaaccttccagcctctggctggcattgcttcctcctaaggcctgttccaatcattctactcaaagtttgcctttgctttacttaaagaaagatcatattagcttcacattgacataaaacttaaatacacatcaggctgttcctttcttctctatagtgttcacttccttgttcccatcacctgtacctagaacagtgtcagcaccttggtgtttgacaaaatgcttaaccagaaagtttggcgtacttagttacaataaaataaactttatgtatttagaaaaaaaaaacccagccagtacatttgggtggaaaatatttagcccactgacataagagacaataaaaggcactttgtaaactcaaggccaagtacttaacacagcattactgatgaaaataatgataattatgatgactccgaggaaatgtttcttaccctcactatcgctgacatttgggaccagatgattatggttgtagggactgtcctaagcattggaagatatcttgtggcatccctgacctttactcactggatgctaatagccaaatacgttgtctgacattgccaaatgtccctggaaggaaaactcctctgaatgccctagggcattgccttcagcatcaaaagacattcagatggccacacatctttcacattaagacattaaggcaagaaagagaaggcaagcgtgtagaaaagttttcaataagcaaatgtaacctcagttaacctgaaaattccattaaccccattctttgagtgctctattccctaagctttctagataacaaaaaaaaatgtacagtacattctattttctaatttgtatgctaagttcagctcattttccatctcaacagctaagcatagaaatccagttcatgagtgagggatcatcagcctctcttttgccatctattttaagtgacctggaagttccaatgttttttttaatccccttgttttgatattttaactttgatattgacaatgattcctgttttatctgactacaagtgaaatgtgacaaaaaatgaacccggtctaattagcagcaattctaccatatactaaaatcccaccatattgctgatgatttaaaagcattcgttccagccatcccactgattgtataagtgaaaaaaatgcccttaaataaacaatatttctcatttcttctttctgcaggttgtgatcctggggaaacattcaagaggttatcactacatgcttgctaacctggtaagaacaaaaatgtagttcaagcatccctgagcaatatagtccatttagttcatgtcatctctaatcagctgtaaaggaaatccaggaagcacctaatgtgttctctagatgcttggagaaacaaattcagtaactacccaaactggcctttcgtagctctggatactataatgttgtctttttcagctacaaagctatctccttttcttatttaaaagataatttgagtcaggtcttctggaactagcctgcaatcccagctacttgggaggttgaggcatggtcagaattcaaaattttcctgtgctgccaagcaacttcaaggtcgtcctggtaaacacagtaagatcctgtctcaaaataaaaataataaaataaaacccttccaaaactgactgaagaaacagctctgtggtagagttcttgcctgggaaaaagcagatattagcttcaacctccaacagcaaataataacaatgatagcaatagtaatcaggcatagttccccattattcttagattcagtttggatgttggctatttcaattaggtttgaaatgtaaaccaagagacagaggacacagggagatgactcccaatatatccaaggacacttgcatgccaatatttgatttgtgctctcagaggctaacaaatctcttccaatcaggcacaacaggatataccttcctacctacacaaaacccaacctggctttttacattcaaatgcctcatacctttaaagtccataacatctgagaagacagtgtgccaccaaggtcaccccatacctctttttattctgaaaaaacaacttgcttagtgattaacaaaatggcttataaattagaaatgccctttagataaaggttctgcagagcattgtctctatggaatgaaaaagggatgtgaaattatcactatactactaagaatctattaagttatcacaggagttcaagccaaaattttgtttcattagcacaacaaaatcacaatcgttataaagctcttaaaccaaaagaataatagtgatggtagatgattaatgtaattgtgctcttagatttctagaattaagggaaatatcttgttttgcttacaaatgtttctaaatgataaaagaagtgctattcaagtatctttctcagaaagcatccaaacactactgacttctgatgtagtatgcatcttgaatatgctgcacaaagtggatgaggccttccatccaatttaagcataaatgattgattcttctaggagaaaaaaacagtcctcaattcacatataaaaatactcagcttaggttttggacaacagatgagtaaggaatattttgagtcaatggaggttagactagggtgtagtagaaaataatagatgtttcaccaagatacctgaaacagttttgttgagtttttcagtttctttcttaccaataatctgctttccttctttcattttcctacttccatccctctcattttatcttcccctcagccttatatgttctagaaggcagtaagatatacaacacagtgtttaaaatatggggcattatgtatttactggcaatgtatgaggtgacttttggtagtgctcatacaagtatttacttactaaaaactcttgtccttaataaacattaagaaaatatatgactaggacatcaaaaacaaagtttttcagatcttaactcacatggagcaaaaacagatctaacaaaagtgaaataatgtttgatcttcaagtaaacaatatattatgctttctttatacatctgcaaacaactgtgctcatgcatgttgactgcagattgaaaaataatattgagttggagtttagaatgttttggtcttgcttgagtaaccatagatacctcagttgccttgtggtggatgtggaggtgggaatagaggaattcttccatatgttgggacccttggaattagatgttaaaacataattagaaaggcaagacatttcttgagagggataactgtgaaaaacaaggaagagagacagaagtaggaagggaaggtttcagaccacaatatacatctgataccactgaagaagggcaagaaggaagatagacagtcaagaagagcacagactgtggtgtatttctgaggaagtcttagtcagaacaactaagaattcctttgcaaagtctgtgaataacaaaccttttcagtctcactttgatcaaccattatctgataaatgccaaggaagaaacgttcttctcttgaaagctaaagtagattctgatggcacctgaagtgggagcctggtccgctcactggacaccttgagtcaagttctgcctgagaaaatttgagctcattcacatcagtaattgtctcagctggcataagatgatctaaggagaccctctctatcctagatttccagctaggccagattatgcctaataacaatctttcaaatatattttcctttcaacgttgagatctagatctgtttccatcaccaccacaccccccaaaaaagcctgcagagtgatggaacagcaaaaaagaattgccacctatggtggtggtgcgcttcagtaaacacaacaattgaaagatacaaggccatcctaggctacatagcaagaccatgttgggggaacagtgagtaaggatgtagctcagtttcatggtgtttagctaacatccacaaggacaagagtgcttgaacttgatcaaaagagaaagaaagataaacagacagacaaagaccgacacagagacaaagtgagaaagaacaaactaagagcaagagaaagctagagcaagggacacagagagacagtgaggaaagagatcactacagtgttctggaaatgaatggtgaactgaatccagagcacacaattcaggataatgagaccttagagagatgcctcctacaagaacaagcaaaatctgttccttctaaaagaaagtaatgtgtagtatcatgtcagtgtgagtcatgaaaacatgaactcattcattgtgctttgagctgccactttttcctctagtgaccttctttcctttgaactcagccacacagtttccataagtccctgaactctatattattaaagcagtggatagaaaaactactactcagttgataataataatgaaacatcatctctatcctccacaaaatttaaagcacaaaaaaaaaatactccaaacacctctagcaatgacatacacatacagagtaaagcaaaactatttagaagtcatttggatggtcaaaaaaggaagtggagctaagaagatgcttccttccaagatgagccatctggcctttcaagatgagccagctgggtaaaaactgaggatgtgtatatactcgggggaacaaactctagtcagccttggtgttacaacagcacagaagaactcctttcttctacaaatgcaaattcaagaacactcaccctgactgagcttcctatactctaagtgtcttctttgattctcagctccacatatctgtcaaagacacctgtatgcttttacataaacctccttaaatgcagttctaaaacgaggaggaagcaatcccataaatgcttcaatagaggccgtcaacaggtcagtgtgtacactattagtgaaaaataagctttggaaaagttcatcttgctaaaaatctcagatataaaaaaaaaaaagcaaagattctaccaagaacacaaaccagagatgtgacatgatcaagctagaagtggacattcctgttaagcaagtaagtctccaacaaattccatatccatatccatatgcatatccattggtgatatcttttcttgctagaggttgttccataattgtttcctcttctagaagaatgctgttacttggtctgcttgagtccccagcagtaactagtatgtgcatgcaacctgtcagttacgcagcacctttttcccatatggctgggtcctataacagtacctcttatattgcattgcaaagcatatcctgtatcatgatttaattttttcatatatgttgacaatagtagtagattgatgtgaagcatggaggtggtatgacatgatacaaaccaaggcactagcatatgagctaagagtcaagcttaaatgcttggaattccttcaactagacatatctctgtaactgtttattcatttgcaagctggggaagaaagacccgatcactatttcccagaataggttatttgcatgagctagtcttaaggagtacatggcagaacctttttaaagcgtattggttttgaatttatattaaatacatattagaaaaaataactactgcatcaattctatgatttcacaaacattctttagaacaaggcagaattgctgtttaagtctcataagtaccatcaatataaaaaaataagtaaattttggttcagatacagatttaaaaagaaaactataaaaggtggcatatttaagactaaaatgttaaaacactccaaggtcacttgcagttctgtacttcttcctccttagatatcacccaggtcgactgtgaaggaaagtgtcaacatagcaactgggtgaatgctaagcacacaggtaggggagcaaaaaccagaggcctactgtttttaaggcagactgaagcattaaaatcagtccagatgggcaaatgctgagagaactgtgagtgtccttagccaagttccaaacagagataaggatccaaagaactattcaacgtagccaagcagttgatacaaggcaaattacatccgcgttgagatggtccaatagcagatgttcaggataccttaaaaatcagaccaaataatccaaacacttgaggtgcccaggggaagacaggagccatagcagaccatattcagtgctatagtgtttaaccactaccttggaagacctgacagttccccagtgttcgaggcagctacagatgctgaaagtggaggtggggtaatgtcagctgtcagtggtaaagaatgtggaggacaggcaatcaagctgagcattgtaccagggagaaaggggataagagttaatggacctctgcctgccccctgctgtgctcgctattttcttgggacttctttaagcatcttaaaacatctaggagtagagacttctcaccaccacctcctcaaatcttttttaaaaatcaggaaatggactcagaaaagagacccaacttgcccaaagtagacaatcagcttataaagtgacttgtttttcctgctcagcccacccatgtgtctcagcaagacaggtcagctctgaaaaggtcacagaagagtttgtgcaaagagggactggtgggatggctcaataggtggaggcaattgccagcaaacctgacaacctaagtaccatccccaggacccacatggtagagaaaacagactcctaagaattgccctttgaccttcatgcatatgcagagatataaggatatgaagcacacacagtagtattatgagaattaagtgatcaaagacaattttaaaaacagggacagcatactgagcatggtatggtaggcatgtaatgtgagctcttgagagatggatgggataggattagggattcaaggtcatcctcagcttcacacagaattccttgaagggcctagaaggaaaggttgattcaaagaataacaaacaaaactttgtgattctgtactttaaagctgtccaaaaaaaatgcatctaaagacacatattgcatcccactatgtccactccctaattcattcttgctctctccctcttggtttttcattcttctgtagctcccccgccccctcccatttccctcttgctgtctcttttccctatatctccctcattcatagcatattacaagaaatggggagagacacctctttttattttactaagacagaaatgatcactcataaagtagtatgcaaaatcacatccagcagtaaactaggtttgaagaactgacctctgtgcttaccagatcttggaatgaaccaaaaacaaaaaagaacctgctttgtttcaagggaaagcagataagattgagtcatgctgttggcatatcaataccaactagtcccttatgctcccttccccttccagggcttcctgttctgttctctgcttccccttcctttgttcttccaattgtaatgttctatataaaaattcaaatgctcaaagccacgtgttgtgatgccctcagcagatggcatgtaaacacagaggtcattgggttggagcctagttttataggcaagggaagtgggcttgaggcaaaaagctgccactggtcccaagtgccaggaaacacagtccacttcccctggatatacaacctctctaatggctcaggattcagtttcttcttaaaacagagatataatagagcagaataccaagagacagaagactggggattggtctgaagtctaaacccctatcatgttattgagggtcacaagcattagtcagcttaaagtagacaacttcagatactcattcctttttctccaaaatgcttccctgtgtgtctctccttccttttccctccttcccctccttcctgactgaaatttacaaggaaagatcactacctagccaatgttttaacgaggtgacttcatagaaatatatcttctctttcaggcttctcaatgctgcctctaaaacagggctacttagtagatttatgtactagtgtttcatgattttatgggattatttcttagattgaaaatatcaaaacttgataatgtgcttagtagcctaaactactggatatcatagctgaacaacacaggacactgcagagatacatcattctggcagctacatggctaagaaggagcaactcactgcctctgtccaggatcaccatacaagatcttagcactaagtaccatatatatcaaaacttaaagtattgcctttaatgatgcatagtagttttcacataattcaaaagcaaataaaaatattaattcagaccatcataagctgagaactgtctgtacttggactgtggtccctcggtcatccacaagcaacctctcttatagttgtcaagtgaaaaatgctagtaactgaaagcaacttatcagctcctccaccacttttcattttattctggccacagtaccatccattatatatcttcccaatattttaatgttagctcttttttccccttctcttcccttcttcccttgttcacaaatcccaggcctcacctctattgtgtggaacattcagatctttaggtcttacccatggtctcttcaaagttcactttatagtatccagaagaaccaaaagtctatttacttaacacagtctaccttttcctgaagaattatagattgaaaatggcactacattatgtatattaaacattacgtagagtttctactcaaccagtgtttatttctgcttgtttcacttctgttttatacatgttcttcttaggtcaaacatgaaatgcttcggcaagtctggttttttgttttgttttgttttgttttaaaaaaaaaaaaaagagcttcttaactacttacagaggtgaacccatttattcccaaacctttatagaccaataaaagtgcaacaaaaataaattaaatgaaatagtcaaaggcagacacatcaaatataagtctaatatttaatattttacatttagcatttaatatattagttcagtagccataagccaagtgtaacagctacagatattgatagcaattattctgattcctctctcctatcatctgactggtgacactcaacagtcaatgaaccagcactaagccacacacaactagggtattagaaccctaaaagtatacaccgtccctttttatttttatttcctttttgctgtgtaggagtagggtacacacatagtactctccatagtacacacatggaggtcaaatgacaatgtggaagaattggtcctttcctactatcatgacggttccagggtttgaattcagatcatcaggctgggtggcaagtgcttttatctactgaggcaaagcaccagtcccaggaaaggttttttcctatatcatttgaatgccccaaattgcattcacttcactacaaagaagacaggacatcatgttctggagaaacttataatcatagtgatgagaacagtcttgcctaacttatagtaactggcctgaagacagacaaagaatgaagaaagccacaatgtacaaaatcagtactgtactgcacgtactgcagacagagaaaaactttgtaaaagggcgacttcaaaggatgctctaaacagtaagaaggatccatttacatgataaatcaggaaaagttcacctaaacagaacatcacatgtcaaagttccgggcaccatgctttttctacattgtcaaaatgtaattttatctagaccagagcaaggctttactaggccagttaaaagaacaatagaaagtaattgatatggttcaagtaagagaaggacatgatatgatttatgcctcagatgaattcactacagacaaattttacaaaaactaaatcatacctcagaaaagctgttagtctaaaacaaaaggctatcagaggctagttcctcaccagtggcaattataatgtcacagttgctttttttaatccttacaaatagctccaaatagactgaagtgtcattagggtggtggccaggtacgatatatggctcacaattctatccacttaggtttcagagaatatttggtgattggattagagaatagaccatttagtaagcaaggcaagtaacctgtaaccaagtgctaattcatatggtgtaatctttccctctgcccatttcctccgcccccaccacatctggaggaaggatctgctttccaggggggggggaagacttgtgtctttcattaggacacaattactttgcatttctaggttgaagcatcactccgatgaacaattcaaatagcactaaagacagaggaggcttcatgcaaatgctaagataaattgttgtccttggcagtcttccaaatccacagtctactgcttttatctcccctctagcaggccacttgcccatttctcacccgtgatctattatcaacgcaggaaaagtcacccaacttactttgtacttgctctcctctatggacaaaatgtgccgtaagaacaattctatgtgcaagaaatctctgtgtagtatcctgaaaataaatgctctaaaagtaaaccttgaatgcatttatttccagcttctaagttatccacactatctgaaggaaaatgatctgcttaaatgtcaatcaatggagagcgcataataccaaagccattcgaaacttttgaagttagaattttatcagaggcagtttgtgtttgaatgccaattgttcaaaccccagttttataaatgatggacttcgagaattcaccaaggactgtttacagtactttgcataaacttcttaggcacaaagttatggttcatcttatatagccgactgcagatatgagcaacagtgttagaaaggtgaaatacaactgataaaatctagcctagcttacaaatctaaatgagtatcttcagtgctcatgttcccagtgaatactgccattgtcacagaggtaaataagccagatgcacagatatttaatacctagaaaaggagaaaacattttaacttaccctgtatgtcagcagtaggattccttccaatctatctctctctgctttccctcatatcttctaatcgcttccctgtgcaaagttcaccgacacaaccaaaggaaaagataccactgtggcaattaggcaagtagcactgatttggatgtttagtgtaaacccacacaagtaattgagtatctaatcatgagctgtaattgttaaaatccccatgaaataataaaatgggcttaacagaaattccacttagtacaacagggaacttgggaccttgaagtaacttagcaatgacattgcagagtgactatacaaatgctcttattctacagaagggaatgggataataaagaagacaaaggtccataagcagtcatcaaatgtacaacagcccttgtaatcattagagaaagaggaaaagaaaagaaaaaaaagcacacattttagtacaaaatacagccaaaattgatgtagcactttcttagtcattgtgttgctaatcaaaaacattggtaaagatgtagagaaagtataattcttaaatatgatggatggaggtggaaattagctcagccattttggtaagtgatagggaatttcctcaaaaacttctaaaagtaaaactactatgtaacccagaattgccatttctgggtatacaggtgctcctagatctggtggatttcataattcaaaagtacagtaaatcaaaactacacctcgatcaagccagggcagtggcaaggactctataatcataggtaccaaggagacagagccaggttgattgtgagttcaaagtcatcacagtcaacaaagaaagcatttcagagcaagtgatgcatttaacatatttaactcacccaacactatagcttggctccatagcccatcaaaagttatggttgtttactcttaatgtagtcgctgactggagtcacagctcactgcagctgctcagcatcctagcactatctgcatactgatagcccattcactcgtataatttcacatgaactgaatttttgttggtcagcccagttgaatctgcgttttgttgaggctttgaaggaagtcaggccacagtgagcaaaatgcaatgaggtttgtgactatagttatatctaggactttttgaaagaacttaaacttaatctcaaatgatagagatgagtggagagctaagaatcaggcacattctactctcagccaactactttcactggcatccttctttatcacatttctcttccccattttatttatttacctatttcagctgttacctttttatcatataagaagttttacggacggttttagaggtatttgacatttattgtgctttgagtaagagtagtggcccagataggctcatatatttggaagcctagtcatcagggagtggcactatttcaaaaggattaagaggtgtggccttggagaacatgtgtcactggttgggttttgaggtttcaaaagcccatatcaagcccagtaattcccattggcctgcatattaagatgtaactcttagttaattctctagcaccatgtctgcctactacccatgatccctgacatgacaataatggactaaatctctgaaactgtaaaccagttcccaattaaatgctttcctttaaatgagttgccatggtctcgtctcagcaatagcaacccaaggtaagacaacaacgtttatatccaaactttgagattggtttgttaacaactccaaaagaaaaatccaacaacacgctggaataaacaaattgccttaaacacagtgaagctcagaacctgcagccaaacaaactcttcctcagagacatgagccctaacttctatcgccaatctttcctttatatactttaggtgctcagtggacatttccacagtgtcatcattttacagaggtttaagtgagacttgaacaatacacccacacaatgtttttaagtggccagcttacataatgaaatgttttgaaaagttatgatagaacggatagcaggaccaaggacctgtaagtgtcttctcctattaagtagtcacccagttgtcccctttgaacatactctacactactgaatgcagcaacgtgtaacagaaatgccagcatgatttggatggtgttagaaggcaagctggagtctgccgagtgctgtctcacagcaggcaccactctctcaccttcttcactctacccatgaccttcacataacagtgcttcatgatttgcttctcactagtgttgtcctttctgctacatggttttatttgtagagatttcagtggaactggggaaacagtcccacctctttagataatgaggagacatcaaacccagggaatatttgtgagcaagtaatttaggagctccaactgatttgataaaaagaaaagtgcagtgagatccggtcagctgcagtgtattataaaaattgatcccacttcgattattctacaccttagaacaaaccttgccctttaaaaaaaatccctattatattttgaatgtacattggtgacctctttgctaaagttgcctgtataatctcagctttctgtatctgtgggttgtatttgtacatgcataaagtctagctactgatggtaaagtaactcacaatataagatagctttaggacatgttagaagagaaacagagagcccagcagtaattgtcccagtcctattgttacctatgaagcagttacagcatgacactctgtctctaccaataaccttcacacaactattttcatatttcaccttccaggtgtcctatggatgtttctcttgtataatttgatttatggtcttttcagtcaactcagcacatagtccctcccagttctgggtctacaggtggtcatctcaagaactgaaaattagccagagtttgtggaaaagttaaatgatctgaggtgatatataatgagtatgactttttaaaggctttgaaccatgtccagtgagaagaggtgaacctcgaatcaggcagtatccgtctcgtacccactgctgttctctgacctccatgctctattcaagagcttcccatcttcattttcatttctacctccatggaaccagtgaatgtttctgatatagttttcttttagagagaatgcactggtctcagtaagttttagccaaatattcttgtcagcacaagaaatgaaccttagttaaatctatagatactcaaaatacctcaccatgttgtgacaagatgcaaaggaaaactgaagcctttttatacctcccattaataaaaatattaatctctgatattctccccttgccacaagtacaacttccttctcttctaatagctccttatattaatgcctatgtataaattatccaaataatctagtctgttttctgtatctgtagactgtatacacacacacacacacacacacacaatatgatcagaagcacagtagtttaaatcatggcagaaagaaaacctgtcttatcgttccattgttctgttgtttcagtctcttccggtgcagataattttgggtcacctctttaataatgcttactttgttaaatttcttcagacaatgaagtctctttgttacgtgggattttaattgcaaatgtcagcagttcaatctagcagtatgtaatataaaaacaacatatttgagtacgtgttagaatgtaaacaggtaagccataaaaccagaccactttgcctttcagatatcagttataagttccgttttttttacaatgatatataccatttttatttacttcttttctcacatgggaattgttatcatctctatgaaattaatatctctccagagatttagaagcgactccctttttatttactcaccttttgctatgaggtcagacagacaaactcaagcagtaaactttagtaagcattctcggcaagtgaaattcctttaaatgatgaaataacgggaaattttaaattattaccattcagttcctgtctctacatcagacttcctcctaacttccctcatcctgccactttgtcctcccattaaaactcttccattgtcctactcacttactgtgggtgctgtctggattccagtctgacataactgtctttatattgcttttaaagattagcaccatttttttaaagatttatttattagtttttgtgaatacactgtaactgtcttcagacccaccagaagagggcatcagatcacattacagatggttgtgagccaccatgtggtttctgggattgaactcaggacctctggaagagcagtctgtgctcttaactgctgagtcatctctccagccccaaattcacaccttatacccagtagcagtgagcattttatagaatgaaaattatcaaatagtacaaaaatggatatttttcctgaatgttttgaatgttattcaaagagtttcaggagccagacatcaattgcctttagctgagatcctaaaccctaagaaaactggggtcctccttttcctccatcttgtcttcccatcattggtaagtgattcttagtcatctctcctctgtcaacattataggtaaacatgtggcaaagtcgggcttggttcaattctcaaagatgacaatgtctcataatataagacagcagtttgaaaagaaaaacagtgaccacattgccaagttgaatctgaatgatgttagtccaagatctagctgagtcctgcacctctctctgagctccccatgttccactactgatgttactctcttgattttcctctaagtaagcaatgttgatttttgcatttgtgaaaattttagatatatagggcctcgtttttctcaaattagtaccattttatggcaatgcttagaggtaaatttggtaagaactgtggttcattaaactccttacaagagtgagaaaatagatgaatacagaccaggactcagtcatccccttgacctattgggaatatgtaccccaaaacttagtattttaagtgtctttcatcatttgtctttattggtcaaagtattgaaggtctcttctattgtgctatgcttatacacagtctttagatagacttggtgtcaaaatcaacttcaaggtctctgtgtagtgaagcaaggagtgaattttgaagagttatataaataattacaatgcccaatgtcttaatcaaatgggtggataaagtgagctagttgccagccaaattcctttctccaacttaattatcttatcacaaccctccctgccaccatcatttgattctcctttttttgtacgttctatgtgtctatggttatccatcctgttctgtttagtgtctttacaatgaattttaagactataaaacactaggaagggttgtgtgtgttcgacccagtgacgtgcacaataatctaactacaaatgatgacagaacgtagtgcctgaaaatatgaggtaggagtctagcagtgcttgccttttagtctgtattcattacttctagtgttaccattctgtgtttatagactactgtgtttatgtctgctagtcagctttcttgtaatagttatttcactaactctgggtagtttgaggcctcctcaatttacaactttgtcaattctagctgtacacaacaataaactgtagtgactcattttagaaacagaacagttcttctaaagtgcaacaaattgagaaggcagagcaggagtcacccaaacatttcttggctgtcttctgccactgaccatctaccattttattgaaccattttgtcacccatgtgtttaatgatcatttgcttgattcatcttttgagagatttttaaagccttaccccaatttgactactgtgaacactcgttcacccacctaaggaagatatctaaaaccctaccctttacccatggcagcttttttgtgcagtatctgttactgcccagtgttttcacttggtaaaatggaagctattaattaaacccatattctctgtttaatatttttctttcttttggaagtggagagtgagttaataaactttcatagcaatgatagcctctgctatctgctagatttatacacaagcttgcttctctggtgattttagtgcgggggttagcaaattgtagaaaatattgtcttagtatctctcataaagggatcctttaggagaaaactcatcacaacaagttaatattaactttaaaatgccttgtggttattagaaaggaggaatgattctcagtatgcaaaccaaactaattggctccttgtccaatctccttaaattcatatctcacaatgaaaggaagatgataggggttctaactaattactgaaaaagtgtctcactaaaatcttttctaagaccattttctgattaattttaaagagctccaaaattaagaatgtaaagttggagttggtggttggagaagaacacatggggcacttctgaagactggatatatttgtggctcagtttatgaatattaatgaatattaataatattcacttaaaatatacgcatgcttttttgtgattatctcccatcaaggaagatgttctgaaagtgcaaaaaagaaaataaaagaacttataagaatatggataagataggcatgtgcatttatcaaaacacatcaagtatacttttaaaatttgtccatttcatcaaatataaattttccctcaaaaaagaaaagaaaaaagcctggaaagataacatgcacacatgtatgtacatttacttgtatgtacacatgtacatgcccacatgaatacatacttataccacaaatacaaaaaggatgggagaaaatactatataaacaggaaattatagctattgacattggggttaaacctttggggttaaagtatactaatatctgcacctacttaacacttttttttgaaatatattccaaaaattgaatgaactattggaccagagagcacaatagtaaaatatgaatatcaactataagggttttcactgcatgtttgctttcaaagtttccatatatttgaaattttcttacactaaagtgttagaggtgatagtaggccagaaaacggctcagttaaaaatgttctagacatggtcctgaatttgggtccctaaaactcatggagaaaaggtaggcatggtggtgagtgcctacaatccaagtgtgggggaagggaagcgggaagagacaggagaaccctggaactcactggctagccaacattgtcaagtcaatgagctccagttttatcgagagatttttgcctcaagagaaaaattgagaataatttaggaaagcattcaacacagaacactggtgtgcatacatatgcttcatgaattcatacacacaaacacaaacgtgaacccacacacacacacacaatcctgacaataatttaaacaagagagaagctctatccagtttccttttgattttcaatttaaatctgaaatgcctgttcccagaagagtttgatacataactactgcgtgtacactacttctaccccttccctcgcccccctttgctctttcaccttcctcttaaattcatgacctatccttttatatctcagaaaaatcaatatcttttccaatttttgtctcttgattttttttataactagtaaaattgccacagatacattgtgcaagttttttctccttgcaattttcccaagtggtaaataaatctattttcttttctaatgtctgtctcttgttttctttttatacacaagaacaataaggtacacagactattcatctgaattttggtagcagctatgttggaggaaaactcagaactagccaactcctaaatttgaaaaataaaggaaattcccagatgctagtgtcttcttccttcttgctgccacaaaagtttgatgtctctaagcatgttttttttttttcgtttactgaaaataggggtatttttcatacgatatattctgattatggtttcctctcccccaactcctctgagatttcccccaccttgcctcccattgatatagaaagctgccatccattcattaaggattctgacacatgcgcaacaaagcacatgagaccaatatccaacagaagtagaagcaattcctgggcaggggatcccagaagacagtaatactcaagggagttggcagtgcccatgtagaaaaggcttaggtgtgaaccctggggagagcacttggaaatacttgggtgacagagacaccagatggtaaccagagcaagtgaaggagcaaatggcggatgctatacagatgtcaagactcatttatggattcatgtgagacgcaccctggggtttatgccatcatatccaggcaagctgtcagcttcactcactggtatttctgtgaatcacaaatgtctaaatactcatcacaagaatctgaaacactttgctctgctcagcatgttaaggtgaagaaaagattttctatcgcacttcttaaggccaaacatcctcaacattctctagtcacatagtgttatatttgaagtctctgtaggaagactgaagaaaatacaggtaagtgaaatcaaatatttgcttaaaagcaaaacatgcattggtcacagacagaaaaatgaaagcatgtaccatttctccattttgtttgtactttcaaacacatggtggcctaagaattggtttcatatccaaggccttcttcattgcgaataaataatcctagggaaggaatctttcatttcatccttactctccaacagataaatgtaccagaaacgtatgtctctcacagtcatgatctttttcactgtctttccagggttttactgacattgtactggaaagagtcatgcatgggggagccaacattacaggtttccagattgtcaacaatgaaaacccaatggtccagcaattcatacagcgctgggtgagactggatgaaagggaattccctgaagccaagaatgcaccactaaaggtaatgctccaatatacacagacaatgaaggccagctttccaacgcttttcaatatggcctttatatacttacaaccatcctgtgatcaagtgctcttccctcaaatgtgattcaataactcttttaaaaagatcagctgtaactgactctatagtataacctaacccccaaacgaactatagagaatagatcttgtaaaaaaaaatctagtgtttgaaaataaattagtttaatgtttaaatgaatctcatttctaatattctcatagtaatttacactattacatgaacctgaatcaggcaaagggtagaggcagtaggaataggtaaagattgatagtctaaaacagtaaattggattttacattatttatgtgattgccccatgataataagttccatgaatctcagaacacccaaatgaattagtctctaatatagaatatgtattacctatatgtacagaaatattgaacagaaatagttacctgcctacaaaagtgtctttaaaaataattagatttcctaagttgctcattttcccaaaatcaagataagaatattaaaaacagaaagtcatatttagagtgcatattttcatatgtgttccctatggttagaaaactatttactcatgattttaaaaaagataaaataggtggaaattatttgtgctatacaaaggtttcctaatatattatatatattatcctaatatgtatatatgtgtgtatgtatatatatatatatatatatatatatatatatatatatatatatatatatatatcccattacctcagcacaccaatttttgctgctatagtaaaaattcatacaaagactgtgatgtaagaagagtcaaatatgttaaaaccttcccccttaaaaaaggaaactgaggaaggtcttctttctcatacttcccagctctcctttctttctaacaataatagagtagagaatactagggaagatagatgaaaaagatgtattctctactaccctgaacaggtcacatcagaacctgtaaagatctgatacaactagatacaagtaaagtttttaaacaattgaaatgctctaggaaaacttgtgaactaaacataacttcatagttcaataaagccacttactagttagaagctaaccatatgactataatgcagattatatgtgccagagctttctagggcatttccatcttaaatcatcctgccccttggtcagaccaagtgtcctaatttgtcttggtgaatattgtcacattcccaattaggaatcctttataatcaaatattatttaatgtactaaactggcatgatttctcatgctatagttaggcgagcttacaaaagtttatatttccatgaaactgcctaaccacactgctttgtggtgttttgatttagcaactttagaagacaaagatacatttattcattattttaagtgttctcaacaattttataaacacaatgttagccacaagaaaatgaacaaagataaaaggtataaagagaaatattgcagtaaagattatccttgctctgaagatatatagcttctaaaaaagataatgaaaaccatctcaggtactcattaatactgagtgtgtgcatgcaacatgctagtacttaccattaaaaaatgcttagtcttataagtaaaaccctacaaatggtttaagaaagtattgaaccttgcattaaatcaatcaaagatcctactttaatacttgacataggatatatagagttagaaagatcatttagaaattaaaatctagatgttgtttaatacatatttcataaataattcttttcattatttattttagattgactggacaatctcatgcatgggtacagaaactgaataaagtacaaaattaaacatttcttttaatatagctttagaagaattgcattaagactagtgacaatgcatgcagttggttgggaggaaaatcaccactctgttggctttaggtagtgctaggatgggcaaacacaaagatttttcttcatgaaagaaaatatgctctccttatagtcatacttgatgagctgcttctgaaaggaaagtaacaagagaaaagtaaattgatagttgtaaagacaacaatgtattcactctcaattgtatttggacagacttttatatagtgagaactccccttaggacattttgctacactttaaaaagtcaataagattccatattctacaagtattcatcacccttgcaaaacagaggccagcttattttaatcatgctttgttgattcatttaatggaaaagcctccaccatttccaactgcagataatcaaatcccttgtgttaagtgactagcagcatccctagtagaacatgtcactgtatacaaggaacagaaagtaaagtgttctcgcctgaaagaggtagcatcaggaagcattgcctacaaattgtcaacgttatcagatttaaaactcaataacaattgtaattttcgacacttgaaaagaatctttggtttttgctaccccctgggaaacaaaaactgatttattgctggccagaggtcctagcttgcttcaaacatggtccagacagaaatgattaatgtttccttccaaattaatttcaagctgtctaacttagctatttccattttcccctaagtaaacagcagatctgaattttctattacaaacagcaataactcagtcttgctttaggatatgctatttcctctctaatctatacatgccatcctttaacatcacatgcatttcttctcataaaatatccagccttttatactcactcactcaatatgaaacagtattgagagcaagaaagagactcccttgagccatttgatcttaataaccctaacatgtgcacacatggggtaaaaggcatcattgttgaatgcatcaaagtcagtcttgcccacagagaattttgaacttgaataattaggatgatatcattgtagggcaaaaggtggaagtgaatgaaaaacacaaggaacaaggcaagtttctaggatgtcatttgtcatgctatcttgtttttcatgtgtttattttagtatacatctgcactgacacacgacgcaatactggtcatagcagaagccttccgatacctgaggaggcagcgagtggatgtatcccgcagaggcagtgctggagactgcttagcaaatcctgctgtgccctggagtcaaggaattgatattgagagagctctgaaaatggtaaggacaatttcttgctggggaggacaggccttagaaagacacaaaaaggaagtcctcagtcccaaaggaggatggactaagaaacagcatctcaggctgtgcagaaaagatttgtgtggataatcacccaagtctataattccaccaatagaaaggtctgctgtgaagttagaaaaaaataaatttagcgcaaatacatctttggttctatgctgcactgtacctggtaaatgaaacttggtaccctgcaaaattatacactgaattaataagtagcttcaaaataacatatcttctgcaaatatgacatttcctaggaagatttgggattttttttttaatgaaatgatcctaaatccaagatgggcattaaaaaggacagcagcatcgttgggctcatcagacaaattaggagcctgaatggactgtggaaccgagccagtgtgatagtatttctgttgtcaaagagaacacttattctattcttcatggtagaatgcaggaacatggtgcatttctagacctacttaagaggctttgtccagtgccacaaagaaaaagcctaaagaaaagtacaaggaatcaatggatagatgatcaaataggtcacttgtttttagtatttactgggtaagagatcatttaaggcttcaagcagtgtcctttgaacagattccattatttacactaggagcaatatcacccattcattgcagctttccaagcaaagctctttcctgaatatttaactttatgcctgccacatgttcctgtatgcattaaaatgagcctccaagagtacaagaatctcttctttccaactaattatcttgatgtttgggacatccagatgagcaaaagagataggccatcctaagataattctgtgcacaactcagcaatgaagaatcaggaacaacctcataacgtacaccattttgtgtatttggctctcttactgctgccttaatttgccaagttggatgcattcagtccagagaggttagtggcccctgtgtctctctccaagaaagagatatgaaccattctcaaattgtgtagacttttatgtcattgtgtcaattccctaacagatgccccgagtgtagttttatggaagcagcggtgcatgattttgaagagcagctaattaaattccaccttcctagcagttacaagatttgtattgtcaggtggaacataatgatgagtgaaatataaaactgcctcagagtgaatcaaaatgagttttcatcaacaaaacctcatgggcaggagccagcatttctaattgattggccattcataacatcaaccaccactttccccaagtagaaacgtggccaccagaatagaaaataagaaaccaacttggatataaatcaataggaccaaccatcctgtcacaaagaaaaatttctggacgtttaactcactggtaagttcaaagggcaggccaaataagccatcctccttcctaggccttaatggccaatcacctaatctcagggatgcttcacattttgtttctattctagaaagcaatggactttccaaaagaatatggtccttcaaaatgactgaaaataagcctggttttattacattttttaaaaatccctttttactgacgttcattaaaaatgagattgcacgatgtacaggcacccttccttatgactaaggatcactgtttcttaataaatcattttcttcccctaaagaaatctagaaaccaaaccattgtttttagatagacgcgtgcgtggggtggggcctatttaaatgaatatatagacatgccatccattctgcacttagtaagcccctatgagtatgtactaggctccatattagtatgcaaatatgagacaagctaaggagagctcgtatttgaattacattaatgttaaaaacacagaaaatgaatgtcttttaccttgagatgctcccaatccagaagatatagattattaaaattataggtaaataatattaaaactatttagatcaaagagggattctggatgaggtagtgggaagctgtcactgacattcaatactagtctatatccctaaaaatagacttcactaagagtggtggtccagtcctatacctactccctgaagactttatatcatgagggctggcatctctaggacacctgttgacttcccagctcataaatcaagttcagataacctgggtcttttgaaatgtgtaattcttaatgagacttgaaggcctgagtatgcacagcaatgaaggatttctatgcaattgtctcagctctatcaaacatcacaacatgcatcaatttcatcctactgaataatgcatcaataaagggcccatttctttacctagagctgtcatctcacatggtctacaagcttagtgcttacgtttgcttggtcagatagaattgccatatcaaagcagtctcatggtctcttaccggcactcagaaatctacttcttttaaaaactattcccaaagccttgatatcaattttccccttggcagtatagacccattactgtccctgacttgtttgctagcttgttgtttttataaatgaagagaaagatattttgtcagcttatcctcaaacaaaacaacaacaacaaaaccagattatttttctttaaaatctctgacccttactcaggaagtgaaacatccagatagactgacagtctttatttgatatttctaaactttagggcagatgagaaaatctgtcagtagatgtggccttttgttttcctatgactaggaacccttagggcatatatagactctgaatttggcatcccaaaacaggaatggagctctaacacttctgtctctgttgtggagcactcaatgttcctgattccttgaggtccacaaattttcatcagtctttgaactatctctgcatggcagccctgatctctgccacctgtctgtaccttggcatatagttttaatagggaggaaatgctgcttctctcacagtagaagtccataaatgcacaaccctctcaaataaatagctaaagtcactttgcttggtaatgaattcagattggagatggaaagacttcctgggttaagatgcttgatgaccagaggtcaatcccaagatcccacaggggaaggaatgaatcaactcctgaaaattgccctctgacctccatatactctgtagcacacacatgcctgtgtttacatatactcatatcagagacacagaataataaacaaataattgtgaatgttaacctagtcagactgcactgtgacgcttactgcataccaggcataacttgcaactcatttaatcatctaaatagttctgagagattggtgcttctgggatttcccatgtcacagattaggattactgagtcatgctgtggaaaccaaatttttttcaaatattggaactatgaggattagaaacaatgctactccacaagaaacacataatgcagaataatgcattaacctatttcagcctaaagtacattcataagaagggactattataaatattcaagtctttgaaatactggttaaagtcatctcactacattatacaggtgaccacttctaatactcacctaaagtttcataacttaaaagcctactaagaacacattgttaagaaaataaggctctgtgaatacttgatcagcctcatagaattcaatgacctgaaatgaaaaccctcaaagatttcatcctagggacctagagtcaacaatgtaaaaactagtttaacttttttcacctcttgcctttttaccaggtgcaagtacaaggaatgactggaaacatccaatttgacacttatggacgtaggacaaattataccattgatgtatatgaaatgaaagtctcaggctctcgaaaagtaagtagccaaaacagtcaataagagaattgtctctccaaaggtgagagcatgctcacacaagatgtgtgagaaatatacaaagaaagccccacttggtgtttgtctttccatctgctaaggaacagagataagatacataaagttttgtaatcagaatgatccaaccatatcttattaaagaggatgacgctctaatgcttataaaagtaatagactcacaagttattaataatttttctaaacaaaggggaagaatgacaaactctatagcatgctattaaacagaatcttcctaggcacatgtggtttttcacaaacaaaaatgaaagtaggtcattgccaacccaccacccaaagtacttgagacaaaatgtctttcttcagagctgaattgtatatgcccagttagcgtctaactcactaacaattgagttagacataagggggattttgtagccgtgtgataaacctttagaatataaactatcttgcatcatatctaccagctattaacaggcttttgacttcaatgtatcagctttctgcaatcccaacattttctgctgtagaaagttaatagaaaaagtggtcattacacagcaggcacaagtatttggcagaattgtcggtaaaggtgaagtgaggaaaggaatcctcaagatcaaggaatagcaagcacgcctctggatgtatcctttttgtcctgagggcagtaaaaacatagatgggaccagggtatcaatccttataaatgtcaagcttcctaaaatccacttagtatttcttgagagaaaaatgggcatccagatgaaatgtctgttctttctaggctggttactggaatgagtatgaaaggtttgtgcccttctcagatcaacaaatcagcaatgacagctcatcctccgagaacaggaccatcgtagtgactaccattctggtaagtgtggacagacagcagggaggctttctgaatagttgcaggtattattcagttctaagtattccggacagttctaaaaatattagtcagctagtcttgagtttaagcatgcagaagttctaacacaacggctgctcaggaaccctcaagcacctcttcgtaatgaacaaaatgccactatacacaatggaattttattcatccataaagaaatattaaattatataatttccaggaaagttttcagaacttgaaaatattatactaagtagaataaccaaggctcagaaaagcaaatactacatgctctctctctctctcatattcagatgttaatttccagttgttaaatataggagtaagtatgagtaaagaccaagaaacttgatagcagacctatgagagcaaagagatattaatgggaggggttaatgaggtgggggatgttgatcatatgtgatatcaacatgaaagggaaaatactgtggacaaaatcatctagaggggttggggtaagtgtggagggaaaggaagaggtggataatcacccagaatgaagtatgtgtgaagattctacaaaacactcaaaaggaagaaaaggaaagaggagtagagggaatggctcagtgggtaaaggtgcttgccaccaagcctaatgatctgagtgaaggagagaactgacccctgcaagttgtccctttgccctctacccaagtaacatggtatggactcagctgcaatatactcagaaaggaaagacagagaacaagagagggaagagagtggatgaatgaatgaggaacaattttacatattactgtcctcttctacttccctcctaaaagaatggtgcttcaccagaatatagagtctaattcttcattgtgtagggttgtcgtgtgaaaaaaagaaaatcagttaatgttctaatattggatctaatattcctttgtataactgtgcaagtctctaatccttaggtttttatttttgcaatttgtaaaatggacataaataataataacctcttacctacgtcttaggaccatttcaaagttacagttagctatatagaagtattccacaaaatacaatacactatagacatatgatggggtagtgttgtttccaaatggttttccaaaagttgtctatttttttttaaatgaagtgtgtacctcaggtaaaaacaagtatggcatttaaaaagcactatcaaattctcttcttcactttatcctaagaactgtatggtggacctcagatggaaaaaagagccagccaaacacctcagcttcacaaggactgcagtatttccctatgccctgcctgagctggctggagcccctacctaatacatcctgagaaatcaaaggcaaatcctctttatgtaccaaaggagatagtactttccaattcaactacatcaaaagacttcactggtgaaaactagtcctgctttcaaattctaggggaaaaaaatcttaaatgtttctctacttcattaaatcatcagtttggggctccaaggaatacatggtcccatgaatagttgattgaggctcccttccttattaagtcaaaatttaaaaaaaaaaatcatttccatacaccgagcctcaataggaacagaaaggaaagtgtctccctattacatttactgcatcttagggaaaaaaaaatggataagagtaatcctttgttcttttgttctgttctctaaggaatcaccatatgtaatgtataaaaagaatcatgagcaactggaaggaaatgagcgctatgaaggctattgtgtcgatttagcctatgaaatagccaaacacgtaaggatcaaatacaaattgtccattgtcggtgatgggaaatatggcgcaagggatccagagactaaaatatggaatggcatggttggggaacttgtctatggagtaagtattttcaattccattgttatctatttctattcttttcagttaacaagaaaatgaggggctctaatgttcagtcttaagatttatcagatttcagggttttcatgagtctgtaaagacctagtttctcatgctgttgaggtcaggaaagcatcctttgagcaacaaggttattttacaaaaaggaaaataaaattgaggaaatgtatttggccacattaagcacagtcttccctctactgagagtcttttccttattccttctgtgtttcactgaattaggtaccagaaccacctacccatgcagtttcttagcagtatctccatctctcctcattggtcccctcatgtctaatgaaccagtctgcagtatgagtcctactaggtctttcaaatctaaaagcactctttctcccaaccatggacattatcttagttaaggtttttgccatctgtctatcatttagctggatccctacctctagttttacactagcaaatcagctctacattattgcaatcccccactttaaaaaacaggataaaacttgaagaagactatagtggtattgccacaggtccttggtgttttaaatggttttggtctcagggaagattaggtcttaagcagagcaatgaagtatatgaggataggtacaattggccaccagaactacccatttcataaaccaatctctaataaccaaagttcagatctaaatatcagaagatatttagttctactagacaataatcacttgctataattggtacctatttagacatcagatactgagaagataaatgaattggaggtatgtgtgctgagaaagtcacagttggtaagaagcaaacacctatgtatctattgggtggaggatcagaaaaattactccagtggtagccagcacaactagggcgtcactcaatcataaaacactactggggtcactcaatatgttttttagaataggcctttggaaaccagcataagagatggagctcatttctaaaaatgaggacacagaatgggaactaaggcttaaaatgaggctgggccccaggtatcaaaactgggacactgtcctcttgccagacaaacagcacagtaacttgaaacccctcctccatctgtggggcctgagccaatcaccacctgtcttaggtcaaggttggccttgggaactggggcaggactgagttgcagatgagacacaagtgaactaagaaatgaaaaagaggtttttcagttccagagagggacagacaacaactcagttgattttggaggaccctaagcagctctcaaccattttgacatagtactagcctctcactttccaggtgacaatgttttctctttcttgtcacttatctccccaacactcaaaacgtattgtcttgcctatagctcttcctgcactttagtaaattgcatagggaaaacccactctttgccctaatgaatcaatacctgtatacaataatggttgacaaagattcattaaagttagctcatggagggaaaaataaggcaatgtttttgttattattagctagcacttatagagtgttcactggctgctacctactgtgctaagtactttacacacattctgtaccttaatcttcacaacatgtgtttgaagaagttccattagtaacctcattgtatatgtaagactatttaagataagaatgaaaactacattccaaagaccaaacatcctgcagggccggtcttggttgttcaggctgctataagaaagtatattagacttgtggtttacaaacaacagatattgatttctcactattctggaggatgagaagttcatgatcaaagatttaattgtctagtaatgatgagctttctagctcacaaattgtacctacttgttgcatcctcacattagggaaagggtaattagtctctgaagcctcttatataaataacctatttatgagggttctgcttcatagagtaaccacttcctaataccccatttcctaataacattactttacagattacaatttgaccatataaagagaggcacaaacattctgaccgtaacaacaacacagtgccttggatctatgaggttcatgtgcttttaataagttcaccacactatcccatagtaaaagttgtttggggcccatttcatctggaataatatttgaaatttattataaaaatattttggtgccttggccattcttgagagaagttgtcgaggctttagtagcgtggaattctattgaggtataaattaatactgctccagttatctgttctagtccatcagttcaccagcccatccaaacagaatggtcagagccctgtagtgtctccaaagaaacctagcacagtctggaaatagatcagtgccctcctagcattgagcaagatgtcaggcatggtgatgtaggataagagattgcctgacattgttcagatgaagtgcagcactctcatggtgtttacgtttctcctctgggatgtgctctctgctacatgatttaatctctacacatccctttctctctctacttcatctatttgtaagtgggggaatttgagaaatacagagcgctttgtttagtaattcaagcggtttgtttagtaattcagacttcatctcctcaattttgaaaaggtgagatttctgaagtgacctttctctcattctcctgctgctctgggaagagctttcctttctgccggggaaggctcttaaaggcacatcctctcccctttcctgacctagaagaagtctctgatgttttctaagctgaataatacaaagtgattctggacaactgacagcaaaccaatccactgaagtagactgtcaaactacactttcctctaaaacctaggaataggaaaactagactttcctgtcatgctaggaggaagagcttgctgtcagagaggaggatagcagaagctaaatgtgttttaatcttttggcatcagaaacttttcaacatctctgtacatgatagaaatggtgggggcatgaaagcacaggcttgcatttctggcagtcctaacctcttatggtttgcaagttgcttcaaaaaaagagagaggaaaaaaactgatgatttttccagagtgcttaatggacaaaatatggagaacaggaaaattatgacttgcatttagcaggaaaactatacagaaaggcatgggttcgtcttcccagtactgcctcctataccttttgtatgtactgtggatcagagcaggaaaggaaggcagagcgggagaaagctttgccaaagacatttctgtatctgcgatgaagtctcaagaaaaagtcaaaaggaattgagtttggtaaagaataaagaagtcaattagtctcttttcagatgcttcttgaatttttttcctttaaagaaattcaaatcaaagttgatgttggggcaccttgtatctctaagaaggttatttttgaaacaaacgtcagcagcatacaatgttccccattacgtaagcccttcagaacattgtggtcttgaaactgtccacctgcttttagcaattttgattttgagctggatttctgtaacactgccacatagtaatcattccagctcaaatggctcacacaccaccagtttttactgctcccaaatagcaagtgttttaagagggcattttaaaagaacattttgtggctatcagaattcttaaatattctttagccaaacatctaattcattttcacagatgactaggagacccaccagggcccaaacattagcattgcccattgagtaaaccaagaaattgaagcctgctggagcacaagagtgacagcaatttctcagggaggaggggaggtggcaaattttgacaatagcacaaaaatcacagttcggcaacttgaataccagtatgcctggtctagtgctctgtccactggtttacattggctcagctcactaagcttctcaatgtatgagaatcttgatattactgcagtcagatatgtcacttcttcatggcttcagggtaaaccggcttgcattctagctggattatgagtgattccatctaagatactcattacatttctatgtaccctctagggcaatgcaatactaatctctagttatctcttgaaatatttaaaaatacaacataaatagctggaaggttctgtcctcaagagaagatatatgacctaacaaggttttttttttttaaggaaaaaaaaaggcaagaaataggctaggaggaaattggagccccagttatgaagaggacacctcccagtgggtcactgccacattgtttaggttcttagtacctagaactgagaataaagatgatgtgggattgcttttggaaaggctaggaacaatatcatacacattggttcttctgacttggaaaatagcagaaagctcaggaatgaagatgagattggcatgaagattccaagtcatggaccttgggtgtcccagactatttctccctcccaggagaaatggcaactcagcagatactacttacaatgacattgcattgcttgtaagaaattatcttagattgccactatcctaaaacagatttattttccattaacaaaggcagagagtcaatctgtcctcccagttaaagggggagaagcaaggacccagtatcagatactatgaattcactgctaatcttcaggtgattacactgggcgctggcagaaaggactgatggtttgataaaagtgctcttctactgaacggacacatagactccagggaagagcattaatgatacatgaaagtctgctattctgagcagagaggtgaggaaatattcccaaccatatttagcatcacacggccttcatccagctccccagatgcccgtttatcttcagtgggtctttaaatccctcagctccccaaggacaaggagtccaaatcaatagacccatactgggacatctgttctggataaagaaatgagaagatcctgttgtgaccctgcttgttgttgccctgatttaaatagtccccatccctttctccagatcttaaccgtagcagacaacaaacatctcagagagtaaagccaatagagcagtttaatccctgttccccaacacacagcaattgtattcctattgtccaccttacttctgccccactctttttttctaccgcatttcaggaggaaattcctgctgaaggccactagagtcttaggcttgacgcaaggagcagggagcagatcacgtctgcttcttatacggtctgcatggtacatctcttcctttttcttccttccccccttgctatcagaaaatgctttgaaacagtggctgacaagttcctgctcaaacataatcttcaaatgggttacaaattttagatgagctgatcagatgaaaatactttaaaatgtaacaagcctcccatctcaaacaatttgtaaaattacagttaaactaaatgtcatctctacttaaaatttgtcagcttcttaagttcatgatccccgtgcataggagtctgttgggagtttaggttttatatttacaactttggctgcccatctataaaaacgattataaatcccctcaagctaaatccccttcaacaacgcagttgcttgggtttgccactggttaagtgggaaaaaaaaatcaaacttaatttagtgtgtttgctgagcccacacagccattcttaagttgcttgattaaaatcctttaagtagtcaaaatgcaagttaaaaacactagtagagtctcaccctgagctcttaccatttgctggtttctgtctgtcacctggagcacactcataccaagcatttacccacctagtattctaaaagtgacttttctgctgctattagcagcacaggcttgatgacaaaaggctgctggagtggtttaggacaccaaaagagaaacacttgattattaagttagaagctcacctgctccatagttctagccataatccttcatgcttggctccagttacagctgacttgcatcaaatatcaagggaggactttcggagggtgggtggatttgatgcaaacgtgttatatgcgtatatgaatattaatttatttgggtggttgcttttttttttttttacattttcatcactcttaaatctttaattttcttttaaagtaaccctgttgtctgtatgccatggcagtcccaggaaaactaaggattcttggacacttattagtaatctgcttctccattttctcattggtaatcaagctgattatttcacaggcattgtagcaggcaggtcatacataagctctgaaataacctacaatcacacggataaatttcattttttattaaatttattatttattcactttacaacccagtgtcatcccttcctctgctcccaggacgcccccatgtaagtcttctccccattcccctgagaaaaggaagctcccttctggtcgtcaaatcccaccagaccacacatcaagttactgcagaagtaggcacatcttctcccactgaggacagacaaggctatccatttaggggtgcaggatccatatgcaggcaggcagtcaacaggctcatgggcagcccctgccccagttgttggggaacccacatgaagacaaagctgctcatctgctacatatgagcaggaggcccaggtccagaccatgtatgctcttcagttggtgattcagtctctaggagttcccaagggtccaggccagttgattctattgttcttcctttgaagtccctatcctctttgggaccctcaatctttcttccaactcttccataagactccccaagctccatctactgtttgggtgtctctgcacctcttcccattgactgttgggtggagcatctcagaggacagttatgttacgttcttccctgcaagcataacagagtgttattaatagtgccgaggattgtttcttgcccacaggatggatctcaatttggggcagtcattggttggccattccctcagactctgctctgtctttgtccctgcacatcttgtaggcaggactcagtttgggtcataggctttgtgggtgggttgctgtccttatccttccacagggagtcctgcctggctacaggaagtggccacttcaggatccatatcctccactgctaggaatcagctagagtctcccacttagaccctctgggatctctccccatcccaggtctctggcaaatcctagagattgcccccaaccccagcctatctcccttctctttcccctgctctccctacatatgatcttcccccctgcctctctcccctcctcatcgcctcttgcacccagtttcctcctttgatcgacctccaatgtctattttgtttcctcttcctcatacataggaagggatagtagcaggagagggcaagggctgcctctgagctgatgctccacttctgtgacttgtctctcacaaaggataaaagagatagaaaatgcaagctccagtctcccacacatcttactgtcctgagggctcaatcagcagctttcttagcttctattggttgagtcttcttctagttacttgactctatatttttgtccttttcaatctgcaggtctttattaagggcccttaagggtgcatggtaaattcttgttttggatccaggccacatcattgagctcaggtttaacatcacccttcatccacccctggggcagtacaaaaaaaaaagtatactttctttgaaaaagctcctgagatcccagcacttgcaagacagaggcagaaggatcaccaccaatttgaagccagcctgagccatgcagtaaattcaaggttaacctgggctgcatagtaacatgctgtctcataagatgaaaaatggcaggaaaagacttcccagaaagaaaaaattcagaaaattagaaatgctaggctaagggaaagaggcaagaacctgaggggaacagattagccctgttgttttttgtgattcaaaagtactttaaactcagtactttaaactcctttgggaatctgttctttagctaaatgttccttaaaactaaacaataagccattattccttctctgttagccacctcttgttagtgtttagtggtgcttaccatgtgatgggtatggcagttacagagttttcttttgtgggcttttttggtaagggtatttttgttttggttttgttttgctttgttttgcttttctatttcagccattgtctctttctttctttttgaaattatgatgtaattttaccattaccccctctctttccctccaccaaaccttgccatatatcaagtggcctatggttgtacatttaaaggggatcgggtgtctcgatcttccattctgtacccacttgaaaagagctcagttcccttaaattcagtccaaataaagtgaatttctcatgccaaatactcacttacttctaccttcaaagacagaaaagaattttttagtaatttctcctagaaagattaagacttacatgattaaagaaagaagaaaatgttaaattaagtaattaaattcaaatgagatcaaatggggactaatactagatgcatatttgtgtcctctgagcaggaggcagagacatgttggcactgagtggaggcccctttgtgtatgaagtctcttggcatgaaaatactctagctgattcaagctatctttgccaaaaacccccgctagctttctggccaagtccattcttatcaggagcctttgttcttatgaccaggtgtaggcctcaggcaaaggataaaacaggtaaaaatttgtcatagcctctcatcttatcatcagtgtggaactgaagattaaggagttcactggaatatgaagggagttgaagccatagatgatgatgttgaataaagaaaaaataaataaataaaggacaggaccttgaatgatctgtcttgttctacaaaccttcagtgattacctcctaaaaggtgcttctagaattacaaaatataccttggtggagaatggaagctatgaagaaaaaagcaggtaaagaataatattcataaaagtaataagagaacctgacatctttagtgtccaaaagccaaaggaaagagtatatactatggaaaagcccagtgatgtcacatgagcagttgatgtctgacaggaggtgtttgagtctggcagccaagtttacagttcaagaaataattttaacaaatcagagggactacagaattagatcttgaaggggaagttctgctttcattcagagacaatgaagttcgagtttcaagaacattgatatgatgtgtagaggcgcaatacgggtaggatgatggaagaattaaaaatgaaaggagtggtgtttggtaaacagaactgcctatgattttaactgaatatgtgttgtatgatttttcctttggaagacatgaacaaatggctactcacttccgcatagagccaatgacaggccagaacaacaattccaccaacactcatcttggcaaagcaatacgtttattggggttatttacagtagtatgagtaagcaggtatttacagatgcgtgaataactcatctgcattgcagatcaaagtattatagtatgtagtacatatatgcaagtgtcagctgaaagcaggttgctagataagccaatggatctgaatctcattaccagagctctaatctcggcctctttcccttataaatggtgagtataagtcatggttaatgccctgtctgttaccgcatacatcatttgaagaaagaatggtcattgtatcaacctcaaggttgctaggagagtgaattaaaacaatatatagaaagtgcttgacacagtgcctcgcacagagtaagcagtcaataaacgtgaggaagtcttcatcatctacatttccccttaaataaggaacacttattcatgtgaaaagcacagtaaaattagggaaatagactatggatggtaaaataagaaaacaagagttaggttaactatgtcataaggaagtacaagttgaggtaagaaagagatagcaaatggtttgagttgccctattaaatttaccaaaataaatttcttccttccttccttccttccttccttccttcctttctttctttctttctttctttctttctggtcaatatacgttctttctttctttctttctttctttctttctttctttctttttggtcaatatactttagttgaaacttcctccattttcctccacctgttcccacaggtagatactgaagcatagctatgcacatcagacacacacacacacaaacccctgagtgttcttggtaacttactacagatctgatataccatacttatttccctaggtacattttaaagactatttccacacaaaaacctactagcattgaattggaacaattgtagaaaaaaaaaataagtgcagaaattcctaatgccacattcctctaaaattaatataaaaaggtgacatgcctttacatgagttaattattcagtgtactgctaacatttatttatcagtctgacatgtgttgatgttgtgcttatatttatcaccagaaaagatagctgacttgagaaaataatataaattctaatagttgttttatccttgtatctctcttgcagaaatattgcattttttcatatactatgttcaacaattggcaactaattaaggcatatacatttttagaatgtactacaataatatatacaaaaccaaatactgtgtctctgtcttcaaatgatgcatattttaacagacaaggcagcagcctagacttacactgaatactacaagggaaaggcaggtcgttgtgcacagtatacaaaaattccagtaaaataagggagagagacataagagtatgaatattaaaataagaaaacaagagttagattagatatgtcataaggaaatacaagttgaggtatatgacatatcaaaagaaaatctggggaaaatagaatcagttcccctaagccaagatgtttcagaggacaaaagaccagggcatttcctttcttgaccaacaaaataaaacaatttagaacccactgaatgaccctgcttctctaatcatagcactgacaaatcagctggttacagtgatcgaatatactatatttccaccaaagacatttattaagtgaaaatgataaaggaaatgctgtctgttaaagtgttctgtgtctttgtttttcagagagctgatatagctgttgctccactcactataacattggtccgtgaagaagtcatagatttttcaaagccatttatgagcctggggatctccatcatgataaagaagcctcagaaatcaaagccaggcgtattttcattcctggatcctttagcttatgaaatctggatgtgcattgtcttcgcttacattggagtcagtgtagttctcttcctagtcagcagatttagcccttatgagtggcacttggaagacaacaatgaagaacctcgtgacccacaaagccctcctgatcctcccaatgaatttggaatatttaacagtctttggttttccttgggtgcttttatgcagcaaggatgtgatatttctccaaggtttgtttgtgtgtaatacagaatacctgcttgtattttgtggtcttactgccctcatgtccatctggtattcacctgcatcaacttcagagttctttcatttaacattccatccaatgacaaattgtcatcacagcattttgtgtgcttatgtctacgaggtgagtgtgtcactggcgatgcttgaatgcctaaggtttgctacaatgctcatagatacccagattctggatacagttaactgctgcataatattcctatgaaagtttcctcattaattgaactgaaatatcttcgcatttgccaaggggctaaatctgggcaaaatgtgaaagaagatagagcatttctttaaaccttcccaccttcccctattagtattgcccttctcattgtgctctcagtctgcctacgactatgcaagcgtctactcaagtttcttagctaaaactagaaaacttctcagaacataagtacaaaccttaatggtgttgtcatatttgaaaataatctggccatttgttataaagttaggccgagagtgaaaatgtgacaaaagaattttactgtcatttatacccccaaagcaaaatgtatgaatgtccatagtatctttagttgtaatagacaaaatatagaaacaaagcagttgttcagctagtaaattgataaagaacttgtagcatatccattcaatggaatactatttacttaagagaagagattactcatgcatcctaacagtacagatgaaccttgaaaacataatgtcaaagtgaaataattcaaacacaaaatgccaaaccccactccactctacttgttgaatataccattatagagcatcccatttgtccccagtagacaaatctatagagataaaaaggacaattactatggacatagtttgaaaggagaagaataaaaacacagataacaatagtgggattaaagtctggcaagtttgcttttgcagaacaagtccaagagtcagaaacaactctgatttaagttttttatgtcttgttcattacagaactttttctgcttgcatttttaaaaagaaatacaccaccaaagtgtcatttgttccaatgaatgagatgttgatacccacttatattagcatgtggggcaaatgccttacttgtctcatccttgccctaaacctgctggaattcattacaaatcctgatattttgatgaagggtgatataaaaccatttcaaaaaatggattgtgatgatggttacagagctctaaccttactatgcaagtatgagaacctgaggtcagttagccaaaaccacataaaaagccaggcatgactgtatttgcctgtaatgccagcattgtggggtagagagaagcaaatcatgagagctcactggccagtcagcatagactatgcttccagttcagcaagagagtccatgtcaagtcaataacatgcagagagacaaaggaagacaccaatgttgtgctttagcctttgcttatgaactcccatacatgcgccagacatatacaccatacacacacagaccaccacagcacccacaaaacaaacatgtacactaaaaatatgtttaaaacactgtaactgtggtcaaagtaagcattaatccaaatgctgactagggtcaatactataaatatacagggattttcactttgaaattaaatgacttggggctgggaagatataccaaccaatatagtggttccttttcaagcatgaggacttgatccaattcctagaatgcatatcaaagctaagcatgctggtgcttgcttataaaaccagtgctggacaggtagacataggtgacccatggtgctcattgggcagtcaagactaatttgtaaactgtacgtgaataatagaccctgtctcaaagcagagggtgggcagtatccctgaggatgatacccaaggtcttcctgtcttctctacatatactactacaaagacaaggtttcagaaagataataccagcatatctttgtgaggttagccattgggtgcacaaaacattcacaataaagctttgcagcataacttttgtagtatagcagactttgaagcatagctatcttcaccagcattttagaattgtgtgtatcaagcgtcatgcatccaaactactccttcccccaacttctgttaaaaagaattgccaccttcagtctgcttggttgggttcttcaaattatttcacgtcctgttccttttgtgttcagagtgtatcattttgtgatatcagggagttcacttgatttcctagtttctttggagggttgagaaatactcactttgagagtctatggcctctgaatgcatctatagctggaagatttctaacatgactagtaatctgtgctgaggccatgttgaagagccattaaggccagagattttcctggtttctgtaagtcaactttcaaaactacatttgtgatattccctactgtgatacatacttaaacaggtttcttcaaaggtcatttgtttttacaaatatttactcatgttacttaattaaataataactaaagctgatactaaaaacgacaagttagaccagctttgttttgttttgctttgctttgcttcaatttctggtggcagaatttaagctatgacttttctgtgatcctgaaatatagcaaatgccttttctttccaaggtatagattttattatgttgctcaagatgtcatcatatagttcaatggcttccaagtttttcaccatgacccacagtaagaaatcctttttccatcttgattcactatacataaattt

SEQ ID NO: 415 - DNA, 212246 bp, mus musculus; identical to SEQ ID NO: 414

SEQ ID NO: 416 - DNA, 105049 bp, mus musculus
ttttttgcacaaccgcgaccagccttagagcgcggcggcggcggccagggcaacatcagcacagccatcagcggtgcagacgcccggcacccggccgcgcggcgagctccggctcagcctggagttcacctcccagtgcccaggaggcttgtcttatcccttctgatctctctgtgtctctcttcctgtgtgcctctctccgtgtctctttctctctgtttctgcctgtctctctgtctctttctctctctttgtctctttgtctctgtctctctctctgtctctctctgtctctctctctgtctctgtctctctgtctctctctgtctctctctctctctctcacacacacacacacacactcattcactcactcacttccatacacacatacacattatcttgaagaagaaaaaaaccgacccccaagcaaataccctcctgggcagcgatcactggcacaacagtagccaggttcggttcctgcccagaagcgaccgcgggctgagagctccgccactgccagctggaggagagcgatgcgggggcccgagcggcagctcgaacagtaatgtggatttacagtcatttcccgcaggaaccagcaaagacgccctaagtccagcgcacttacagcacaccagcagagctgagtacctggcaaggaggcgggggaccgcacctgaggacatcactgaaacttgcgcctggactaggtaggtccgcttcttctggcttacttccttcccgcttgatcctgcctgccttccgccccaaggactctgggcgaacttcccccctaggatgtgatagaatgcatttgcggattgtgactcctgatcttgaaaagctggttgcgcccgctctgggactcctggtggaggaaacagagcctctgcaaccttttctctgggtctccttctgcccccagggatctggacctctcaggagagatgggagattggccttgttgttagtttaggcttccagcgggcactagggacactgtcctttgaaggtttcgtgggtttcccaggtggcacttttaccatccaactccttcagtactgtaagagggctgttcgcctccgctttcgcgcagaccaaagcactctaacaagtggaccaagatgtttggagtggcaggtggggaggctgtaccccccaaaagaaggagatgatcacctccttcattacttccacctggagcatccaccaaggttctgccactcggggtcacctactactctctctgaaagaagatgcccaagggctagaacatactgtagaacctgtttgcttccgaattgctattccaccctcacttggggagttccagctctaggagaatgccaggaccctcactgaggccccacccaatgtgttatccaatctcccaatctgtgtcaaaggaaataatcctaacggggcactgggtgcttcagtagccatcggcgttggctttaaccatacgctcatctgtgcgggattgtgtgtttctgcatttcatcctgaaaacctggtgtctagaattcagcaatagccagtacatctgccgagagccaagcacccgctaggcatgcctggggaaatgtaacctcagcttctcccattccgggaacaggcggattgccaattcagttttaagatgctttgcctagaggtgtggaaagaaccttagcgctacttggtgagcggatgtgctagaaaccagtagcctatttaaacatttcagcaaaccgggtgcagctgattgtttacaattgcagagacagccgatctcactccactagtggatgtcctgtccatgtctgtttcgccactggcagaataggggcgggggccagagctggcttgcagctagtacttgcatttggcagcattgggtttagcagatctgcatcactgctgctggagacatgctaatatggttcaaaaaaaaaaaaaaaaaaactctacttgagtacaaagcaattggtcaggatttgtctcaaacttctcagttttttctgagcacactaacctagtcgtatatttatagtggtccaaagaaacaggaagagaagttccctgtgccacaggagagaaattaaatgtcatttgaatgaagacaccaaaagcaaaggatgtgccccagagaactttaataggtatccttagatgagcatttaattgatcatatttccggtaaggattacaggcagcttccttgaattggagattgttgttttataattataattagcaagccaggtacactgcactgtaagcatcaattgctactttagtctgttccgtgaagacattgcaaatgtctgctctattgtacctttggttgaaaaaaaaatcctatataccttcatcctctgaaatcttctgacctgtagcagagggcacgggaatagtgtcaaatgatagcacaacctaaaagggtttgaaagctcatttttaatgaaaagactgtccacggctttaacttcttctcagtaattatcctgcacttgtttacttgcttacccctgccatgtattctatgtatctcccaatgtgtgtgtatgaggggatgaatttgcataaggcttcatatggctcttaaaagtagataccagaatagcaaaacccaagttttgacatttttatccaaatttgaaagacttttaaaatgatatgttgaataatttactattgcaaagttcttaaagggtagtcaaagattttcaggtatgctaaaataaggttgcaaacttttgatgctaataaaataaagccataaagtgcatttgcaaagtggttcaggtattttctaaaatgagcccatgctctagatattaattaaaactttacaggttgttcatcataattttctaaaaaaaaaaatcaggtgtttctgctaaacaactatataaatgaatactcaacataatacatttgataatgacaataataaaatttgctttctagaacaataacagaaatttaggggaaacacgggattaaatgatatggtgtttacaattagagcaaggactcaattatagagtaagaatagatagacatagcagttgataaattagagagaaagcttaaaggaaaacattgttttgtagaatcatggtgctgtgatgatggctaactgaacatccaaatattcaaacatattagtgtactgaaaaggtaaatcatagtgtatggaattatcaactacctcaaggccctgcttcaaagtttgaatgtcctaaaggtctcagtgattgagttctgctatcatatgtttaagtaacattgacatgatcatagcttcccttatcattgtacctttctcctgcctttatacagattcttgctgaaagagaacaacatagccgtcacattcattctgtatgatactatttttgatgatcaaactgaaaattactatttgatgttacttttgaaaacaaaaacaatgggattttattttctatgacagttttagaaacttaaaagcggtgagaaattttagtgacaactaacataaaaaaatgtttttgattttatgctggagataggctttcagaattcatgcaatgttcgcctgaagctcccagttcctgaaagcccatcagtttccgatttaagtaaagctcttaactcttcagtatacattttgattgatcatttccctaaggtttgcaaaaatatgttaatttattagttatgaatatatttacttatgaatgacttgaggtcaagataacattggtactttgagtacctgattcaaagatatttttaattgaaatatttttatcatattagtcatacttgttacatcctcatacccacccccccccccccacacacacacacacacacatacactttcttggaaggaatcgtccaagatttcttagctatttctattcattggcttattttatttacattacatgtatataattcttaattttctgaattttaaagccaaatgtaatgatttgtgaatattttacaaagcttccacatcacttatcatttggtaacaattctgagttgggttataagcacaactacaggtagataaaatgataaaagctattgccatatgactaccagcatatatccataacttcaaatgtgagtgctataatgaaaattaaacaaatttacatttcagaattgttccacataaacaataactgatttcaatcacctgcagactactaggttagatccttctttttaatggaggttgagcttatgttttcgtcctttaagaaatgaaacaaccttcttacgggatataatgcttagctattgttaataaataaaattaaggcctgaatcacctggcttaagtttatttatatttcttttagtttttttttgtttgtttttctgtttttgttcctgatgattgctgttaatgcagagaacagtaaatactaactagcaccatgtgcagttagagcaggtgaatgttataaaaggttttacccagcttttgattattgtgaacaatcttgatggttcaaccatagctgtctcctcagtatcagtgttcaattatgtagcttatagtaatattgtagtttgctacatgtggtttagtatgattaagcaaatccaaagatattgtttaaatagaaaactcatagaaaataggactgaataaatttaaatataatggtatgaactgaaaatcattgtaaaacatacatgttcatttatctgctaatatttgcattaataattcaaccaactcattttatttagtcatagcaaaaaattacagttgatgaggatcactgatattttaaaaatagtaacattaataaaaatttaaaactataaaattcatatgtaactttaattcttatttctagacctgaaagtataatcttggataatttataactttaaaaatattctgaattatatttcctgcccaagcacctacttttggtaaacaatagcatatggtaaaatgtgtgtatatgccaaatagccactacctcctggatgatgtttttaaagtgatgtaatgattctgaaatattaggcttttctctcctaccctaatctaactgtaagaatgaagagttaactagaaaatcaagacatcaatatgtattaagaaactgttatcagattagtggatcatttttttgaatttgtttcttaggagccttcttatttgtgtttctcagaggtctgtaacatgattaatatgctttctgggtatttatgattgtatctgagactctatgattataccttggtaagacccaaatgtctgcatgcaacagccaactgtttgggacaattcagactaacctctgattgatcaagaaaatgttttcctcagggtctgagtgttttggaatcatttaacaggacgatgaccactgatatctttgcaggaaaagaaaacatgcaaaacaaaaaatggcgtcctagagccttctctgaattatataagatgctactggcatcccccaactaatacaaaaccaaaagcatactgactggtctttgctagaacagagaaaatgcaacaatttaactttaatctgtaattcttatacatcaccctccaccccgtgatttatcagtttagaaattaaattaatgggattgatatgttagcttcttatgattttctatatctcatttcccaacagtccttctactgccatggaaactagatggcacagacagcggagagtcactcattcagaacaggagcctcctttttaatttcatgtcagcctgttggtccctgaaagtaactgaaaaggttggaacaatgaatttgtcagaaatatattattaagcggagcaaaatttctgccaattttttcttaggattttatttgtaaacctcttctgtttctactcatcaagcagttctttcaaagtagtcatagaaatagaggtttgatttgactattcttgttggtatttatgtagtctacaactcatttttgttctaatagagcattcacagctttaaaatagtttcgtaataatgattacattggaaaatatgttctttcaaattttgagtctgtagactttgaagaaccctacttagttatcacagtaaaactaaatacaagtggtacttgaattttccagtactatgggttattttccctttttaaatagaaaagcagttctgttaaaatatctatgtcccacttttttttttattagagaccacatgtatttgaatgcatttatttggaatttgtagaattattgtactcatccctataaagcatgcagattgttttaattttaatcaactaagttgtcatttgataagtagtcaacaatgaggaaattgccttttaatgtttctcatattttgttctaacatttttgtggctgattaaaacttataaaattgaattttagaatcacagtctctaatatgagctgaactgaatctcatgctgtcttttgcaatgccagctatacgttctgagaatctaatgggttttcttgcaaattattgtttcaaacttttttttaatattatagctaagaaaaagcaattccttagtgaagattttttgtaatgaaaaaaggcatatttgtttgtcatataaagatcagaaggtctttaatgttttaaatgaatacacacacacacacacacacacacacacacatatatatatatatatatatatatatatatatatatatactagacagaattatgagtgatagaatagggtaattatttaaaattttagaaaaaacagttgtttacagttttgtataataggaaatattgagaatattagtatcctgtggctggattttgaaatgcatatattttattagctgttttgttgctattttcttatttgagctaaagctatataatgacaaaaccaaaaactaggtcactcatcactgctgcacatgtagagtacctaatacttgaatcatctctatcactttgatttttttaaactttatgcaaatacttgacagtttaggggaataatgaaatagtatattaactatttggctcaaactatctgataaatcacattttgttgtatagccaaatgctcaagtttggagaaatgatagccttcatttctcgtttcaaagtataatatacttactattcaattgttttcctatttagatgaaatatattatcaatattgagtgtgctgatgcagatagagtcactctcagtagaattcaaatatggctatattaaagaaactcccattttcacttttttgggaaatagtttagtgtttttagctgcctatatgaatgagggtttgtatattggccaaaataaaagtaaattactctccatttgcatacttaagggaaaaatcttattactggctaaggtcacagagaaaatttcccagttgcatggtttttgtctaattggtggattctaagtacaactattacctctaatgtttctatctggtttagacacctgtcaaagagaaggtgccagattaaatggacaattggtttattagatatcaccacccctgcatcccagctgcatgtagacatttaaagaaaattcttccatttttcagctaaaatagaaaaaaatactacagatggcccatctcaataatccacattttttcaggtacatttaaaattaaatgtcctaagagatgattaattcaggaaagttattgataatgaactcatcttatgctacacatcctttgcacccatgatgatgccttattaaaggtgtctcaatcttgctaattaccacctgtgtttaaatatagaggtgtataaatacactacaactgcacagtggctggaagcattctaaacctgaaattttggctctattcctagctaacttagttcctatcaacaaaatgtttctgatcaagattttcaatttatagtctgcacattatgtcccttacttttaatgttagtgatttccttttctaaagctgctttgcttaattgcaaacatttgagagatattgatgtgtgatctcctgctttattaagtagccccaaaatataaatgtgtttgcttgtgtgtgtttgtgtttgtgtttgtgtgtgtgtgtgtgtgtgtgtgtgttcataagattgctttctctggggaatatttattaaaagtatatatatacatttcacatcaatttcacaaacattgtgtacagacacataacaatctcctctgttgctactatatactataaaggactatgcttctttgactgagcctccactacatctataaagctttaagcagcataagacaatttaggtagaatttctaggcaagtcaaacaaagaaaattattttgagaagatagttttaattttactaatgagatctagttacctttaagaaaaagggctatgcaattgagtaggaggtgtaacaacatacacattttctggatttgaattcttttcatgttacatttttttatatttatgtgtgtgcacatgtagaaatatacatatgctatttgtaaaggtcagaagacaaagtaaagaagtaagaattctattctacttgcaccatgtgggtattgaaaattggactcaggccactgggcaggatcacaagtgcctttcctcctgagacatcttgccagccctggatttatattctttattgaaggctttactttgagtatacttcttaaaatatttcatatttttgaatttctgatggttagtatgagaaaatcacatcatgtaggtgtaacaccatttaaatttggattggaatccaagaagtgttaacaccagcatgctactttttaattatcatcattttgtcctggtctcctatttaagatttaacaacttgtgaaagtgagataatttcaatgtaaacaattagaatccagtacaagggaaatattttaatggttaacttatcacaacaaaaggaattttcacaatgtaggttttgaatatggaatacaacatagttaggcaaatgtataaaatatgagagaatacttgtcccacagattcagtaaaatacttagtgggacttggctgctaaaggcacagagcaatataattactatttacagaatttaggaataattggttttatatttccattcatttcctctaaaggagctttagttgtcatgtggtgaccccttcttttaacaaaagcttcagttttacataaattttgtcatataccaaagaacactcttcatgaataaagcttttcatgtgataatttttaatgtacttgataaacttttacacatgcctctatttagctaactgtacaaacttattcaaaagacttacctatttttgaagacaaacatatataggtctaatatgatcatgtaaggaattctctaaaagcaataaccagaatattgtgaaaactcaaacatgataaagctttataaaggatagactgcttaaattaattctttttttagatttgtaaagtctctctcgctcttctctctctctctcctgttctcaatctcgctctcgctctgtgtgtgtgtgtgtgtgtgtgtgtgtgtgtgtgtatgtgtgtgtgtgtgtgtgtgtgtgtgtgtgtgtgtgtgtgtgtgtgtgaaatgtgtattcaggagcccatggaggcccccaaagagtgtcagataccctgaaaccattacaagtatttttgaggtgcctgatatggatgctaataactaaaattgaatcctctagaggagtaatatacgttcataatggccaagccatttttcctgtatccttaaattaattcttactgagtacccctggatattttagttagacctgtgcttctcaaccttcctattgctgaaacattttagtacagtcagttccttatgttatggtgacccccaaacataaaattattttgttgctacttcatatctttaatattgctactgttatgaattttaatgtacatatctgatatacaggatatttgatatataactcagaaaggggtaataatgcacatgttgagaaccactgatagagactagaaagactcccatcctgcatggtataagggctatgaaagggcacaggctaagctagatacagagcatacctactcaggataaaagtactttctatctaggtttgaagaacaagatcaaacataatttctcatttggtattcctgcatgtgcctagtactggtgtttagtacttacatacagaatggatcaacttatttgtatggagtgttattctagaaaaagtaattttcctgatgcttatttaaaaaaaacaaacaaacaggaaagttgctatatttaaaagcagaaattatctatattgttgaattggtggaaggttttaagatagcattggggtgaccacttatactaatttactctcttaccgtgattaataaaatgaccaaaagcaaatcaggaaggaaaggttctattttaacttacagattatattaatcgttgagggaagtcaggacaatagctggaggcaagaatcaggagataggaacagactcaaaagccagagaggaaggctttttactgagttgcaccctaagacatgcttatttagcctcatcatacaacccaagctaggtgccacgcatagtgggctgggccttcctagaccaattagaaatcaagaaaatgccacatagacatggccacaagctaacctgattaaagcattcccagagttgagttgtttcttcctaggagtgtgattcttttaaaaaggtaattcctatatggaggataggttaaactggattaagagtgagatatgtgaagagactatactgcaagtgtaaaagtttctcaggatgtggaccaaaacgtgacagtgacaatgaagagaagagaatatggaacctactgtaaaactcattatgcaatataaggactgcaaaagaaaaaaaaatgtttgagtgggcaatgaggtgaggtttggatttatttaatgggcaatagcacaaagacatccagacagaattagattttagattatttaaattgaattatcagttctgaaggtagatatttgggtaccatcagcaaacacagtcattaaacttccaagaatgagtacttaggatcccctacagactgtagagaaaataggaagggaacagtttcagaaatattgcactaaggatgttagaaacccaagaggaagtattccatgggaagttatgatataagccaggaggaaaacaaaacaatgaaataaaaataaaatctaagtgcacaaggttttgtacatgccactaggtaaagggcatgaaaaatataatgcatgagagaaaacacaaatgcaaattgttctttttaaagtcaaattttgccgggctgtggtggcgcatgcctttaatcctagcacttgggaggcagagccaggcagatttctgagttcgaggccagcctgttctacaaagtgagttccaggacagccagggctatacaaagaaatcctgtatcaaaaaaagcaagcaagcaaacaaacaaaggacaaatttcagtaatcaaaagaaattctattatatatctgtgaaatttcagatgtgaaaagtgaataacttcttatgatgtgtatagatatgcatgtatacttgcaatatagaaacaatacagaaaactatatatgtgagaaatttattaataagataatacagttgtgcaaggccgaattcttaagagtcattcctcgggcatggtggtgcacacctttaatcccagcacttgggaggcagaggcaggtgaatttctgagttcaaggccagcctagtctacagagtgagttccaggacagccaaggctacacagagaaaccctgtcttgaaaaaaacaaaaaacaaaaacaaaaaacaaacaaacaaacaaacaaaaccccaaacaacaacagcaacaacaaaagtgtcattcctgccaggtaaaacctataatcaaatcaattaacaaatggctaactcatttgattctacctgcaaactctagtgtttaaaaatgagtcattttttcccctgctaatcattaacactctcaaccaagccattgttttttaattaggactgggttatagtattcacaaagattcatccatcgattgttgtccctctatgattttcgacaccacagccagtatgatttttaaatttcattaagctctgtgtttttatctcttctttacttcaatcttcatcctacaatctacaatcaaacataccacttataagatacaatttaaatatttaagaaaaaatatcaaggccttcattattttgctatcagactatgtactgtatttcctatccaaacttgctcaaaaccttctatacactttgtcttctgctttgtttctgaaacataccatgaatggtttgtcactcaggaactttaggcatgcattttcttctcttagtttgaaatatttttccatattcctactggttgtatttctcattttattcatacatttaaattattatcctttcatcataactgtatcctctcccttttgcattgatttgtgttatacttcttcattttctctcccattctctacctctattttctttcttattagttagaactacttggaatcttactgtggtttagtttgtttataatttatcaactcctctagcatacgggatccatggggccatgagctacttgcctttttatttaccactacatccatccatataaaatagaatagtgccctacatgtaggaagtgcttaggaaatatcactttaataagagataataaagacctgatggaacactaattggtagagatttgacagttttctgcaaaataattaagaattttgtacacagcaactatggtggtagattaccagtggaacatttgtctagcatatgtagaccctgtgttgtagtaccacaaaaacaatattgttatcacttgtcccaggaactttacttctgagaatctgtcctaatgtaagataaaattcatttgcaaagtttttttttcacagaacatattttgtaatggtagaatacatgttcaacaaaggaattgctaaatgattatctgttgagaaaatacaatattttatgtgtactaaagatgatgtttacaaatattctatgtaaaaggaaaatgtgcatattatattgccaagtaacatagtcagataagtaaatgtttgtgccccatatacatgtagggaaaaagataaaaaatggatgcacaaaattattaaaaacaaaaagactgttttgggaggaagtagataggaggcagcatttaattttttctttcctctgctttatatagtaatagactatataacttcaattatcagattatatgtacaagagaaagactaaatacaatgcacaaataattactggtgcattgcagtaaagtttacatggtagcttagtataaacctttctccttgggcggtatagctatagcagtggttctcagccttcctaatgtcgtaacccttagtacagttcctcatgttgtggtgactcccaactataaaattattttgtccctactttataactattttttgctactattatgaatcattgtgtaaatatctgaaatgcaggatataagatgtgcgacccctaaagagagaaccaatgaggtagaggtaaacaaatcaggtagaaatgttctctggaagttttgtttaaagaggtccacaggcaagggtaataattgaaagccactaatgcaatttagtcttcatttactagagaaccagagagagctgagtgtattctgccagtatttgaacaggatgttaggggaagattaggcaagctaagccttctacatattgctgtgaaaagcactagcaatttgcttcatgtaaagcagaagtgattactcactatatttcttcatgtcgtgtagtaataacaattaagagaagttagactacagattacttgacaagtcagccacagtcacctctaatggaaaagaagaaaaatagcattgacaacttttggcaagtctcatcattagaaatgcccatattgccagaaagaaaagaagctgcatccaataatgtaaaccaaaagttctttaggccctgaggaaagaagtgacaatccgaagtagagaggcattaattgtcgaggagcacagatcattgtaatggggaaactgtctctgttattaacacaattattttctacaaggtccttgagtaaaggttcctttggaaaaatcgcatccgagttttcaaagcatgggaagcaacaccgaaagatatcgtcattagtaaaatcaagtatactgatttgtacgctacctaagggccttgtaaataggaactgtgttcatataccacctacagctaaaatttatcaagaaattgaataattaaatgacaattttcttaaattagtagaagttattcttttcaaatccattgaagatagcaattccatatacacacatgtatattttatatatgtatatccataaattgatatattaacattttgaatgagatttttaaagtcttatctgcacaccttcaattcactaattacgtctccatttatggatggcaattatttagagatactaagcacctcctttgtgaagacagtagaatattattcttttcataggatcaaacaagaggtcatagaatctgaagtctggactagatagtctcttaatgagctgtctagatttggatttataacttggctgtcaagatgtagcccatttctaaatcataagtcagttctgtgggctgtctttctaatgtttatggcttctgctattttgcatctggtatacattatttgcttcattccagtgccaatactctcaaatattctaacttctttttgttaagtggtggttagcacacataaagtcattgaacaatttcttccatttagaattgaactcttgggtgagatagagatttgtaaaaacgaagggatgtggaacatgttggcaacttgtaagcaatggcatggaacctggggtatctgacatagatcaacctatacactggccttctataatcttaaatggggtgattcgcttctaaatgctgaagcaggaaagcaattctgaagtgagcagagaagagctatatctttttaaagccagttttcttctcatttctctgtgtacctcaccaagccaaaatgctacatataggacagtttattttttcaagtacattttttttgctagctttcttgcacaatcagccttatgggtatgaagccaatttctacagaattactctggtatgttcagcagaagagacaggaataattttgtagtctagatgtcagtacgtactgaagtatcttcccttgaaagattctaacttagcactattatggaaccacttcaacacttgagcagaactatgccttttttttgagcagcattaacaatgataaaaaatgcacatagagcaattagattgcaactaatcaagagcacttcttcagtttactatgaatgatttatacatagtacattgggcatggaaatcattagtaataatatcatactctattatcattacaaggtcatcttagtgatttttttccaaaggtgacaatgttgtttgcctacattcttttttatttctttgtttgtttggttttggtttttcaggacagagtttctctgtgttgccctggcggtcctagaactcactctgtacaccaggctggcctcaaactcagaaatctgcctatctctgcctcccaagtgctgggattaaaggcatgcaccaccattgcccggcggcctacattctttaaaagtgtatttaaatattgtcttttatcttgatatactcatagcatttttgaaagatgtgttctcatgtttgagaatttccaaatataaaataagtagatttgagaattagttgattgataaattggtgtcacaagattaactaatgtcaatcataaaatatcaaaatgttaaagtttaaagttgacattttctttttcttatgctttgatttacaatactaccttttctacaatggaaattttaaggaattaaaatatatctactaatacaaggtaatacattcattaaagaaatgttagataatggaaatatacacaaaagagaatcatgtattttgaatacagttttctatactgatcacattttaaattactttattacatgcattgtatttaccagtattttgataataatttctaagttaataaaaaaatatatatggagagaaaagcagtaaaaaaataatagcccaaaagagatctaacacacttcatcgaatggccccactacatcaggctgcagtggcaaagagccaccctctataagtgcctcaaagtccctcctgccattaccgagttcacccaggccctggacaggtaaacaactactcagctgattaagcttgcccacaagtacagtccagaaacaaagcaagagaagaaacaaaggctactggcacatgctgagaagaaagctgctggcaaaggctacgtcccaactaagagaccacctgtcctcggaactgaagtcaatacagtctccaccttgatggagaacaagaaggctcagctggagtgattgcccatgatgcagacctcactgagcttgtgattttcctgccttccctgtgtcaaaagacagggatgccctactgcatcatcaagggaaaggccaggctgggaagcctggtgtacagtaagatatgcaccattgttgtcttcacacaggttagctcggaagataagggtgctctggttaagctggtgggagctattagaaccaattataatgacagctctgaggagatctgccactactggggatgcaacatcctgggtcctaagccctgcctcacattgccaagctggaaaaggcaaaggctaaaggactcaccactaaactgggttaaatacacagtgctaagttttctgtacataaatataattatatatgtaggaaaagatcaaataaactgcatatcttaaaggattaacatctactgatatgctgctctccaaaaatgtatccatatgcattgcttatgagggtggggtgttgtaaagttcatatgttaactatcattagattacatattgaataaattatgccacagcaaaatatgtatctttcaagtagagcatattagtgtggccccttttatgatagtaaacctttggtccaagtgctaagttgttgatatgtgttaaaaatattttaccttcatttttataagtgctgtataaagatagcatgtgagtcattgaatcaaagaataaagcaaaaagaaaaagacacacatcttgatgctagctctgccatgtaccatttatattattcagtgcagtaatgctagctattgaagatctatgaaccctagttttccaaacttaaaacaattactaggagaaatagattaagtctgtataagaaggttttcagtaagtacaagtaactattatactttaagcaattattgttagcatagacttcatgttgttaatgacattgtgatatcatatcatctcaaaaggtttagtataaattaaatgaggttgtatggggagtagacataaattccatactattctatgtatatacactgaaattaaaatactctttagcctagaatgtgacttagtggtagagtgcttgcctacattcctaagaagaaaagttccataccatgtacagcaaaacattaaaacaaaactccttctattagcagtgcagttaatataatggaagtttaaagcatacctttagtcaagaaacacaattctcatgtgaattagaaaataagctaccctagagatggaacaacattatgaactaaccagtaccccggagctcttgactctagctgcatatgtatcaaaagatggcctagtcggccatcactggaaagagaggcccattggacttgcaaactttatatgccccagtacaggggaacaccagagccaaaaagtgggagtcggtggataggggagttgggggagggtatgggggacttttgggatagcattggaaatgtaaatgaggaaaatacctaataaaaatattaaaaaaaaagaaaataagttacagtgtatatatagtcccattatatagagtgtatgtatagtcagtccctctcagtatgtatgtgtgtgtgtatgtatatttccctcatggaggaaatgcactggacctgtttgtacatctatatgaaagataatttggtctaatttttttacaggaattacaagagcgacttttattctgtgtaacttctcttctggatctaacaaggtatgtttaatctatgctgaatcttttaatataatagtatgtattattgagttgattttagctgaaatgcatagtttaatttttggaatttatttttctattttatatataaaatgtttatagaatctattattatgagagagtatttgcaaaaccaaatgttcaaactgtctgaaaagtttgaattattaattctgcaacattttctatacatagtaactaaccttaggagtttctataactagtgatatcctctgtagagtgagtaggaatagcagttaccaataacgaaatttgcaaaattatttaatagttctcgtggactataataaaatgacacttttccctatcaatggaacaaatatttctatttagaagatccagaacaaaatttgcctccagaaatgtatgtcatgattctttaagaagtagcaagtgaaatatttagatttgcatcttttgtttaacattccatttttcttcttttcttctacccatctatccaaccacatatttgtccaatgaacattcactaagaaaccatcaaaaatcactgcaccctttcttctgataaataactaatgtagctatagttcaattagagtatcgattaagtgcttttagagtcagtcctctggtggaatatatacaaaaatgtggcaagatttgtaacataccttacagttattaattttattaaaacattagtcattattaagttcttagtaactagggaagagatagtattgctcttttaaactttggtccctatctgtgatagtgctatacaccattaatcaaatattaattctcattccaagtggaaacaatgaaaggatgatctgaatttgaagtaaggtgttaagtctttgacatcacatagtacttttaaagtaaactatataaatatataagtatagaaaaaaagaaacagaaatccctcaaatcttaggatttgtatgcagtttgaaaaatatactaaatgtaaaaatattctaaatatataattagttagagctcaactagttataattattctaaacatgaacttaaaatatattagccaattgttaccatattaaacataacttcatttaccattcatctagatgtattatctttaggagaataataatatgacaaagtttagataattctacaacaaaaattataatcagataaccaaatgacaaaattaaaagaaaatttccttagagaactattcaagattttcacatattatgtcatttgtgaatttggaagttgtctatgtgccctaatatcattgcatgctattaacatatctttcatactaagaaagctttatagttaatgtaaagtaatatagtataattaaggcgaaacatccctggaaaaacttgaaagatgcacacttacaaaaagatattggcactgattacatagttcagagaacgtctaggtttgcttctttagtgagaaagcatgccatggcagaaggcctgaactctattgctactcttctattaacaatacatttctgcttaggtcatttctctttagtttcctcatctatgctaaaacattgtgatgaataataatgtttctccctggtcaaaaatcctgtagtttaaaatcgataggtagttgttagggcttgaaacatggataccttagtaagtttcttctatcttaatcatgaggacctgaggttaatcttctaaactcacttttcaaaaacaatgtacattgtattactttggaacatacctggggctggcacatagaatctaactgaatgagtaagatctatacaggttcagcgagtgatcctgtcgaaaaaaataaggttcaaagtgattgaggaagtgtgatggtttgaatgacctatggtctccatagggtcatatatttgaatgtttagttcctagttggtagaaccatttataaaggattaggaggtatagccttgtgggaggaggaatgtcactaggattgggctttgaggtttcagaagatctctgttttagctctcttgctctgactcatgcttgtctgtttgcctgctgccatgctccctgccttgctgatcaaggactcaaggacccacccacagaaaccatgagaccttacaataaaagctttgttctataagttgctgtggtcatggtgttttatcatagcaatacaaaatagtcactaagacaggaagacagctacccttgacctctggtttccataggtacatacaagcacatgcacccacgaatacattcccctaacacccccctctcacaaaccaggattcttctcaggtatgtgtatgagtcagtattggttgttaggttggaaaatatacacacaaatcagctgtccaaagatttcctgttaagtggttaaaatgaattagtaataaaatacttgtttctctttgaaacaaagtagctatgtattcttaaatgattagcacccacttacctctctccataacaatacttgtactggcattatattaattagactgaagtctaagtttaactactagtttcaaagtttttttttcccccttggtaaaaaggtttaaattagtggtggcatattcccatgctggttctctttgtgtctcttaaaagtttagcaagctctatgtttcttgccttttgcttaggtggtcattcaaggtcaagcatctctctgtaccttgaaagcagccaagtgcataacccgatgacttcaaactccaatgctttcaatctggcacctttcatgagcttgtgttcatattaaagcattcaaaatatattctccttcatctacatatcacagcaataacatcctgggccggacagtgcctgggagcaaataaccacttggagttaatgatctgaggggcagctgaaggaccattgactcttcctagtcttttcttcatcccaataaaatgtctattcctgaagtgccaagccttcaataattttccatcacacatcagattaagtagtggctataaataatagtatttaatacataataatgagatgtggcgatgcagtaaaataccaacaattcaagtgctatataaagatggctattctgatcaaacccaaaaagcagcagtaaatgaagttctcgaatcgtaatgttttagaagtgactttcatcttattgatttgaaatgaaatataagtaaaaattcatgtggtataagggaatagtttactttcttttgtcccatattccattgatgaatgattcagtttaaaaataattttataatgcctctgacatatccttttaaatggattttaagtagtataagttcatctccatatttagaattagattcatgcttttgaaatatatatagctgtgaactaagtaacaaatgctagtatacgatggttcccaaacgaactttcacttactttatttattacagtgacacccattaagtttccacaatggggcatggtactaagttctagtgaaataagaatcagcaaggggcaggttctacagtcagaaccacatgatatgtagttgagggctgaaattatgcatttatgtaccaggtaatcagtgttgttagtatgtattacataaatacatttgttttggacattattcttccaagtgaaaaggattcatacatcaaattcctacttggtaaagcaataatatatatgattgcaaataactccacattcaaaaaggaatcacaccttatgtgaggcataattccctgtacaagctcatcttttaatctgtagaatttgtaacaatgtcatgccatatgtatgaaagaattaagaattagaggtgctaatcagatggccttaaataacagaggaatatctgtatagaatcaatgaagttataaggtccttaaaagtagaagaaggtgacagaacagagctgcagaaagcatgaaaacaacctaacatggtattggcagctttaagatagaggaagggaccatgaaatatggataacctctggatgctaaaaaaggcaaggattcacattatatgtaccctggtgcctcatttgaaaaattcacccttctatcatcctaaatttatcctatcaagaactgtttaagatttcttttttgttaatttatttttttatcctttaatccttttttacagtacagacttcatacccctccctgtgtgcctcctgaccactcaccattccatacctcctctctatccatctgactccaagagggcaaccttcctcatcgcctcccccaacccatcacaagggcgccccattccttggggctcaagtctcttgagggttaggtgcatcttctctcactgaggccagaccaggcagttctctattgtatatttgttgggggcctcatatcagctggtttatgctgcttggttggtggttcagtatctgagagatctccaggggccaggtcatttgagattacgggtcttaatatagagccaactcctcctcagcttcttccatctttcccccaattcaaacacaaggtcctggcttccatccctttcttgggtgctagtatctgcatctgactctttcagctggttggggcagccatgctaggcttctgtctgaaagcacatcacagcatcagtaacagtgtcagagccccaggcctccctctgagctggatcccaatttgggcctgtcactggacctcctttttctcatgctcttctccatttttttttcctgcagttccttcagacaggaacatttctgagtcagagcttttgacagtgggatggcaaccccatcacttcacttgatgtcctgtcccttcactggaggtgaactctacaagttcctgctccccactataaggcatttcatctaaggtccctctctttgagttctgagagtctcacacctcccaggtctctggtacattctagagggtccccccagcccccacctcctgaggttgcctgtttccattctttctgctggccttcagggcttcagtcctgttccccctaatccctgatcatgttcttcctttctcttcctttcttctctcccgcacaggtccctccctccctccctctgtcctccttgactgctttcttcttccttccaagtgagattgaggaatccttacttgggtcatttggcttgttaaccttcttgagtcctgtgggttgtttcctgggtattctgtgcttttttggctaataaccacttattagtgagtacataccatgcctatccttttgggtctgaattacctcactcaggatgatcttttctagttctatccattcccctgcaaaactcatgatgtccgcattctttttttaaatatttttaatatttctattaggtattttcctcatttacatttccaatggtatcccaaaagtccccgataccctccccccaccccactcccctacccacccactcccactttttggccctggcgttcccctgtactggggcatataaagtttgcatgtccaatgggcctctctttccagtgatggccgactaggccatcttttgatgcatatgcagctagagtcaagagctccagggtactggtaagttcataatgttgttccaactatagggttgcagatccctttagctccttggatactttctcaagctccttcattggggccctgtgatgcatccaatagctgactgtgagcatccactactgtgtttgctaggcatagtctcacaagagacagctataccaggatcctttcagcaaaatcttgctagtgtatgcaatggtgtcagcgtttggaggctgattatggcatggatccttggatatggtagtctctagatggtccatcctttcgtcacagctccaaactttgtctctgtaactccttccatgggtgttttgttcccaattctaagaaggggcaaagtgtccacactttggtcttcgttcttcttgagtttcatgtgtttcacaaattgtatcttatatcttgggtattctaagtttctgggttaatatccacttatcagtgagtacatatcatttgagttcttttgtgattgggttacctcactcaggatgatgccctccaggtccatccatttgcctaggaatttcataaattcattctttttaatagctgagtagtactccattgtgtaaatgtaccacatttttttgtatccattcctctgttgaggggcatctgggctctttccagctattataaataaggctgttatgaacatagtggagcatgtgtctttcttactagttggaacatcttctgggtatatgcccaggagaggtatagcaggatcctccagtagtactatgtccaattttctgaggaaccgccagactgatttccagagtggttgtagaagcttgcaatcccaccaacagtggaggagtattcctctttctccacatcctcaccagcatctgctgtcacctgaatttttgatcttagccattctgactgctgtgagatggattctcagggttgttttgatttgcatttccctgatgattaaggatgctgaacattttttgaggtgcttctcagccattcggtattcctcaggtgagaattctttgtttagctctgagccccatttttaatggggttatttgattttctggagtccaccttcttgacttctttatatatattggatattagtcccctatctgatttaggataggtaaagatcctttcccaatctgttggtggcctttttgtcttattgacggtgtcttttgccttacagaagctttgcagttttatgaggtcccatttgtcaattctcgatcttacagcacaacccattgctgttctattcaggaatttttcccctgtgcccatatctttgaggcttttacccactttctcctctataagtttcagtgtttctggttttatgtggacttccttgatccacttagatttgatcttagtacaaggagataggaatggatcaattcgcattcttctacatggtaacctccagttgtgccagcaccatttgttgaaaatgctgtcttttttccactggatggttttagctcccttgtccaagatcaagtgaccataggtgtgtgggttcatttctgggtcttcaattctattccattggtctacttgtctgtcgctataccagtaccatgcaatttttatcacaattgctctgtagtacagctttaggtcaggcatggtgattccatcagaggttcttttatccttgagaagagtttttgctatcctaggttttttgttattccagatgaatttgcaggtttctctttttttttaaaaaattaggtattttcctcatttacatttccaatgctttcccaaaagtcccccataaccaaccacccccactcctctacccacccactccccccttttggccctggcattcccctttactggggcatataaagtttgcaagtccaattggcctctctttccagtgatggccaactaggccatcttttgatacatatgcagctagagacaagagctcaggggtactggttagttcatattgttgttccacctatagggttgcagttcgctttagatccttgggtactttctctagctcctccattggggaccctgtgatccatccaatagctgactgtgagcatccacttctgtgtttgctaggacaaacaagagacagctatatctgggtcctttcagcaaaatcttgctagtgtatgcaatggtgtcagcgtttggaagctgattatgggatggatccctggatatggcaatcacaagatggtccatcctttcatcacagctcctaattttgtctctgtacctccttccatgggtgttttgttcccaattctaagaaggggcaaagtgtccacactttggtcttcgttcttcttgagtttcatgtgtttagcaaattgtatcttatatcttgggtatcctaagctttctgtcccaactggtaagaaggacacatgctccactatgttcatagcagccttatttataatagccagaagctggaaagaacccagatgcccctcaacagaggaacggatacagaaaatgtggtacatttacgcaatggagtactactcagctattaaaaagaatgaatttatgaaattcctaggcaaatggatggacctggagggcatcatcctgagtgaggtaatccaatcacaaaggaactcacacgacatgtactcactgataagtggatattagcccagaaacttaggttgttctttctaattcgttgaagaattgagttggaattttgatggggattgcatttaatgtgtagatgtcctcattcttaatagctaagtaatatttcatagtttaaatgaatcacatattttgtatccattcttcaattgtggaacatctggtttgtttccagcttccagctatcacaaatatggctgctgtgaatacactggaacatgttgcccctgttacccatggtgtggcatcttttggtcatatgcccaagagtggtatagctgggttttcagatagatctatttccagttgtctgaggatcctccagattgatttccagggtggttgtaccagtttccagttccagcagcaatgaaagagagttcctctttctccacatcctctccaacatatgttgtcacttgtagttttgatcttagccattctgactggtgtgaggtggaatctcaaggttgttttgatttgcattttcctgatgactaaggatgttgaacatttctttgcgtactttcagcccttccagattcctctgttgtgaattctcttagttttataccctacttcttgattgggttgtttggttttaaaaacaatttggtattggtacagagacagagaggttgatcaatggaatagaattgaaaatccagaaataaaaccacacagagaaacttcatctttgacagacaagccaaaaatatacaatggaaagaagaaagcatcttcaataaatgatactggtataactggcaatctctatgttgaaaaataagaataaatacatatctgtcaccttgcatgaagttctagtctatgtggatcaaggacctcaaaataaaaccagatatactaaatctaatagaagagaaagtgggaaagaacctggaactcatttgcacagggagaaattccctaaacagagctccaatggctcaggctctaagataaaaaattgataaatgggacctcataaaactggaaatcttctgtaaggcaaaggactcagttaataggacaaaccagcaacctacagattgagaaaatattttcactatcctcacatctgatagagggctaatatccaaaatataaaaagaacttatttaagactcctgacttattcgactctaagagaattctgtgttgtttcatatcataatatcctcactaatttatcagagtgaagtccttgagaaaacatggaagtgtctagttgtaatccaaacataattactaatagacatggctcatgttacttctgagatatttcatccagtgatcatctccaaacccccagatatcctttaggacattccttctgagaaggaatttgttaggtctttggaaacccattctcattttcagggagaatttggacctttccccattccattttctgtaagctaggtgttaaactaatgaccttcaaatagcatcttgttttcactagggatcttacagatatcagttgaaacaatataacttagataattcaatcatgttttatgaaaatgcaccagctacctatttttgtcccatattcattcgcatatctgcatatgtatttgaattctggatgcattttaaaggacacagctgactagatcttccttggaatagaaatgatagcaactatatcattcagtcttttcaaaataagctattagaagtcacagaagttcccattgtccttaagtttatctaattctgtaacttcctttgttaaaaaacactgtgattgatgctataatatttttactcagcttaccacaacatcctgtaggatctgtcattgtgtcattcgttctaatttgtaccaaaattatagttttaatcataagtgtgcatgaagttaatgctcattttactgctgacagtcctttgaggaggtggaagacagcgctgaaaggagatcctttggtaatcctaagaaaggctgattttctgttaagtacatttttgtaagtcatttttgtcatttcgtaaacatgaaatgattattccttcagacagatgaaatattcattaagaagagaagtgaggaaatcacagtactattaaagaatagcaaatgagtgggatggctgtcaagcatcccctgacctgaggaaaaagaaatcagagtgccatagagagggaccatagaatgaaaacttttttaaaggttatttccataaagtctgtagaaatcttggcttccattaagatttttgtccctgagagcctaaactgtaagtatggtatgtgctttgtctgcagaataaaaaagaagatcttcacttaatcattatcctgggagctgaacagcctgctaaatttgaataaaaatgcctccttcattactgatgggaacacagagttccatgtatcagtgatttatggagagcttactaacagggctaacttataaatgaatggtcagtttaaagaataatacaatttgttaatgtgtctagcatcaactgagatacattatgcttccaaattcaaagggaaaaaatgctaccaagtgaacactgccagtgaaaatttttactttgctttccatatagagtgagggatcatagccaaccatctctttgtaaagttcatttctctgtttcatctcggtccttctgagatggcctccttccactttatatagtttaacaccttattagtaccttcccaaagcttgacgtttttctttgcttgtagcattgccagtgtattttgttttcgttgttgattgagtttattcttcctgtaagaagaaccaagttacttcgaaagcaagctttttggtacatcttttcttctaggagagtttttctctctttgggaagttgttgtgtatattttatcagaatgactatcatatacttgccttttatgaaaagaaaagggaactggagagatagttcagcaattaggagaacttgttcttccagaggtcccaggttgggttgcaaacattcaaatggtagcttacaaccacttgtagctctagctcttcgggcctctgagggcactgtacacatatggtgcacattcaagcttacaaacactcatacaaaggaaaaggaataaatgaataaatctgtaacaaaaaggacaggaacaaaactgacgcacttatactgctttagatggacaatcagaacattttatccaacaagatcagataaaaagcttcatagaagtagtaaccatatgtattttatctttaatgactagcaagtgcctagaacagcatctcacacttgtagatatttagcaaacacgcgtttaatgctttaatgaatgaatctcagaaacagaactgttctaacccaacagaggggaataaaagtctcctcttgacttgccttattcacttcaatatattacactgtacctaacatgctgagattttcccacatagtcatatatttaaggtaataattgaatatctcagtgcaatttatgcccatgctaaattatacttcttgtgggacagcatggcaggattctactcagggtactacaaattatattgatagggtgaaatgtgttttcatgtctgtttgtaaaatgtggaatattattgaattactttaaatgtcatgtttgagatgagctcaggctggtttctttgggcttgacacatttcagtctgtcatcttgtccttagagatgctgaaaattaaatggggatctttaaataatttaccttataagtttgcttatagctatgtgttttgtcaagccagatgtcagtaccctcagatgctgcttgaacataaattaaagttggtgctgcatatcaaagaacagcatgcaaaaaaagaaagaaaccactgtaatctgtgctaggaaggatgttttcttctttaaactgttagataatgtggaggagaaaaaaaggctaatcattcataaaagaatattgcttaaatatcatgggaaatcctgttccctgtatatataatgacgtaactcatatgtctggaactggaagtctataatagatatcatcttattctagttccacgcctttctatccttagaagacatttttttcctattctttttcaaatgcaatagacctagtgtaggttttatgattatagcatcaacacttccagtttatggttaaaaaaaaatggtctagacgatgttttaacagggcgttttattctagtgagaaattatgcatctgagctcatcttccctgacataaatggaaaacaaacaacagccttctatgtaatttaagcaaggttgtgggagatgacttaaaatgatagaaacaaagcagattcgttcccagcactgcacacatccacagtgggacagtcagctgctatgtctgggtttgtttctcaaagaaggtgaaaaatttaggatgaatcatctctcaatttccttgcatgcccagagttctttgagaagtagtagagtcttaccaacctctatctgaactctttgttttattaaattctgcctatgtgttaaggcccataacagatttacaatgatcctaattcttccatgattttcttaattttcctaaagtatatacataatcaggaaggcatattttccatgtttatgtcatcttgcttatccaatttttatctagttatctgatgtattttttcatattaaaattgtctccccaaatatattgcacaagactttttttttttgagacaaggtttctctgtggagccctggttgctggctgtcctggaactcactctgaagatcaggctggcctcgaactcagaaatccgcctgtctctgcctcccaagtgctgggactaaaggcgtgtgccaccaccgccctggctcatgagacttttatatacagcattatgcctaataccaattcctgcatggaatctgggacattatgaggtatgacaaaatttgtcaagtattttagatgagattctaatcacttagcattaggagaccaactgacttggtagctaaaagtataaaggcctgtgtatccatttatatggacttctacaaacaaaattactcattctctcgtggcttataaaaaaaaagaagagaaaatttaattcttacagttctggttgctaggaggtggtccatgatgatggtgctaacaaatttgattcatgtcctaactggccatctgcttcacagacaacagcttctcactattcttcatataatgtcaagggtgaaaggtctctctgaggccttagtttaagggcatttattcaattcaggagagcaaatccttatggtatagtcagtttccaaagaccgttttcctgatatccaccctggagtttaggatttaagcatattaaatcagtgggcctaggaagggacaaacacttagattctatcacttcctctgaaaatcattgccctagactcctacattgaaaggatattataattaattcgatctttcatggctacaaagatctatctggatatagcatttttgagaaataagtccttcttttttcaggaaggttattatttctgtcatttttcttttctggaattctgacatcaaaaataccttagttatgatttcttttactatgaaataatagtatgaccaaaagcaacttcatgaggagagggtttaagtggcttatacttccatattgcagtccatatttgaagaaagtcaggacaggaattgaagcagaggccatcactgaattctgctaacaggcttgctcccagaggcttgttcctgctttcttatacacccaggaccaccttctcatgggtggcagcatcttccattgcctgccctctcacagagatcatcgattaagaaaacacctcccaggcttgcctgcaggccaagctgacagagatatcttctcaactgtgattcactgttcttagaaaactcaagctggtgtcagattgaaaaacaacaagaaaaacagcaaaccaactgactaatgaagtccactcagcttcaagaaaggccatattatgacctactgtgatagccactctagtgagcatgaggacagttagtgtgcatagagtgtcttagttagggttttactactgtgaacagacaccatgaccaaggcaagtcttataaaaaacaaacaaacaaacaaacaaacaaacaacatttaattggggctggcttacaggttcagagattcagtccattatcatcaaggtaggagcatggcagtatccaagcaggcagagctgagagttctaggtcttcatccaaaggctgcctggtcttctactagccattggagaaggtatagcctcagctgcagttgatggcccaagactgaaggggtcatgcaacgaatttgaggcttggcaccatgaagagagcctatgagaggctattggtgaagcctagttggagtggaacaccccagtatattggagatgtcagtaccatgggatgattaccaagaacagcagccttagtggagtggattaatctgagcttagagtgctacagagggcagagctggagtagtgatgccagcccttaggaggagtccaaaagatcaagtggaatcctagacactgaaacaagaagctgtaacattgaaattgcctttgagactcaaagatgttaaagatgccagagccatgggatacatgttgaggaaagctgctaacagggagtggagcaaacccaggagaaagcagtttgttgcagtcaacaaagatgaaaaagtagtggagatctgaagactgctttgacatcatctatggagatgcagagtttagagtttgcccagctggtttcctgccttgctttggggattacagttaattatttggatgaatctcagaagagaccttgaactttggacttttaacattgctgagactgctatagactatgaggactttgaaagttggactaaatgcattttgcattatgctatgtttaagtatggcccccatagactcatgtttttgaataagtctatgagggccagggagtggaatgtgatggtttgtatattttcagaccagggagtggcaccatctggaggtgtggcctggttggaataggtgtatcactgtgggtgtgggcttaagaccagctccagctaaccagcatcaattgtcccagtagttccttccattcttaactctacagccagagccacatggctgaatctgtcgagttctgctgcttgcaggaattagaacatgacccacttgtactattacattgtcactggctttctgttttacaaatccttcactacttaagcttggctatcctgggtcttgctctgtagattggccttgaacgcagagatcaacatgcctgactcctgggattaaaggtgtgaatcaccatgcctggatctaaatttagctgggtaggatcttgccctgaggtcccactcttttaatctgttatcttctagaatataggattttgctccatttcacttcctggtacccctttaatactcgaaccatatattttatattttccctttctaagcttgctatgcttgttcaaacttctcttcataagacttaaccagagaacaaagtctctgctgagcttttttgaaactttctttgtcagtgcaattaatctgagtctcttcaccttagcctcaggcagacttttcaggcaagggcaaaaagtagccacattcttcaccaaaataccacaaaaacagtctttatgccacattctgaaattcttctcctttgaaatctcttgggccaggtcaacacagttcaaattactcccagcaacaaagttttccatattcctactaggatgacccattgaatcccatttaaagcattccactgctttcaaattccaaagtcccaaaatccacagtctttcaaataaaagcatggtcaggcctatcacagcaataccccagtccctggtaccaacttctgtcttagtgttttactgctgtgaacagacaccatgaccaaggcaagtcttataaaaacaaacaaacaaacaaacaaaataaaaccatttaattggggctggtttacaggttcagaggttcagtccattatcatcaagataggagcatggcagtatccaagcaggcatggcgcaggcagagctgagagttctatatctgctagtagaggactgacttccaggcaactaggatgagagtcttaaacccacacccacagtgacacacctattccaaccaggccagatgttgccactccctggtctgagaatatacaaaccattacatagagtatactccatgtgtttgcagtgaagaagatgggacataaaacaagcacacaaaataatttctatattatagtgtaatgaaatcatattaaaagtatatatgagctgaactgcaatcagagacaagtgggcttctggctttcttttggtttatatattagaaagtacatccaaaatgttacaatgatttgagctttagaaaatgttagaacatggactttaggagatggaacaaagtacattcaaggctgaatgattcgaataaggaaaatcataaagacacacaactgatatgtctgcctgaccacctggttttgttagattagagaaacggttggaaaaacattttagaagatatgcgtcaaatgacaagacttttcctgacttattattcacctttcaggttcatttaattccctcacaggaatagattctaaaatgaggaagaccatggttttgaacagaagcgtagctcttcaaagaattgtattttaggtaagcaaattaagatgggctgtggatgtatgcgtttgagataagaccaaagctgtttaaaaaacatctgagggtcagatataaacgagatatcccagttcgtttaaaagcaaagccaaagcctgactgtgaaccaaattaagaaagaggaaaataactctgatttatgccagccatgtgttggccactatagccagtttgttagtcagttctttgtaattggatttctgaattatttgttcttcctacattattgccatctttaggaggaatgtggtcatttttcagcttcctgcattgataagtaggtatacaactcccactgtttttcatgtgtgtctaatttttgccactctgctgaaaaatatgtgacaaatcagaagtcggtatattgcattttacatccttagtaggaaacagtttcagcaggaggtacagtataatacagaatactcaagtagaagcaattcatttaagcctgcaagcattcctgtggtacagtggtccaagcactagccacagatagaggggcaaaagatgcagcttttccctcacgtacttactcttaaggatgaccggaacacatacatgttgtattcattttctctggctaaagaaggaactcatgatctaaacgactgataatgaaaccaatttattatttcacaaattttgcaagtcaaatgtatggacgtgacttaaactgtttttcttctcagagtctcacaaggctgtagtgcaatgttggcccggcttattttcttttgaaggttgagtagggaacaatctacatccagttcttgcagaacaaatttcttcataaatgcaagtacatagcagtgtatttcttctgatcaaggaatagaaaggatctgcagtgattctcctatctaacatcagtgatgacctagacaccctttgaaaggactttttggattatactaggcttaacccagtataaatgatcttttgatgaagccaaagtctactaattggggacttaattactcctgaaatattactttgcctttgccatattctgttttctacaaatatttcacaacatcaacacatattcaaacaaaggacattaatacaagggcatgacttactatcattcttttgctgtcacatcccatacaacgtacaaaccatgaaaataaaaatccccctgtatgactggatttttaatcacagtggaaattatgtgtaataactgaggaaacacaaagcaaaagtatatgtggggatgacttacttattcaggaaatgcttaaaacaaatctatccatgtatcctttgatccgatgctaacctctatggctgaagcaagtgccacataccaagtggcttagatacatctttacagcattccaagatttcagaactctaaaatatgttcctgtctagaaaaaaaaaagcaaagaaaaagaaaaaagtaaagaaattctacaaaattagatgacaacaaacatatttctttatagctacagattccacatatttagttgtgtaagtaaagcttgcttttatgtgacagacgtttccatcagagatgcaatggacttgtttattcacttgagaaagggaaccctaactagaccaaagcaacagctgtgcagatgtacattcgggatcactgagggattttgtttgtttggttggttggttggatttggtgttttgttttgttttgttttgttttgttttgttttgttttgttttgtttcagtgggttggtttgtttgttttgctcattggacttattaacttgtggctgaggggttacatacaaggagatgttccttataactaaaattggttgcatcaccaaaaaagcctaccattacactgatgtggacttctgtaaacctgaaaccctggagtttttccctggagcattcaggcatcttgctatctggatatctctttctctgcagtttggctgctcagaatctgtgaccctacgcttctgtttcctcttttttataatgtggagtgggagccttcaagaatgttccagttgtattctccaggatgtgtaacctttgtttacctcctgaggtcgaagagcctcctctttccttcctagagctaatgtttcaatttggaggaaatgttgcaattcaggggaaatgttacaattcagataaaatgtcttagaaggacatacaaaaaccacaccaacagaagtaatgaaagtgtacttgaatgggtagaataagcttaacatatgtcccttgacaccaaattgtgattgatttattggcttctctatttactttgtgtggaacacagaaaattacaatgttcaaaccttggatttggaaatcttgctctctggtgtattcaggtaatgagcatgaatggggagcaaagcgacttctcagtacattccttgtagtcacagattgctgaaatttggtttgaacttttttcttctattatggtgctattgaatcagagaaccaagccaatcacacctacagagcaacatttagcactcccattttacaaaattgcttatatagatctggataagtagaatggtgaacaacatgaccttaaatataggtcctatactccaaacgcagactttctttcagtgtgtttatgagttaatgaggaagtgtgacagaagagcaatcgatacagaaaacaatagcatccaacctctttagttcttcattataataaaaggtcctgtgtttggtgcgctccctttgcattgttcattttaagctccaaatagtggatgattgtagactcaaagtatttatactgcaaagattaaaaaaatacatgatattgtttctaaaaggtattgttaaattccaatagaaagacaacttaagtaggttctctttgccccattagtgaattgatccccttactcagagtggaattttgcaagcatccttttcctacagtaattgtaatgatgtgagcatttgacctctgggaatgaaaaagcaatcgcaaaatcatttcatataggttattgcacaacagacaggatattacatttctaggcaatgttgaccatttgttcaaagctactttggaatgttctctgtctattcaatttcaccagagatttctgttatttttttttttttttctactcaggctactttgggctaaaggttaggataggtttttttttgtttgtttgtttttgttgttttgttttagattttgtctttgtttttattcttaatgactgtttagtcaccccaagttgctctattttttttttaataaaatgtgttgggcatcagttccaaaaaggaacagatattgccactccaagttgtttgcaaatctcccctgaagtgaaaacagtggtgttacttcagtctgcaaagctttatccctcagctgatagttatggtgatgtcattatgtcaatatgaagaagatgaaagttgtgatcctatagtttacattatcagctaacatgcaatttgatctacttttaattataggcaagtcatttcagagacatattaaatatataccaacctttctatctaagcatcctgttacctggtaaacagcaaaatcatattgtcataaaattatatattttgtaatctctgtatttaatgtgctggagcatatgtatcataagcttcttaatttacaccatcagtacatcaaacatattccagggccttgattgttggtttctaactttattacagttattagtagtataatgttgagaaattcatatattatctctaggcctcagtatttcagtttatttttcaaaggtttcctgacaaaacaaaaactaagatcttcatataatcatacacacacacacacacacacacacacacacacacacacacacacgagcttcagtgatcacaattgatagcatgaagaaatgttagcaacttggattagcctgatgattaaacttattatatggtaaaaacttgtagatacttctggaactggggagatgacttagtgggtaaagcacctgttgtgcaagcactaatatttgaacacagactccattgctgcttgtgtctagctccagcctttgagaggaatgaggagatggagataagaggaattcctgaagctcattggtcaacctattccaaatgcatgaacttcagtgtcagtgagactgtctttgaaaacaaaaagtggagaggaattcaagaaagacatctgactttaatctcagttcttcacacatgcatgcatataaccacttatctatacccatgtgcacccatgcacatgttatatacatgcctcacataatcaaatctctgataactccctagtataaatatgggaatttaagtattttatataaacttaaatgttctgtaagaaggtcacaatgccttataattgaaatgcatacttaaaaatagactagggtttcaaaattccaaatgtattttatataaagtactgtgtgtaattatagtttactctttaacaagaaacttacagaataaagaacagatattaatgtgttgtgttggaaatgctattatatatctctgtgtattttcaagacatattatattacatatctgaaactcaagtgccattgacactaaatcatttgagttattacttatacaagttactttttctccaatggcagaaactttggcttttaaaagcgcttggaaagtaggtcaggacaacatcctttaggcacttggaatttaggtatctaaattttttccatgaatttttccatgctacatagtaaaataaatttcgatttcctatgtagatggcatcttgtaagtaaaagagtattttagatatacatttacatttctcagtagtctcatataatgatttctttatgaatcatggatatagtgactattgcaagagccagagaatgtttaaaaactccaacttcctctatatttctgctttatatacaaaatcaattcttttttctactgtccttttccaacttctcttgctgtgtctttccatcctcataatggtaataagaactggtataatttcattaagtagagattatgcaaattaatgtagagttcttcttgtgatgacctagatagaatgagtgaaaattgttttgtcactgtaaactaatgtgttgggatagacactcagtgtcatttgtgacagctttaccaactcttgccctgtagtatggagtttgttttctagtcataatcatgattttcttttatgactagcatttggtaagaagctgaagggaagtaatatttgattgttaggagtaaggaacttcctttctagaaactttctgtactcaggaccaaagaagattaactccactttcgtgtgtttatagcagttcctacatttaatggtggagatatagtccaacttaatgagtcagtacagaaatatgtggctagggaactgtgggttggggtggggcgagtcggcccagagcaaaagtcagggaggagtaggatcattaccaccctgctccacgcctacctgacccagtagccctgcacccccacctttgcccactggaagtggtagcaatgttaaactttctctctccctttataagttcataatgctgcacctagaattccttcgtatgataatgaggcatcctcaataccctggcctggccaatgatgtaccctcatccccaaatccactcgccacccccaaaggtttaagtagccttcgtgccccaacactcccattaaataacctatttcattaaatctccctcccagaatctcttgtccccgtgctcactactgcccttctcacaatccactggttgtgattgctgctgatcatggcacaatgggctgggaagatatgtcaaagaaagaaaagaaaagaggatgtgtgtttcactaatatttacacaatgaaatattattttggaggtcattagtataccgaagacacattcgctgagaagtatcagtctttggttatagacttgctattcattcaggtacaaaatgatctctttaaaatgttaacctcctttactttaaactgcaagtttctacaaatccagaaaagagaaactaagtgtagcttatagagataatgggtcttaagaaagctctgaaatgtaaagactcataaatgaaagcacaatactgaatagacaagaagcaactgagtggagtatttttgggtacgttgaaacagcattaaaggagatagtggggctgggcagatggctcaataattattagcacttactattctcacagaaaatccaggtttagctccacgcacccacacggtggctcgcaattgtccattactccagtgccagcagatctgacatgatcttttgacttctataagtgctaaacatgcacttagtgttcagaacatgtacataggaaaaacactcatatatctaaataaaaataaatgaatttttaaaaaaattactctaataaaggagatattgagagtggttgggaaaggatgaagttttatcatttagaaggatattgccataaggcttgcctatgagacatttacacaaatggcaaatttaggcgttgtgtacacacatggctgaaattaaggaactactacttttggaacaaactgacttagaactgttctgtgaacaatcattttggttgaatttacctctttctctcaaaatcaactcattattagagaagaacagataaaataagctcattccattgttgatagataaaccagttagtaaattaccttgaaaatttggctcttcaactataagtttcagtgtggtattgataggttaagagtcatataaatattggctggtggtagtaaaatatttagacttaataggtattttcaaacagacatgccaaaataaatgcttatgcaagaatgtcacaaaataatatcatttgttttattacattattttcagtggttcagaatttgctaacttataaataaaaaaattagagaataaacaatattgggaagaaagtgacaaaaggcacattttatatgtcacatttaaatgctgggtattgagaaacaaagctcttatttggagaatggtatttctgaacagatagcttgcatttgtcaaaaaaaaaaaaaccagaaaggttaatatcagacataacattaagcagacctgaatgtcatttcaaacttacatttctcgaaagattaaagacagttttatccttaacaacactccagggatacagatatttttgcttcttcaagccaactttacaaaaagttatgctgattccttttgataattagttcctaatactttctaaatagcagttacagcaatgtaaatgatgttgtgaagactacctggttgtgacagcctttagcaaagatagctcacgagcaaatgacactgatgacagtgtgcagaggacaatgtgagacaagaaattccctttgggaaaagaaccactttttggtggcaattcttgcccaacagccatatacagctgctattgatttttcttcagcttccagtttatagctgtaacagtaacaacatccagagagactggaggcaggagtgccatttaccagtccactagcacagacctaggaaacatggagagtaacttgaattaaagcaatagccatagggattgtaaaacatggacacatggtatggacaatatgatggttcaaattttcaagtgatggtgactttggaatggtggaatataacaattaaaggtgggaaactcaagctgactctaaggaagtttcagtcatggggatcgaacgtgctggtgctgatgaatgaaagtgagcttacatgtgctagggtagctgtttaactgagtaagtccatcctttctgcatatattgcctctaatatggccataattataacttctgaggtgtttgcatttagtgtgtgtgtgtgtgtgtgtgtgtgtgtgtgtgtgtcaggggagggagggcagggaaatggttataatatatgagaatcataggtatcttcaaaacttaggctttatttcaggtgatagcaactaacgaaactgcccatacaagaaataaagagacccttagtaagtaagtaagtaagtaagtaagtaagtaaataagtaactccaagaaaagtatttaaggtactattacagggaacatagccaatgaaagagttacagcaaagataagcagactgatatagatcacgaatataagtcattcgtttaagtccttatgcaacacaaagacctgatttcaataccctgaacccacataaaaagccaaacatgatggtgatctcctgcagtccctgcaccagggaaaatgaaataggtaaatcattatggcttattagcctgccatcctatttccttggtgaattataaaccagatatcaaaaaccagaggaatgacacactcagttatctgctgctttacacatgcatgtgcttgtattcgtgcacatgcatacacacacacacacacacacacacacacttgcatgcatatacctgtgtacacatgcagttgaacacacacaaatatccacttagtacacgcgtgatagaagaaaaccatgatgatataatgctttggaatctaaaagaagagagaatcaaggtgagttatgatttagcatcatccatctgatgatgcacaaatattgaacaggagattggaaaaaaaggaacttagatttgacaccttggggaacagttttgcaaaaacagtgcatatgagataacaatgagttactgaggaagaagacctaggaaatatattctggggcacatactgttaatggtaggagccaccatgataaagcaaaaaatacacgtaaaaattgacatatgtttacgtattttaattctaactgtgcacagatgcttcatttggtggcatctccagttgatgctgtttacccaccatgatttaagtgcagcactcaaattctgtcaacaagcattagatgtttaatagcttagaaagcaaagaaacactcctgtattaatgccctgcattatcacaatagccaaattggactccacctatatctctgtcaatgcatgagtgaattaagaaaataaaatatatacatccaatatgatagtattcagtcttgaaagggaagaaatattgtcttttgtgacaacatgggtagattttaagagtattatgctaaagaaaatcaataaaacatagagagacaaaagaaactgtatattctaattcacaggaggaatgtaaaatgatcgaagttctgaagttggagaaaagaatattgtatatatgagaggggatgaaatgaatgaagccattataatcaaacatattagattagtttccagatcaattgaataggatcaggattattgctagtaaaaattgtgcacatttcaataatgctgtcatcaaatccactctctcagaggaaaagagaagggggtatggggacagggactctgggaggaggaaccaggatatggagcaggatttttgatgtaaaaaaaaaaaaactgcatagaaagcacatgaaggaagcaaggtacatcttattcaaaataaatgttagtactttaaacatgctgaatacataagatggtgaatatgttggctagttcaatcagtctagattgcattaaaatattaatacagatttttcccacaaaactaggacattcgcatgcacacacacaattataatgtgtaattgtataatcaaaatggaagcaacagagatgaagtcaagtaagttatccttactgagtcctttttttttggggggggggctttctttgagtctcacagcaccaggaagtactaggcaatcagatcctatcagtgttgaattggataaaatcccccagagattctatattttaacacactgattgcctcgggagaaaacagtgaaataaaaggtttcttgctggccaaggccagccatgcggccatgtcagagggaaagaaatggacattcaacttccttagtatcatcaaattctaacccatggctagtagtaaaataccccccccccccgccccccgtttcttcattatctacgttcagagaaagctttaaagaaagtatgagtttcttctatgtcaggaaatggccttaacaccgttcttaaacacacacacacacacacacacacacacacacacacacacacacacacacaagcacataaccttaaagtatattctgaaatcaataattttatgccttggaatgaggatgtaaatttagcctgttttcattaaaattttgtaattccactgacaaaaaaattgctgacattattttctctaattggtttatcatttcgatttaagcacatgcattctgtctatttaactagacgattatgattataagtacttgtaaacttacatttatagtgcttaaatgctaatgatatttgtcttttgtctgtattatattaaaatttctttaatctcaacttctgtaagaaaatacactttctgggagacttgctaaacaatgacaaagaggtaagagacagagatgaggaaaccacatgcttcattccctgaagtttaaatactgtagaaataattattttccaatagtttgatggtaaagtttattgttacataggattgatgagcacaacatatgacttaaaagggactttttaacctttaaatgaatatttagtcatttcaagtcattttggactaagatctaatataataaattgcattttattaccttgaatatgattgactacaagttggaaaaaacaacactgaaacaataaaaacatttattatcttacatgctatcatattggcacattctaaggcggtgttaatcatttttatgcctcaagtcatttatttcctgttattccagccaaagtgttcagaatatgttgtcactcatattatctacattgatagaaatgcttctggcatgacatgttcataaaacaatgtaaaaagatgcataaagcatgttttttctgactcttcaatactaaggtatatatctatatttataaattcctttatttaaagaaaccttttcacatttcactggctaaagattaggtcaaatgaatcttccttagccaatctctgggcagataataataataataataataataataataataaaaacggtagtagtaatagaaaagaaaagaaaagaaaagaaaagaaaagaaaagaaaagaaaagaaaagaaaagaaaagaaaatgtagattctatattcctttacacttctggtgtattaatactagcacttccattggaaacagtgctgtgactgagcatagaatcttttcatacaatttcattgtgatacaattgcacataataaaatttgacttttgtaatttagtaatttactagcactggtctacttataactttgtgtatccattaccacaacaattttaaattatttcatggttgccacaatagtctacacctgttagacaatcacatcccacacctgattctcactgccactgacaaatactaatatacattttgtttgtgtgtagttttctttgttggatactttatatgaaggtgaccgtataatatttggctttgatgacaggtttcttcacctcagcagaaacaggttttatttatttatttatttatttatttattcttacccgcgttcacgaccggccaggaagaacgcagcaaaccggaatcttctgcggcaaagctttattgcttacattttcaggagccagagagcaagagagcaagagagcaagagagagaaaaggaacaagaacaagaaagcaagagcaagagagagaaaaagcaagaacaagagagagagaacaagagcaagaagaagaacaagaaagcaagagagagaaaaagcaagaacaagagagagaaaaagaacaagaaagcaagagagagaaaacaagaacaagaaagcaagagaggagagagaaaaagcaagaacaagagagagagcaagaatggcaaaaccccgtcccttttaaggagaattatcctccgcctaggacgtattactccctgattggctgcagcccattggcccagttgtcatcatgagaaaggcagaacacatggcgggaaaactgcccctgcacgtgtgcagattatgtttaccacttagatcacagctgtcagcgccatcttataatggcaaatgtgagggcggctcccaacatctcccccttttcttttaataagagcaataggccacccatattaatgagagtggagatagaggtcaaatccccagtgtgcaggtaaaggagccatgtacaggattagctcttaggctcacaggcttttacccagagcaaccctgacctgctcccgtgtcgtttttcctggggagaaggacacttggacactcaaccttcttgaaaaatgacatgtctccctagaataggctcatatatgccgcagagcccttctactgcagtgcttagccgtgcaactctctcgggctgctgaagcacactcactctatcccgtgcaatgagactagcctcgtggggtgcaagagctgaatggccagcgacctattgcttaagcatagataaccatatatcaggggaagcaccatgttctagagctgcaagtgcctgggcaataaccaccttgtctctcctagtttgggccttaagcttacagaccaaccaaagaagcaacactaatccacagcaaagtgtatctccaaataatcccacccatacccattctttaaagaaggaaaatgctgaggagatccaattgggtaatcctttgatcagggacaggtccaagcgcgtggagttgacctgaatgatggcaattctcaattcccgaagggtctgttcaaattcagccgtccaattctgtaacatatactgagaaagactttttgacaaattagctgccctagtaaatttctcatactgaatggaagtaacgcacaatcccggaaacttttattcacattccagctgagttatttgccataatacatctagttgtttctggacaagatatatgcgttgattaatttctgcccatggagcatttttgggattggaggatggcggccgctaagcctgcattggtgagaggtcccccaagctcccgacaaaccctgagccagtcttgtaaacctttgttctttcttggggctatggccgctctgcattcctgcgtggcttgctcataaataagctattctaccagaggtgcggcttgctccaaatctgcaaaaatacgctctgctgcctctgtcattctggccacaaaatctgagaaggactcctgaggtccctggacgatctttgttagttgtccagtggcttcacctgctcgggagagcgccttccaggccctaatagccttttcatctgattcagaactattaagaactggctccttgagctcatctagtgatgagtataggctttttctcctagaaacctccgctgattgatcttttttcttttcttttttcttttccttccttccaatctctccccaggtattcttacctgacctaaacttttcctcaggttcaagacccgtggaaaggcctgtatacttattttgtgtaccatatttcctctttgctccaactctctttccctgctttacttctgatagattgccctgaatttcatccagaattttcagccctgccttaaccacttgataacatgtgaaaaggaacaaaaaggctcctaacactagagaaagttcaaggccaaacataccttgtaaagctatttcccactttacttctgatagactgtcttgaatttcgttagaaagttcaagaccagacttaccttgtaaagctatttcccactttacttctgatagactgtcttgaatttcgttagaaagttcaagaccagacttaccttgtaaagctatacttacgggtaccctgttccccagctgaagagttctgaattcacgcagttgaatccttctcaacagtctgttttacgggaacactttattaccaccattccccagctgaagagttctgaattcacgcagttgaatccttctcaacagtctgtgttgtgggaacactttattaccaccgttccccagctgaagagttctgaatccaggctggatccttctcaacagtctgttttacgggaacctttatgaccgtgacccgcagttctggttccggaatgagggatcttccttgcgccagtgatggttaactcccgtcccgagttttcttgtcccaggatttctcgtcccgggttttctcgtcccaggtcttctcgtcccgggtctcagcaccaactcttacccgcgttcacgaccggccaggaagaacgcagcaaaccggaatcttctgcggcaaagctttattgcttacattttcaggagccagagagcaagagagcaagagagcaagagagagaaaaggaacaagaacaagaaagcaagagcaagagagagaaaaagcaagaacaagagagagagaacaagagcaagaagaagaacaagaaagcaagagagagaaaaagcaagaacaagagagagaaaaagaacaagaaagcaagagagagaaaacaagaacaagaaagcaagagaggagagagaaaaagcaagaacaagagagagagcaagaatggcaaaaccccgtcccttttaaggagaattatcctccgcctaggacgtattactccctgattggctgcagcccattggcccagttgtcatcatgagaaaggcagaacacatggcgggaaaactgcccctgcacgtgtgcagattatgtttatcacttagaacacagctgtcagcgccatcttataatggcaaatgtgagggcggctcccaacaatttatttatttatttatttatttatttgtttgtttgtttgtttgttttttctgtcactgttgcaaacactactatttcattattttcttatgtttgaatgatattttgttttatggatgagacacattttaaaatatgtgtatcaattaatgagcaagagaattgtacccacactttgactgtcataaaaatgctagtataaacaattgtgtactgtatatttataaaatttgttttcaattatttttttggtgatatagatacttagaagtggaactccttcattattggacaactctatgattaggattttgaggcactgccaaaggcatatccagagcgtgtggatcattttccatccctataggcaatttaggtgtatcttattgcaatttcttcacatcttctaaaaaggttgttattgacttttttattatgatagtcaaattgggtatcaactactattttattattgtttcacagtctttcttgaagtgtgtgcatgcacaagtagaaaccaaatgaatcttccaaaactatgagatgatattgacaagaaagtactgggggtggctgtcaaagactaatatcacagtctgattacaaacatatacagaaagcatccttatttaaataaatttaacaacactatttcttgtattgcaacttaactgtttacctatttttaagttctcagagtttctcacttgttcactggagaaataggaatattgtgaataaatatttctagatataatcatttttaatacttaagtatgtttttaaaagtatgttattatagttatcattgtatgtatgttcacattcatataaagaaatctattaacctttaatatacaaaatggatgatataatatctgacccacatctcattagttctcagaaaactacatttttaaatctcattttatcagaagcctatgagttagtttttaattgttttcatttcatgtgtgctttgtccattgaggcacgatgatgcaatggatcccctaggactggaattacagaccattatcaactgtcatgtgagtgagagaaatttaataataaccctctgaaagtatagcaaataccagccccaggcatgagagctggttttgataaggaatcacaaaggaaaaaaaacatattttaattacaaaggacatacaccagaggtaaagccaaagccaaagttaaatttagtgtgaaatctggtagcaagatttcattgcttctttatgataaacatttggactcctatagaattttgtggatctctttgaccaattacactatactatactcatactttcttctgaacaactcaattgcctgattgttttaaaaattggcagtctcaaaatcatattatttatggaatcgtagagtgtttctttcaccatggccctaagcaatttcaacctatgaaagctcactctaatcctccttatgaatacaagcatgctgtatttatttacgattagacactgctatttctttatctaactgtttacatctccttcattttaaacacaatgtgagagttttaggctttctgaaatgctagagttgtaagtatcctcaattttgtcaatggaaggaaatgtagaactcatttaccccctcattttctaagtatacaaattgaattccagcatattccttccacttgccctgacacacatctatcacagacattggttagtacacatgtcagcaaatgtataaagtttcttggctgcctgacaccggtgaaaccatcagcatagatgaatcaagtagaaatactgcataaacttttgccatctcttggtaacctgttaaatcataataactggagatgaaatccaagaaatggcatactgccaactctgtagtctagttaaactatgaatgtggtattcagaacctgtaagctagctgaacatccaataacactgttttgagaagcctaggtattaatatttttggctacaaccctaaatccactaggtacaaacatttaaacaactatgacccatcattcctgttctaaagggctgttccttcatttctctttataaactgactgacttgatttttagttttctttcatttctatttattgcaactttgtttcattttaacacttagttacaaacaagggacattttaaatgtttcatactacctgaaggtgctgtgcacacttagggagaagaaaactcatcatccatcttacttatttgtgaactctgaaaactgtaattattagctagatatgatatgtccacggggacaatagtggcacaaatgttgtactagtaaccaaccagtttctgattccatttaaggccacatccataagatgaaacttatatctagcaccactatctgtgccaagagcctgtgtctgtacaggtcataggccctagggaagaacgtactactactactattattctaaacagggagaattaagttaatttctattaattgtcattacatcatagagtaatacatctcttaagcctcatctgagatgcttctgttcacaatagatgacaacacagacccctaaaactgcccaaggtgctgagaagaagatacactggaatgctcatccctatgtgggacaccaatatcacacttcccaaggcacagcattaagttttattccctgggattgaacttgcactttaataatacattctaaacatgataacaagtatgtctcatttatagttcagtcatctggaaataaaaaaaaaaaaatagctagttcctaccaaataggcaagtagggagaccagccattgtggaaaattattcccaggagaaacatatattatcaggtttcattaattgttttttttacataaagtacacacacacacacacacacacacacacacatccctcaaaatacctataactgtaacaaaagcatactatccgttgatagataaaaaagcaggtgtaatggataagcatgaacattgtctgaacttaaggttctcttgtgatcttttggtttcttcttacattacatagacatagaaagtcacatacctcatggtgttattcaaatgtagtactatagaaaaattgatctcacaacagctgagaaaagttggtagttactagaagacagagaatggtgagaagatgatttctgtattaagtcataattagtggatgtagggctgatgttctattgaatagtcgggagactatagatagctgtaatatactttatattttaaaaactatacaaaaagaattttcaaaagcttcacaaaacaatgaagaaatgtggagatatatatgcttacacttatttaaacaaaacagtatgtatatgtttcagaatatcacatataccacataaatttatgtataaattttattgtcatgtattacttaaaatatttactttaaataaagtaaaattataattttgagcaaattatgtcagataggtctgctttttttgcttttcacaatgttatgaagaggtagaaggcaaaaatatattacacatcaaaaacctttgtagaatttacaagaaaatttccaagcctgttggcacaatgttgtctctcagttaaacttcttttattttgttcttctacttccttttcattaattaattagtttattcattttacatcctgacaactgtagcctcttctcctcctcacagttctagcctcacaacctccctctcttcattatcccctccccttcacctcagagtaggggatcctcccatctggtaccaacccaccctggcacatcaagtcccagcaagcctaatcacacccctcccactgaggccagacaaagcagcctggctactggaaagggtcccaaaggcatacaatagaataagagacagccaccaccactccattttagggactcaggaagaccaagctgcacatctgctacaaatgagtaggaggcctagatccaggccatctgtgcactttggttggtggttcaatctctaggcacccatagacccaggtgagttgactctgtaggtgtccttcctggggtgtcctcgactcctccacctccctcagtccttaccccaactcttccacaagacagcccaaggtctgcctaatgtttggctgtgggtctctttatctatttctgtcacctgctggatgaagtgtctcagaagacagttatgctaggcttctgtctgcaagcaaagcagagtcaaggattagttatctcccatgggatgggtctaaacttggggtagttctatctttattcctgcacatcttataggcaggaaatatttttggttgaaggttttgtgggtggattgatgtctcctttcctccttggaaagtcctatctggttacaggaggtggctacttcagtctctatataggaaactcccctagccccacccaccatagattcctgggaacctctctgtccaaagacttcagtttgtccctgagatgcctcccagtcctcttctcccccccccaatactgtttccacacctgaccccaacccccaaccccagtttcccgccccaccctgtttcctaccagtttcctccttccacccaccccgatatctgttttatttccccttttgagtgagattgaaacatccttccttggaccctccttgatacctagcttcttggggtgtgtggtttgtagcatggttatcctgtactttatttatggtaatatccacttatatgtgaatacataccatgcctgcctttctgggtctgaattacctcactcaagatgatattttctaatttcatccgtgtgcctgcaaattgcatgatgtctttgatttaatggtgtttagcttacaatcctgagatccagtacactcttaattgggcctcaaaaacttttccgaacagaaaactatcctactagtttctatcacttaccctttgtcatgacttcaatgacttcagagtcttatgttaaaccccaaggttatgactccaacttaaatatgtaaatttaagggttttaatgccagtgccctttctttttagtgtagattggctccacacagtggtgtagctggaatttaataatttgataattactgtggcctattgtaaatctagttgggtagggaatcaggtaacacttcactaattgattatatttccctctttattaattacatgtttgcagctgagttgagttatggatcaagcagtaaaaacactgagatgctttttgaaaatgctgttatattttatcagtgtcttttaaaacctaatgtttagagatgacgtgagggttgaaatgcagctttagctgaagcaagaaatactccttgataatagttgacacaacatgcatgtagtgaaaatgacaatcaagtgttctattaagtgcagaaacagatgtcctgtataaaagatgtcagtgtcactgctagggaacgtgtgtgtgcattattcatctctgctcaggcacaacattccaaacctttccacggattcctactgaattactgtctccgagtttgtgctttacatttaacactcaatttgacttttcacagaagcaggatagcaaagtagcatagaaactaagggtcaaagcatagcttaatcagaaaatcctagctttgtgcagttgggtctaagagggctgcagtctgttctttgtgaatgtgaaagctctgtcgatgttggatggggttagttttactcatgcaaactgggcattaatacagcacaagttttgctgattattacactttctcaaattacccatccaaaaaatatcaaggtaggaaaaacatgacaaaaatcaactttggttgtattagtcttacctaaggaatttcagtacttaggggttttgttgtttgattggcttctttttactcaagggcattaattcggttcccatgtatatgagcaaaagacttttctgtaagagctgaactagtatagaaagatttttaattaatacagtaagtgattctggaaattgctttccaatagaatcacctcatccccgccccctctaccagtcatctacaccaagggcattgtaatggtacaggatcaaggaactaaaggggccttctttcacttcctcttgttcaaagagaacacttggtggcagtcctctttaagaaccagctcttcttgattaagctctttcttgggggaaaaacaaaagacttccctggtggttctcaagagctcctaacaaattcctttctccttgaaacagcaaggagctatcactaagacaattgctccagtgcagaaacaagagccaggggatagtagatattttttttttcccctggaggcacaacttgcttagggaggagctttatctttgggctttaaagacactactcctttgcactacccttcatttaattgtttgttttccattccttttctctctgctgtttagccactgtctcagacagtctgatttggattaagcttgtcatgctgcccttgtgactgaataatatatatatttttaaatgctgagggtattttgcaatgccttctctttacaacaaaaccatttgtgtaaactattcaggccaatctgtttttgggtcttttggttttgtatgtttagggtagttgcttttcccttatgtgtttttcttatgggaaagtattatttacttctctccccgttgtaattaaatattagataagaaccaacatgtaggaagaaggaataattccaatgcacagtttcatggcaaataaattatggtggctgggatctgacctgagtttgggtatttgagactcttcagaccttgacagcagaaatgcgagtgggggacataatacacaatgggttagagggagggaaggagggagggagggagggagagagagaaagaaggagagagtgagagagaaagcaactttgaacaaagagattgccttgccctttaattaatatactcttcttccatgggacatgagtggcattgcatatgtgtgacttttcccttttaatttcaccagtagtggtcatctctttccttttaaacctataggcactctaacctgttcctctgaccattcacacgttgcaatcctcacatcctctcaaagagtagataaatacatacagtgattttattgtaatgtgttccaggaaaacccctcaaaataaaactaaagtcaacttataggcaaaaccatcttttaatattttaaaagtgcttaacagaagctctaagatgcttgggcatgacatccaagatgacattctttatagttattgtcagttcagattgctctaagattttagtagattcacttagggcagagttcttccacctcagcaatattgtcatttggggcaagatacgttttgctgtggaggggctgcacttcgcattatagaacattaaccaccatctctggcctgaaactactgcgtggtagtcatgtcccttttctgaacttgtgatagtcaaaactttttccagtgctgccaaaaaaaaaaaaaaaaaaaaatgaagatgagaggcccaaactgatctccactttgacatattgactttgaattcctgtgatttggtttctaactaaaaagatccaattgcatctcaatataaattatacaagcaatttttcaatacttctagatattctatttgtactattctcgtgatccttaatatcattcatatacaaggattttttaaattagttaattaacttattcattcactttacatcccactcactgcaactcctcccagccccccataccctttgtaccccctccccttctcctctgagagaatggaaattccccctggatattcccttaccctggcacatcaagtccttgcagacctagacactagccaagttaagggaatggattccacagaccatcaacagctttaggggtagtccccactccagttatttaggacccacatgaagaccaagctgcatatctcttacatatgagggggaggcataggtccagcctgtgtttgttctttgcttggtggttcagtctctgagagccccgaaaggattcaggttagttggctctgttggtcttcctgtggagttcctaacctcttcaggcccttgatccttctcccaactcttccatgagtcccaaagctccatccactgtttgtgtgtgggtctctgcatctatctaagtcagctgctgggtggagtctctgagaggacagacatggtgggcttctgttttatactgaattctttaaaaaaaatacctgaattcttaaaaagaatgtcacctattttccatgattatgaactaagtagtcaggaatctataacatccttaaccaaccaaactcctttcattcctattatctcttacaagatagtaacttcctgaatatcatcaatgctttctcagtactttcttatgtatatgtttctactattatgctaaacagcaattttaaagcagggctgctgaactattttgtctacattcactgctttgtaactttaatagaaagactgaaaaaagccatttattttaatattttgggtatttttcttaaaatttttaatctagccctgctgttaaatatatgatgtttatgtgtttgtttatttatttatttatttatttatttattcagtctactctttcagcatagcttctgcagtgaacttgagatgaagcacacactttaaaacttatagatccactgaaatgttgattcccttagcctttccagcaatagtacacagatgcattttatatttaaatatattttgatttctttttataaacatcattgtaccattttagcagtaaatattgagcatgaactaggtacattttctgctgagaagtgctaaaaacctttaactagaaaacagtagtaattgtcaaacattgaaccacgagcttaatgaagcaatttctcttaggaaaactttcatcacacagacattttatccttgttcaaatttggccagaagctatgtatggctaaaatctcttatgatgccatatggagcttttttttcactattttatgaataaaatgggtgtgttttagtgtgctactagcttcaaacttagtttatctcatctacatatatatttgaagtcaaagcttaagtttcatttcaggtcaggggctcattaggcaaggtacttttctttgggaaaagtgaccattggtaagttgttcatgactctatacatatgctcacatgggagcactaactgaactcagtgggttatttaaaaagaaaaagatggaggccatgaagttgctagagatgtggaagataatttaccagggagagatgaagtgatagaagtcaggaggatggatattcaaggtgtattgtaaacatttataaaattaaaaattagaacaaaacatataaatagtgtgtgatcacttgctttaaggaagtaaatgagagttctctccaataagatgctaacatcctgtcatcttgtcagtctgtgcctactacccaaggccagttgtcttacaagagactacgtgaaattagcataagcttgtcaaagatcatacagtggtgtgacacatttagagttatgttagccaccagattttcttcttaactatttttgccacaatatgctgctctcagtgagttttagctaagagttcattgttatcatctatataatagctatttaagacaataactcatactaatatcattcattcttacttctgaacaacatagtcggcatgtattaagtatgaaattaccctttacagctaaccaccattttaaatattccactagccttccttgctttcctcattccctttcttctttccatccttttgtcctttcttgaattatttgtttgatcctcatgtacaattttgcccttcagtcttgattagattttgaaatccctgtgtaggtactacaaacacagatttcttgctaacacaatggtctaattaaaataaaaataatgttggatgtgttggaccatcagatagaggttgtaatttaactgtatttacctcttgtatacttgcatctcaattaacagtaattgagcaagtggaaaatgaagaacaggactagtgaggtagttcatgttgagaggaggtcatgagcctgaggagaaaacttattctgctaaaggaacatttgcaatagaatgactcctaaggatacatactgctagtcctatagatcaaagcatcactcagctctcaccagtgagtctactttatccagtagataggaattaaaagagacctacaactggttgatgtgcagagagtgaacacttttggaacactcaagcaggcctaagtaggacggatgtctttatcagactccttacctcaaggtacagggatctatgcagaagagccagaggtgataaactccagtgacataatcttgtcctagcacaatagggtggtgcatacatgagctcatagagactgtgtcagcaggtacaaatcctagacaagttcaaaacatacaaaattccatcactgagaagggcaagtgagtacaaagtcccatcataaccaagaagcaatttataattaatacccgtggggaaagggaaatttagttttctacaatggagtgccactggctatattacacacagttcgggtagcccacatgcttaggagtacttggccaacacaaaactgactccgtgtgtgtgtgtgtgtgtgtgtgtgtgtgtgtgtgtgatacttttcatgttgttttggtttggttttgtataattttgtcttgatttgttgtgtttgttgtatttgttttgattttcattctgagacactgatagaaaacaatgtgaagttgggtgggtaaggacgtagggagactataaaaggagtagacagttaggagagtataataaaaagcatattatataaaaataagaaaaagaaagaaaattactatagaatatcaggcattttggaccttgcaacttgcatcaggacaaacatcagagttagagacatagacttaggggtaattattatagattaaataatggaaaatatggacccaagtaaaataacaggattagagtatatattctgaaagcagaacagaaacatggcatatatcaaggggaaagacatactttatagaattggcagaaaatcagaagcaggcaagaagtagtaattgtactagggaaagatcaaaatataatggtagtgagggagtaaaagaataactagaaatggaaataaagagacaagaaataaattaaaggagaaagtaatatgggtagaagaattaaacaatttaggaataataagaaagattaggtaaagtgtgtgccttagatggaagagcaaacatggtggtggcacatctatagtgtcagtactccacaggtgaagttaagagaatcagaaggtcaaaatctcatatgtattctgctatagagtaaggacaatgccagcctgggttctacgagatacccagggtcaataaagaaccgcatggtagtggtggggggagtggaggagaaggaggaagaggaagaggaaggaaaaaaagatattgaatgatgaaagaggaaggggaagaagtagaagagagactgatataaatgagtcaaaagagaagaaaagggagtgagtgagggagagatggaaggaggaaggtagggagagaaggagggagggtggaaggaaaggagagaaggagggaggagggagagagagagagagaaagagagatttctatctttatattttctcatcttctataagtttttacagctgcactcacagtcacatgcttcacaggagtttaaagattcttttcatgtgttactcaacattacattttagttttaaaaattagttgagccataaaagattttctatttaaatccacaggactctaatctcataattagactctaaaatatacttcttcactcccaatgaatctgaaatcccatcttaacgggatcatcaattgtatccctacttctgagttcattgtccacttcttcctgacttcccttctgttccttcctgatccttaccagtagacctgggtctgcttttccccttgggatatctaggcaccctagtatatgggactggactggaaacaatggagcttagccaggttggtgtatgagacaggatgtcttttgtcctcagtgagggtgaaatagccttctccggaaataatttttcatgaaacaactttttattagagggaaaaggggctatataaaccttggagagcggagagggttttgggggtgagtatatattgttggctggagttgaggtgctgaggtcctggaaatacttcatttgcatgtagagaaattccaggtggtaactggatcttataaagagagggagtttaacttgaaatctgcccaacagactgtgtgactacctcaagagtggtggaggtgggagtcttaaggtttatgtgtgccaatttatgcaggcccttttcaaagtcctactcctgctgctcccaggatgagaatttgggggtttggacatgtcttgacctcactctttccctggttatggggctttctgaccttgaactcagaagtgctcatgagttccttatgtactttactatatatatttgacctatcaattctgcttactttttccccacaatttgtttcttctattaagaagcagctggaaaaaaaggaaaatcatttctcctggctgttgactcccaacgcacatgcattatatatcacacatttggatctcaaactcctatcactgaaatgtattttaatataaactgggagtataatacacattttattcatttgatttatttaatacactacaaatagagaaaatgtggacaagtctgtgttaagtaaaaagtgaaagactggacctgtgaaacattcctctcgtttatttggtgctattgtaagatccattataagtaggcacagaattgaaggtgatttagtaatatgcaagtaatggttagtattcaaacacagtcagctgggtatggtgtgtcacaccaataatgtgaaatgtttggtgagacataataagaaaaatgatgtttattcacccccaggtatggtagtaatgacagaacaaaagaatgactctactcagcttgtgaaagtctagttattttttttttttgtcaacttgacacaagctagaattatctgagaagagggaaccatattgaaaaaaaaaatgcctccatgagactgacctgtaggaaactatgggggaaaaatttatattgattgatgtgtgaggactctgctccccattgatggtgccacccctagggaggtggtcttgggacatctataacagcaggctgaggaagccatgtgaaccaagtcagtaagctgagttcctccatgatctctgcttcagttcctgccttgagttcctccccgataaagtgtgacctgagagtcgtttcatgaaataaatactttcatccccaagctggttttgctaatggggttttatcacagcaatagaaaccctaagttagtaaagcaataagtgagtttactgggtttactttacaggaatatgggtgactgaaaaacatatccaactttgaggcttcttgattcattaaagttgtatttctgtagctccttgcacagactgcaggtgataccaaggagataccctcttcccatgatttgtttactacatatataataacaagaagatgggacttagaagttttgaaactttctgagcatctcagtctcttaaagttttcttactccttgagatttattatcctccttccatcctccagaaaggattaagttcaaagaaaagaactacaaaagatcccaacactttgaaaggtgatacaggaagactggccctagttcaatgacagccatgattacatagtgaaatccagaccagcctggactagaaagtttcagaacaaacacaacaatatgtaacggtggtcaactgtgacctgtttgtgtatattataattattggggaacaaaacaaagccatgagcaagggacagctgacttgataaccataagttatttaacattttaatgtcttaatgatatgtcatcatgacatctaatgtaaattagatccatgttacttaagacatatttttctttgtttttattaagtatatatatattcatatgcacattttatttatttttatatttaaacaactttttattagatatttttttcatttacaattcaaatgctatcccaaatgtcccttatgtcttcccctcgccctgctccccaacccacccactcccacttcttggccctggcattcccctgtattggggcatagaatctttgcaagaccaagggcctctcctccctttgaaataaaatctcatcatttcatccctccaaaccctattcttcctttcaaatcttcccatgtttccctctcaaattgaaggcctttttttattattgttttatatacacaaatacatgcacaaaatatttatgcatgcaatatatatatgcatacatgcacaaatatataaatacaatccactaagtctaattttgttgttttgtgtgtaagaccaagcactttttattggataaacaatatgagggcccatctttgagaggggctaattctatctctctgctctccttagtttcacgttctttgtcaaggggcagaattgatgaaatttttctccctccacattttcatgtttggtaatattgtcattgttcaggtcttcttaagcagcatttctagaagacagtctcatagctagctagcatcctggtcttccagaacttatggactttctgcctcctcttctgtgatataagctttaggtgtagaagtgatattgaagatatattagttgtggctgaactcataatgttttgctaaacactgcattgtgtatagttgtatttttccgtagttgtctttatttttctgtaaaaaaaagaagtgtctttgatgagggatggctgctacacttctctgtagatataagaataacttttagatgtagttaaaattatgctggtcaagtaaagtggcagtagtaagttctctacgatccatgaactcattggcctgaggtaattgactttctaataccagacatgatttccctttagttggcctttagtccaactaaatatctattggtttcgatgaaataatatcactattgaacttttaaggatatcttgccatgctgaatcttgttccagttcattggcatcatatcttggtcaaaatatatatatatatatcttccctctcttggtagcttgtgttaggccatgcccattgtgatattattggagtaagactaagcaaaagatgggtttcctgtaacccatcttttgcttagtcttactctaataatggctaagatcaaaaattcaagtgacagcagatgctggcgaggatgtggagaaagaggaacactcctccattgttggtgggattgcaagcttgtacaaccatcctgtaaatcagtctggtggtgccttagtcagggtttctattcctgcactaacatcatgaccaagaagcaagttggggaagaaagggtttatttggcttacatttccacactgctgttcatcatcaaggaagtcaggactggaactcaagcaggtcagaaagcaggagctgatgcagaggccttgctgttcatcatcaaggaagtcaggactggaactcaagcaggtcaggaagcaggagctgatgcagaggccttggagggatgttctttactggcttgcttcccctggcttgctcagcctgctctcttatagaaccaagactaccaaaccagagatggtcccacccacaaggggcctttcccccttgatcactaattgagaaaatgccttacagttggatctcatggaggcatttcctcaactgaagctcctttttctgtgataactccagctgtgtcaagttgacacaaaactagccagtacaattgaccccttgtcaacatgacatacaaacacatcactagtaagcctcaacccttagtttcttattcatccccaagatctaaacaactttaaaagtcccacagtctttacatattaaaagtcaatccctttaaaatgtccaatatcttttaaagtctaaagcctttttacaattaaaagtctcttaactgtgggatccactaaaatatttccttccttcaagagggaaaatatcagggcaaagtcacaatcaaaagcaaaaatcaatctccaaccatccaatgtctgggatccaactcacgatcttctgggctcctcgaagggcttgggccacttctcctgctatgccctttgtagcacacatgtcatcctctaggctccagatgcctgtactccactgctgctgctcttggtggtcatctcatagtactggtatctccaaaacactgcatgaccccttcggtcctaggctgtcaattgcaactgaggcttcaccttcaccaatggccttccatggcctctcacagtaccgagcctcagctgctctgtgtgaccccttcatgccttcaaaaccagtaccacctgggtgacccttacacattaccaagtcccactgcagcagaagtacaacctttgctatctctggaacacagcctctttgtgctttcagaaaacacttcccagaagatgtcacctcaacaatgctggtctcttcttaatcaccgctaatttcttagctccagctaaccagcttcaatggtcccagtattgcaaagattttgctttagtagttctggtatcttgttaatcacagctgattcttcagccccagctaaccagaaccacagaataatcaaactccaaaatagcaatggccctgaaaaaagtctttaattttccctctgaaatttcacaagccaggccttcatcttttgcactgttctcaacattatcttccaagctcctacacaacatctgacagagctcttaacactgagtggatcttctagcccaaagttccaaagtccttccacagtcctccccaaaacatggtcaggttgtcacagaaatacctcacttctggtaccaatttgccttagtcagggtttctattcctgcactaacatcatgaccaagaagcaaattggggaggaaagggtttatttggcttgcatttccatactgctgttcatcatcaaggaagtcaggactggaactcaagcaggtcagaaagcaggaactgatgcagaggtcttggagggatgttctttactggcttgcttcccctggcttgctcagcctgctctcttacagaaccaagactaccagcccaaagatagtcccacccacaaggggcctttcccccttgatcactaattgagaaaatgccttacagttggatctcatggaggcatttcctcaactgaagctcctttttctgtgataactccagctgtgtcaagttgacacaaaactagccagtacaggcagttcctcagaaaattggacatagtactaccagaggatccctcaatacctctcctgggcatatatccagaagatgttccaactggtaagaaggacacatgctccactatgttcatagcagccttatttataatagccagaagatggaaagaacccagatgcctctcaacagagaaatggatacagaaaatgtggtacatttacacaatggagtactactcagctattaaaaagaaagaatttatgaaattcctaggcaaatggatggacctggagggcatcatcctgagtgagttaacacaatcacaaaagaactcacatgatatgtactcactgatatgtgtatattagcccagaaacttaaaatacccaagatataagatacaatttgctaaacacatgaaactcaagaagaatgaaaatcaaagtgtggacactttgccccttcttagaattgggaacaaaacacccatgaaaggagttacagagacaaagtttggagctgagatgaaaggatggaccatctagagactgccatacctggggatccatcccataattagcctccaaacactgacaccattgcatacactagcaagattttgctgaaaggaccctgatatagctgtctcttgtgagattatgctggggcctagcaaacacagaagtggatgctcacagtcagctattggatggatcacagggcccccaatggaggagctagagaaagtaaccaagtagctaaagggatctgcaaccctataggtggatcaacattatgaactaaccagtaccccccttgagatcgtctctagctgcatatgtagcagaagatagcctagtaggcctcagtggaaagagaggcttattggtcttgcaaactttatatgcctcagtacaggggaacaccagggccaagaagcaggagtgggtgggtaggggagtggggggagggacgggggacttttgggatagcattggaaatgtaaatgaagaaaatacctaattaaaattaaaaagactaagcaaaagaggctttcaggtccataataataataaaattaagaataaaattaaaataataataaaaattaataatagcttgaatcttatgcctaaaatatgtgatacatggaggcttcagcaataaagacataccctcaaccaagggcaacagcagtaacctataatatttaggagtcacatagtctgtcctcaccaacaacttggaaggcagtgtctgatgcttggtgctgaggtgtttgttaagtaatcaggtgctattgtgactagcactttctcaagtcattttaggtaaagctaaaacaatactattcacttatgctttgttaaataacgtaggtgtacttctcagtctgtattgaccttccttcttcctccccagttatattccctctcccattttctcctcaatattgcccatatcctgctatctccctccagagcctcccattcattgccctttatacttgcatggtttctcttgttactccctgttctacaattacatctgaaaatttaggtttatgaaccacagatgaaagagaacatgagactttttttttctctgcatttggattgtctcactcagtatgactctttctagttccacccatttacctgtagattatttttctttacagatatatagtattggttgggtatatgtatcacattttcattatgtattcatctattaaaggacatttagagtgttcccatttactagcttttttgactaggtcagctataaacatgggtcagcaagtatctggggagtatgatgttgaattctttgggcatgggccaagtagtagaatagataaactatatggtagatttatttatttttctctttttgaaagttctccctactgatttctatagtggctgcatcagcttgcagtcccacccacagtaaatgagggcttccttttcctcacatccatttcagcatttgttgttagatgttttgttatacattgccatttttgcctagggtataaagaaatcacaaagttactttgatgtgcatttttctaattgctaggaacaatgagcatcttttgcgatggtgtttcttagtcattttcttttcttttcaaggtcttgggcccatttttaatagggatgctaattttattgacattttgggttttagtgctttatgcattataagtattaaccctttgttagatatacagctgccgagattctttcctactctgtgggtttgacttgtcaattgttcttaattcctgggcaatcaaagcaatcctagtcaggaagaccttttctacctttatcttgtggggtagtactcatgttttcttatagcagttttaacctttgagctttcaaattgaagtattttttctacttggagttaagttttgtacaggaagagagttatatgtttaatgtcattcttctgcatgtggatagtcacttttctcagcaccatgtgttttagttatatttctttattgaataagaaatatactgccaaaatatagcaaactgatggatatacttgagatagcatgttgacttattgacaagagtcttctattacatcatttcaaccaatacacatgacacaagagacttatttctcattgtgtgactttttttttgggggggggactcatgaaaaagcatccattgtcttcagatggggcatttaagcagaccaaagaaacagccctattcaagtctagattgactttacttcttttttttgatggaattatattttaattttaaaagaatttttaagtacagtcatatacgtcaaatctaggaatacattatattttgctataacattgtgcacatgttcttttatcttttaaaacaacagaaaaaagaaaaaaaaagaaaaaaaaagaaaaaaaagaaaaaaaagtagatatgctcaagtacaaagcacaaggcaaattataatccctcagataaacacaattacagctagaaaaaaatattaaataatggacaaataccttaagctacattagaactttctcttcatagtaaaagaacttttgaaatttcaattaaaatataaaaatgtaatatctctttatagtatttttaaatacatttaaaattagtgcacattaatcttcaagtattttcatattagaaggcaagaagactgtataaatctatgattatcatttacattaaaagaacttagcaaatggtttaaaagttaaaacgcactaggattgcacaccaaagcaatacattccttattggtgtgtttgacagccaataaacattcatggtgtgtatattttgtattcagattttgttataaatttggctttatttctttgtttttaggcataataaatcataatttagaagaaatgtttattttcaggttgatatgaaaatgtgtgcctattgactttacttctttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtttgactttacttcttaaggaggattacttatggcagcaagagtatgttttattcacaggtttacatgtatgtctgatgcctgccttggtatgtagctaatacacacagtgatactacattggagaaaagtgattttttttcctaactggtatcaatagtaaatagcttcttggttaggggtgggactttgctatttcctcctctcagtatcagctggaaattgtttgataaacatgaaggggaatcttgcaagtttgtgagcttcctcagtctttgtctttctcttttcctttctccaggatgaaacattattttttgtatattacattttatatttgaaaccaaaatacaattagattataatataaaggtatcatttcctcttcccttttctcactcccaagcctagaacatatccttcttgttctccctcaaaatcatggcctcttatttctagcattgttacatacagcaaaagctatagtccatctaacaaaattacactcctgtgtctgggaaacattctgtggcattcttggtcaagaaagaagtttcaatcgagaacaaacaggtatagaataaaaacatctcctttgtgcagtaacattttctattgctttattcaacatgagtgggactaaccttgtgtttgtatataatttgcatataagtaaaatttgtggataatttatttcaattagtagctaatatctgaatataaaagttctctttataaggtcataatggtttgattaactatcatcatttcctggattaatatgattttcatgattaaaaaagttagaaaatcagttgtgctattaaatgtgtcctcggctagtcaagccaacctcagtcaaacctatttaaagttccaaaaagctactttttcttattatgttttccacttgatttccctaagttgaagtgaaggggatgaataattttaatttatcatttttgcattcaaatataaaaagtcattgggtgctagttgaaaatttatgaagtgacagtcttgttaataaagataaatgagaaggcttgttttattaatattaatgttgcacataatatagctttctaagtaaatataggcttacattttgcaaactttgcaaattatgtatctatagcaataacagagctaaaacccaagttgtatctttcgggtttcattttatttgtaggaagtctttaaacagagaaaagcaaggatgcatttgaaatatatgtgagatgtttactaacagtatttctgatttctggtattttcactgatatcttatcatacttgtaagagtgagaactaatgaatggtatttgagtagctgaaacgtgtctggtttaatacaagtcaatccagttattatgagttccaaaagagtgttactttgggagagttacagtaaaattcttgctgtcatgagaaagaaaggcgaccttcctttttgtgggagaaagtatttaaattgacagaggtaataaaaatgagaaaaaggaaggacttggacaccccatcactcgttacttcttccttccttccttccttccttccttccttccttccttccttccttcctttctttctttctttctttctttctttctttctttctttctttctttctttctttctttctttctttctttctttctttcttccagagcctctactatgtaccaaaccttgtcttgtataaataagaaagatgagaaaaataaatagtcatcccccacacatattcagccctttacttctcaagtacagaagcttctgtagtcctatagtattctcttatttgttggaagtatgctggacatttctagtctctgtgttaacttaataaggtgattaatatgttgggatagagaaaaggggttagtgttatagttgggtagggctggtaaagatgtcagtcattctctcctttatctctcatcacttgaatagtgtttgactttctggatcaaggtcatcacactcattatagtattttccaggtccatccatttatctgaacaaaattgtgcctgtgtgtgcgttcataccaattcaccacttcatgatcttgtcaatcaccatatatgtaggtatctctgtggtaatatgtttattccttggtatataatagtagtatagctgggtcataaggtagttctaagtttagctttctaataacttttgtactgagctccaaattgctgtgtaaactggtacaggcatgtttttcagggaaagatggcatgggatttcaatatacaaattatttagaaaatggagtttactcgtttagaaagaattgatgttcagtctgtcatctgatgtaccttctgtttgacctcttcttcacagcatttcacagccctttgtgaacttctgtaatttcctagggatatgagtaataagaactaaaaccactgtggtgcttttatgatcttaatatctgttcactgatcatggcttatatttcattttacatttccaaactgtgatgttaattatttcgcaaaaaatgttaatttgaatagaaatcagcttatcttcagatattacatatgcataaaataaatgtaatgctaaggaatttgaaaggtaatttctatgtcatacccatctaactcctatgtttactagagaaaattagtatttgataagctgatatgatttgtcaggagatcagttgaaccactctagtctttttatttttttcttcataaaaggtctcaagatggaccatgaaagtaaaagttctgttttatatataatgcaaatttcacacactagtggagataaagaaattagtgtcccaagctaggaaacaggatatggattattagtcataattcagttgttctcagtgcatattttcattctcccagttttctactctctttttaataatttattttgcataggcagagatatattaaaaggaaatcaatcacaaggtagttctgagaaatatttgtaaagatatatttgttaatacatataatattatgactggggttttctgtctaattctctgagtcctgagacttctcagagttttacctttgccatctgtatatcgccatgtttgttcatcttcgtctgatttatttgcagtatactttaaatacccccttttcacccatcttctcccattctcctctctcttcttctttccctggtctctctattgtcatctccacagggatcagagccttcccatacttgagtcagttaggctataatgaataacaattcagttaagataggaaactaccaagttattaaaagaatatagagacacctcacaagatgccaatgcaggatgtaagtgtcatggcaggaagtgaggtggctttttccaagtctgggaatacatagcttttcatgtctgctgctctctcatggcttttctctgcacatctgctccaacttcctctcatttttttcttattacatctttatttcagtttgaatcccttctatgtgaatgtccaagtcctaaatctaaaggaactttcagacctagtaccggaacagacacatccagtatcttttctcttacactggacatttacaaatacatttatgtggactctccatccttttacacaaattacattttagaacaaaaagtcctctgaagttataaagatttataaaattaaaaacaaaacaaaacaaaacaaaacacaaccactaacaacataaaaccaaaacagactgttctactcaaaacttgtaagaaacatgtttagttcaaacatgcttgggtgtcatcccagtctgtggcaaacatcttcagaaacgttcacatagaaataagcaggattttgtccttcggcaattgctttaaaataagcttgatccttacttggaacatatatttgagttgaaatcaacatcatgaattgtctttcctgtgaagcacagttgtttgagatatgggtcagaaagaaagatattgcccaccatgcttgatggtgctatcttattcaaataactgaaattatgtttctgtgggaatgatgttctaaatattctatactcagaactaaagaatctataatgctgctgtgggtatagtagtaataatctgtgttgtaactctaaaaggttcaggactatgtttatgtcattgaccatttgtctaacacagtgcctatcacatgaaagatctcaatatatatttgagagatgaatgagataggaacagtagagcactattatctgtgatttttaagaaaaacacttatgctatgtttttaatcctgctaaaacatgtaagaaacctagtatagtgatttctgtgtaaatttggttaatttaaggaaagttcatggagaaaacaataaggagcatgagtaaaacacacaatacaaaaaaccctcacacaggcatttgaaaagaatcgttaccaatgttcaacatagttaaagtatccttgtcattagcatacaatataatcattttcacatattgaacatatgcaagcatacctgcttctggttagtgtcatttcgcaattaattgttatcctgtcttctaactatcattagatttgcccatttttcttttatattagtggagccatgtagtctcttcttttctaactctatgactttgagagtcaaccactggtcactatggttacatgtactacctttaattcttttaaaaatgaacaaataaggtacaaaagaaaatgaggggacatgatagtggtaaacagaacttcaatgatcatatgtagtgaaaattaaagatttattgaagtgacacatgttctattcaatttaatgtgccttctgtgtcttctccatcactgcttctcaaattctaatgatgcaacttacaaatatttgtccctaggaaaattacttactgaaccatacataatgtatctcttctactgaggaaaaaaaattttgaacctgtgttctctccctgagatgtgtcagtaggtgctatttctttttaccagaggcagtgtttaattattgattctccatgcatatgtcctgaaagtgtttattaaactgaggttagggacatagttctttccacctcaatgcatgaagttatgagacgacctaccaggaaggggtaatgaaaaaagtgattaagtttctagactgttacatagaattaggtaaaaaaaaaatagtagagtatgcatgatttaaaattggcaagggcaggcattcagtatgaagaaatctttttaagttattaatcatatttttatgacagcaaaagtgaaaggctttaattaaatacatcttactaatgctcccttaaaaaatcctttctaaaataaatgtggtatcaaataatctatggaaggtgtgaggttgattttctatatccctgcatagtaagacagcccttgctgacaaagaaggttgccaggcacttacacagattactaaagaagactggggaatcaatgaccatctgttcaacatggttctcatacaagtgtatgtggagccagaaggctagatgacatgaacttttagaaggaaaaatattttttccctgtttatttaacaattatcacatttgtgtgaaacagaaattcaaataaaatgcttaaaacaagaaataaaatgaagggtttcttttcttgaagtaatttgttggtctctttctaaagcatttcagaattgatgctgaaaagcacttggagatgaaaaccatcctttatttcactgcttctctttctagcaccacacgttgcaagaaaataaaatgcacactacattgttgcttggataaagagctattatttactgttgttcattttcaaatgtttttattgcttttcaaagtggtcaagatgacacttttaaaacccacaattttgtttgacctgaatattgaaccactctagacactacttgaaaggtctctgtaggccattgtggctccatacaaaataataatcaataacacttagacaatgtactgggtgcatactaggtgccaggaactgctaggcaatttatatatgttatcacatttaattctctcaataccctgcaaaacagatatcgctatcatttgcagtagtaaatgagagagccttgattaaaacaagtatgtagtccttactcctaacactaattcttccaagcactgatttatgaacttaggcctgttaccattactattctgcaccatattttccaaagttttgagaaccttatctcaattctaataggactttgaaacttgcatgtctttagatagtgatacatttctgtcttgttctggttggtcaattttgacatggtggataatttaggatttagaaatacttagacctagacttggaccttaccttcgcaacttgacagctgtgtaaccaagctaattcaccaaccctctctgaatttcagatttgtacttgtccaaacttttattgctgtgataaatacttaagaggaacaatttgaatgagaagagttttatggttctcagttttggaggtttcaacctctggttggatacttccattgtttctgagcctgcagtgaaacagaacatcagaaaagaagtgaatgcagtataaatattagttccctatgatggttaggaattatagaggaagaggagggaactaagaacaaaattcagattccaagaatatgcttccggtgactcactgcctcatgaactgtttaacacaaacatagtaatatcaaaatagtaatatcagttgcgtaccaagtcatcaacacatgagcacttagggatataatagtgaagtccctattctatgaagtcaattgaataaaaaagctagatttagaggtgatgtaaagataaaggagatcaaataactgaaaacatatattaaagagctggagatagcttcatgagttaaaagtacttgtagatttttcagaggacccaagtttgattcccagtatccacacagttgcttgtaaccatttataactccagttccaagtgatccatcaccctcaactggccccaatgtatactgcatgtatatggtatatagacatacatgtaaataaaatacacatacacaaaaaaatttaaaaggataaaaaatatcaaaatgacaatgtgtggtagacattcaagaaaaagtaacagcactattaatgttttttttttcaaatttgtaagatcttggcaatgcctctcctcacaaagaaactaacagtattatttctatccattcagatgttagatttggtgattggatataggttatcattacaaaataatcttgattcttgtatatggatatttttagcagcctgtcctttcctccataataagtaaacaatatatgggtatgcattaattttaggaaacttctatatgtaatttccttatgactttgaagaaacccttaagtattatttacccctctccatattctctccatcaatccccagattttctagccgactcctgaatttaacccgttttcttccattattttccttcaacccttatgaagttaccttaaaataggatgataatgctcttactagacagtataggctaacaaaagtctcagtgtcaggaatggcacggcttaccacttttggagttgtgggctagttgggtttaatagaccctcaaatattgagggctattgccagtgttcttgtttgccagccagaccttgacagtaagaccctcttgctgaagacactacattattgaatcactgaacacagatatatcaagctagtagtgacctgaaaatttcattcttactggaaacctttcaaggctttggaagacgccatatttactgctaatggaaaagtgaaacaattggtttttcgacctctggaccctgcacactgcaaaaatgactggcctggttatacatgagatttgatacaatactagcaggaacatcatggaattcatcattatttcctggctggatttaagtccctctccacaaaataaaacacacacacatactctctctctcactctctctctctctctctctctctctctctctctctcacacacacacacacacacacacacacacacacacacacatatcctcattgttgtagttatatttttgttactgttacgcgacaccattaacaagacagcttataaaagaagccatttcatagggtgagttgatgaccatcatgataaggagcatagaagccatggcactgagacaacagctgggagcttatatgttgaaataacaaccaccaggcaaagaaagtacaaactagaatggtgtgggcttttgaaacatcaattccacccccagttctcatccctactccaacaataacccatctactccaacaataccatagttcctaatcctcgccaaagttttttactgctgtggatctattcaaacatataagcgtctgcgggtcattttccttgcatcagaaatgcattctgtgtaccattatatgttgggaaagtaactatagcacaggtcataggcactagaagagaacctgctactatcattctgcaaaatgaatatatcaaaataataaataaaataaaaataagtaaaagaataaataatggcttggatatcattgcagaagagggcacagaaacagtgtaagagtcaaaggcagtagatgacatcattaatatctattacattgcttctaacttgaaatcatatttttgcttagtaattattgcttaccatcacaggtagacctcctattagtgcaaattagaacttacacaagcatatgctttatatattttttatgtcaataaaagtgatgcatatttagaagtgggggaatattattagccacacatttggtaaacatcattcgacagtcattctgtttatctgaaactctacatataaccaatgagatttataatgaagaatttaacttttaagctttctataaaattatttcaatctttgtcacacaatatttgagagctaatattatagaatatgcttcatgaatttatgttagaaatagttacattcccagagagattgcagataatgtatatatcatggttttcttttattttagctgtgagattagcgtttgttgggaaattgtggttagagtgaacatcagtaacttttaatgatttttaaaaatgtattttaatctagtattcatggactagtcacatgcaactttttcctctgatgtttagaaataatcctattttatgtgaatttagagaaaggaatttaaagacagtacatgttaataaggttcctttaacaattttctaatcatctgtgctttcttctgtttatggccctgtcagttttttcttttcctatctaatttcgtctacctgttcttaaagagattgccttgttagtaaaaaatgactcatttctactagtggcaagatagccttttcatccaccactatgagctagcaataatctgctaagctttcgtaaatttcactgtgaaagaacttaatttgtttccattatgagaacttttgagcactttaagttattacaactaaaaggaacataactacatctgtgctagaccgagagaattagagagattttctgccatctgagtgcccacagttacaaagagtaaataccacaatatatggattgttgcaaatgttaggatggtgcaagatcctacactggcgttagcatctgaatatcatgtgaaaatagcatacctgtttcacacaaggacatttttactgtaactaagaacatattgtatgtccaggagtaaagcagaatctaggttatggcatatacagtgtggaactgaatctagaagatcaatgactaaaagaggatccatgtcaaagtggtatccaagcatacaagaaaattggtcagaattcatagtaagcaaggggaattggtagagcaatatgccagcaatatgatctattagtgtaaaaatagagtaggtattttcctagggtctcaggttcttagtttcatcaacaagtgtcagctatgaggtctgtctcagggaataggccttaagcccatttttacaaatttgtcagttacttctataacactcatgaccctactgcaggactgggcacagtttgtagacagacctttattgtagcttgcagtttcacggccaagtgagattcgtgattccttttctcctctggtggcatctataatgcctttcagtgctataaatgctatctagtaagggtgaagctaccgtaagttgagtatcagctagatttttccacatttaatcaattaagtacgtggaatcttcagcaataggctcttttccttacgttgtggaaggcaattaatagcattggcaatggcttataatttttttggagaagggttctctgggattcttttgacctatgactcaaaaggatgtaacaattcctcatattggaggttttatttgctaggatatgctgcttagttgggcttttgttcctctcttatgtggtaaatctacttaaatggtctatctatctatctatctatctacctaccaaccttttctacagtagtagattgccatgtagcttttcaaaaagagtttattgttagctatctctcctcatcctctctcctctaccctatactcacattctagtatgttatttatcttattataatactatatcatatttccttttccttgagagagtgtttttttttacttcatttttctgcaataaatccattcattcacttagctatagacttttatttggatttctagtcatcatttagttttatgacattgaccactatactgatattgccaaggacagtgatgctatttctgcaaaatattgagtagtctaataaacaaactatatttctctatgaagtaaagtcaaatatagaccccagtgagtgtaaaaggtgaagaaatagattttaaagtgtactaagtatgttattaattactattgatatgagtataactctttatatgtattagaggattacttatggcagtttttcctggtatttctgttgcaattagttaaaaaataaagtgagaagtacatgtgaaaattaatagtgaatagaatatagagaggtttttggccacttgctaggatactatgcataaatcatttactagtatgatagaatcttgataactgctcaaaagattaactgttctgcaaccattgttatcatcatcctaccatcctcgaagtatcaaatactaaaaccaatgttgttaaaataaaggataaaaggaacttgctgtttctactagaaggccattggccagcaattgtcttagatacgatcttttgtatgtcttacagtagaaaaccattttctttctgaaccctaaagtctttagattatataaggggagtatatcactgataatccaagtattggataactttccattaagctatgctataaaatgtacctatgtggatttcatctaataaatctggggcctcattcaaagatgcctaaacactcattttagatcatacccacacaaagagaaaaatggtcaacctagcatgtttatctctcttaatttctgtcacttatggaacactatgaatgattaattataaagttatacattgactttgttggacctctaaataatcctaacttccaggtatatcaggtttcacggatttcctatgtacccaaatttgcccaaagcagaaatatttttgtacaaaatgttatgctgggcttctttaagttttatgaactttgatgtttcttatggataatctccataatctccactcaaaatgctcaattgtgtgtacctttcagaataagaataactgcgacaaatccaggtccgtaggaaaattaattttaagccagatggagctaaatttgccttatggatttatcttccctgcaaattaattcatttttcatttaaaaataaaatgatagtaaaagaccgttctttcttgtttctctagtaattgctcaccatttgtactgaatcattctcagcctctcattcagtccccaaagggaagtagccagatgccttctacttgacaaatctctggtcccacgttttaataaccttgatgtttgttgaaatccatacaaacaaaaataattgaaaaaaaatcattgtattagtaaggattctctatagcacagaacttagagaatgaatctgtgtgtgtgtgtgtgtgtgtgtgtgtgtgtgtgtgtgtgtgtgtgtgtgattcattggaatgataggtgcagtttatctaatccgaaaatgtttcactgagaatggaaagtccaagaatctagtagctgctcagtcctacaagactggatgtcttagctggtcttctgtatatgctggaatcccaaagaagcagacgccaatgccagagaagtaatggatgtgctagcaaggtgagagccagtaggcaaagagtgaaagcctccttttttcatgtcttttcattccagcagaaaatgtggcccagattaaaagcataccttctgtcctcaaattcatgatcaaaggtgtgtatcttatacctctcaaagatctgaaacagaagtagattcacccacttccaaccaagcaaatcccaggtgtgttttccttttctggattgtagttcattccagatatagtcatattaacagtattaacagttcatcataattatcaatatggattttaaccttttgaaacctagtgggactttttaaaaattggatattttctttatttacatttcaaatgttttcccatgtccaggcctttattggacctctaaataatcctaaacttttaatttcagggcagaaaaattttgccatcctgagacttagacttttgaccctactgggcagctaaattagtaagaaaaacagcaacctcttactctcactagatgttaggaacttcttactaaaaatgtaaggaactgcaacaagtacatgtttagatcattgtatcataaaaactgtcttttatagaaaagtgaatgcatgagaacatgagacatgacatgctaaaacagaatttatgagggaattaatcatttgtgttaaacaaaacaatttaggatttaaagcaagcagagcaagataaataatacaacttagaagaaataccacactggatcgacttaaaatattttttctctgtgcttctgaaagtttacttctttcaaatctctgtcaaaatgtcatttcattaacaagttatactccttctaatatgctataatccctaattgtggctgttttttttataacaacaattactatttcagtgcaacattgtattttacttggttgtttatgttttgcacgcctttcttttcccttgcaggataaaagatccttgggaacaaattcttgtttgtttgtttgtttgttcgttttttgcatgccatctttccagaataccggctggcacataatggatgattaatttatttttattgactgagtagatgaatgaccataaagaaattactgtaagcttaagctgacttaaaagttcaatttggaattattaattaaaattaaatccaattaagtataatataaatcacataggttcaaagtaaattattttataatatacaagctctagtctttttctttattcacaaaaatattaggtattattttctaaagaaataagtcttaatgttaacaattaatgatagctaagttaattgatttttaggtaataatgcctaatttattttctcttctcataccatcaatcaatataatgaaccctgtcattgataacaggacaacttagtagtattttggtggttaattttaggtttttggttttgttctgagaagttgtgaaatatttttgagaatttaataaaaatagatcagccaccatcagatatactttctcctgtagtagatgggaactaatatagagacctgcaactgagaattttcagagagtgagagattttgaaacactcagtcttaaaatgggatgttttcatcctacccctgatctcaggattcaggcaattgtgcagaagaggaggtagaaagattgtaaaagccagatgagatggatgatccagggaaacagtgctttccagacacatctggactaatgcacagtcatagagactgtggcagcatgcacaggacctgttcaggttccagccagattgggtcattggacaaagagggtgaagttgacatgagctcccacccctaaccaagaagctttctccaattgacatttgctcacaaagaaaattaactttcctcaatagcatctaacggggtatattaacctgatttacgggtagacccaggcccaattaaaatcctggtttgtttgtttttctatgcttttttgtttcctaaggagagaaaggaaagttatagagttgagtgtatggggaagtgaagataatctgaggagagttgggggaaaagaaatgtgaaaaaaatttcaataaaactaaactaaaatattttctagttccatccatttgcttgcaaaactcaagatgtccttgttcttaattgctgagtagtattccattgtgtaaatgaaccacattttctgtatctattcttctgtcatgggacatctaggttgtttccagcttctggctatcacaaatgaggctgctatgaacatagtggaccacgtgcccctgtggcatggtggggcatcttttgggtgtattcccaaaagtggtataactgggtcttaggtaggtctatttccaaatttttgaggaacgtccagattaatttccagagtggttgtaccagtttgcaatcccactagcaatggaggagtgtttctctttctccatatcctctccaacatgtgttgtcacttgaggttttgaacttagccattctgattggtataaggtgcaatctcagggttgttttgatttgcatttcagatggaattgcagaggagtttgagaaaaacaagattcagtggcaggcccaaagtgcaattcagctcaaggggaggtcccaagtcctgaaactattactcacaaaaaggaacctataatgactgccctctgaaagacccagtaagcagctaaaagagtcagatgcagatatttgtacccaaccaatggacagaagcagccaatccctgttgaattagggaaggctgaaagaagctgaggagaagggtgatcctgtaggagaaccagcagtctcaattaatctggacccccaagatcgctcaagcactggaccaccaaccaggcagagcatacaccaggtgataggagccccccaacatacatacagtagaggacttctgggtctgtgttcattcagagattatatacctaacctcaagagactggaggctccagggagttcagaggtcaggtggggtggggggtagctccatccaagtggaggcagggagtggggaggaggcatgggatgtggagcagtcagagggtggatggggtggggtggggaatgaaatatggagtgtaaaaaataaatcaattttaaaaactaaaaaaagtagctacaaaaactggacaagtgaatttagagcatgaatatgtggacatttttaaatacccaactgcctctggaagtaaatcttaaaatgtttatttgagatgtgatagaatgttaccagagataactttttatagagcctgcattttctaatatgtaatctcatgataacattttctgtcctttactttctcaaaattactgttacatatcagaattcccttgtccaacacaaagtataatttaaatacaaagggccatatgatgatggtaataaaaagttttatttgcctagtgattattctcttagagttaagagattttacttgaaattatatgttattgtcaaatgcttaacatggaaaaaatagtgaacaacatatgttagtattaaaagaagcgcaacatcactgtacattggatgtactttctaacaatgaggtaatcagtgccaacttctgagtgagataaagaaacatgatagcttaaaagacactgaactttcctctttgggaggttattgatttcattaacacaaatgcaaactaaatttcaaaatgtccaagtttaggttgaaatcatgaggcagatgggaaatgttttattgcattttggatggtataagaagtttgatactcatcctagaagcttagacaaacttcctagtcataaactggctgattggcatgcgttagtgtgcttctgaatctgcctgcagaaaaatagtatcatgtgacaggtcaagttgctgctatcttagaatttattatgcattttgaaaatccttcaaggtttagaatacaagctaaaaacaaagatctatgaaaccagaacctcaatcaaagtagattatgactaaagtattatctacaaggctaaggtactaaggaaaaattctagcatatggccagtgatatcagatacttccaagatgctcatccatatgacatactctcctacttggttttgaagctcactgtcttttgactgcctatggacacatttcaagtagctgatccagtgtacataggaaatacctgtcatggggggaatttcaattttgtcatgtcttgatgattggaaacactttcaaataacagataaccattctaggagaaacatatgaattttgggtatattacaaggttcccattgcattgtccgaataaatatgacttactgaaaattatcttcagtagtgtaatatcctcttttagaactctaaaaacaattcatggcttagccaggaaattctgccatacaaaatactatataatagatgacttcattaaattaaatttatgttgtgttctgaaatctagaagtgaaaatttaactttctgttccattcaattttcaagaggaaggaagggttcttttttgtctcagggcaaatgctttctcaataccttcatgtattttttcttcttgggaagggtattgacaaatagtgattaaaggggcttggcatttgttgagaatctagtaatccctcagattagggacccacctttattacttcagttacattttatgagacccatcttcaaaaagttcactgtgggagctaggacttttacataagaatttcccagaccacaaatgctcaacctacaacaaacaccaagaataccaccatactaacatttatagtggttacttttctttgaacagttttgtaaatatgatagagtgatagagactttaagcgaatattttcagtattacttaagtcaaatattccatgaattgaatttattatgttcccattaattccaccaacagaagctcttttcaatgcagttatttaaaacccaagtcttaatatcttgtgggtcttgcctcctatgagcctttatatacttcatttaccagttgactaagtgccttagtaaggatttctattgctctgagagataccatggccatagcacctcgtgtacaggaaaacatttcattgtacctggccttacaatttcagaggttttgcccattatcatcatggcagtaaacttatagtatgcaggcagacactgtgctggagaaggatctgagagtgctacatgttgatcctccatcagaaaaggagactatgaggtgcactgggcataacttgagcatatgagacctcaaagacctgccccatagtggtatacttcctacagcaaggccacacttcttaatagttccactccttatggaccaagcattcaagcacatgaatctatattggccattcaaactaccacattaagtaaataaagtgagggtggcacatgggaacaatttataattcatcattaaaataatacttgatgaatttttattagtaataacttaattcaggactgtaactaattattgagaaatacagccactgtatatattgaacaagagataaataggggaatacaaatactcatgagaattagctgttttctcaaaccctcttgtaatcatcaaagcaaacaaatgatgtgggtgtgatcactgtctgtggggaaatgggctatgcacagatagcctggtctccagagttgaggttttgaaccacggtgcaaccccatgggtggtaatttccacctacatgggacagaaggctttcaatcatgtctcctgaacccctggctcctgtcaaagttactgcccccacagcccccacaagagaggcctgtggctagtagtcacatagataatgccccaagcttctggcattctggctagactcctccccacagttatctagcaataataagagagcaaagcccactattatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaagaggggctgcttgtcccatcctcactctctttaagctttcttactctctagccctccttctctctctctttcccttcccatctctctctctctctctctctctctctctctctctctctctctctctctctctctctctctcagcttttacctctcttactctctagcctttcctctctctctcccctccccccttctctccacgtggccatagccagcctctccctttctctttctaccttctctctttcccccctgcctttctacaataaagctctaaaaccagattatctgtgatcatcaaggccagccatgcttgaactctgggatagactttctcctaaccccatgtctaacctccggacagaaggccttcctaagctgcagctagggaccagactaaggactctcacctgcatgggaaccaccccagtgccccactccctctgcccctcttcccttatctctggagcccagtgcctcccaggggccactattgtgttctcagtttctctgctgtatccagcatgggatgctggagactaagcacttggtacctggggctgccccttgtctaccacctgccatgtggggtcagtggcttaacacagccagatgaccacctgaagctgtgtagaaagtgtctggcagtcctcctggtctgcctgcccagagcactcccctctttcccacactcccacggtcccgcaattgtccatattctattaattaaaagtagggattatgttcaataaaagtttactggtaatctggatttgtagatttagcactataagtagctgagctgttctacgtgagccatgatattatttcactatgtattaatgttttgaaatgtttgactcttttcaaaaatgccttaacaaagtccatcaagtaatagatcaaagattttctttcacctttgtttttattctaaaggaacaagagagacaaataggaaaagtatcatgggggaaagagagaagagaaaagaaaatagtggcattttatgaaggatttgatgatgtttattaaactatgtgctatcttacatgtattttctaatagcaatttgttcaccattagggctctttcctacagtggcagtaactatacaggacctttgaatgattttatgttacaattatagtgttaatgatagggagttttaatataatagactcttcacaaaagagtgaagagagatatcatatatataccttttttagaattcaagtaagtctgtccatattggatacatgttggaaggacacaaactaggacctgacttcccaaagaggccctgaagtaatccaatataggaaagatgggagaaatgccttttcttcttgctaaatagttacagaattgaataataattattataggcttctacatgtttgttacatcctagacaatcttaaagacacctagaccagatttcctatccattgtactccattaaaatagtatattgattggtttaaatttttaacaaacatctcttttctgttctgtatcagttgaatacttcttttcttttggtacatatcataatagtagcatagctaggttgtactaacaaaccacagtatgtgaaaaaccacagtatatgaaagtacaggcttctaaaagtttccttcctatcaatcacatttggctcataaaatgtgaacatttatcaaaggtggtttaattcagaattagtaaaccactagaaggaattgtctataaaagaaaactgttctaatttattaagccaaatgtctccaatactataatactcctggtaggctttcaagctggtgacagacagaatgtgtcaatgagtttaaatgttttctttctatattaaggaaagcagcattctgagatgctagtagcacactttatcttgaaactgagaatgaagggttagagaacagttgaatgacttagtactttgttaaaaatcaagtcaggtttgtggcatgtgcataaatatgggcctaagcaagagttcctgaataatggtatttatcaggctttgttgataataacagtaatagcataataggtaaataaaaatattatacaagtcaaatctgccttaccaatccaaaacatcctataatctgagaaagcactgcaatcagacttgtagaactgaattagagatgtgtgggtattaaaatacccacatccaatccatttccacatgtaccatctgttgtttccagatgcactgcttcctagaggcagtattcatgaccatggtattataacactaacaaaccggcattcctagttctgggacttaatttccagaaatacaagttttcattggctagacttaggggaattagagtcttctgtggctggggacgtgccattacaatcatggtaacggaaatagaccaatacagagcttaaaaggcttcagggagctttcaaattgggagcagtacaaagtttctctgatgtgtctgtaacttaagataagtttagaagcactattaatgctcttcccttggtggatagatatgcctagttcattgtagataaggcgttagaggtacctgttctatgtaacttgtgataagggaagttagaaaatgctccaaagactcttgagtatatgcttcaagccacatatatagtccagcaccttcatctggtgctgtctgtaaagcaatgggctgtcacctccctcaagaccactgcttgcctcattaataccactggaacaaattatcacttcacagcccagaaatcttctatagcagttgtggtgattgatgtaacaaggctaaaaaataatgatgaaatgcatgttccagaagacagattcaaatggcaggagcttcaaaggcaattaaatgtgacacagaaggagtcttcatggaataaagtattttcaaataaatggtaagataagtgtgataatctcctagactcgcattacacataaattagtttcctatgaataattatttctgaaggcttactatgtgttgaagtaaaagcttaaaaacagacactttgatgcatatacatactacggttttaagatggtgtggggagcagtgttgtggcactgaaaaacttggctggacttgaatttatttttagccagacactttgaataacatcttttgttatgttgaaaggtgtcttgtttgttggaaagtaaagaatcatgactacagatgtcaagtttaactgctttcctccgaagcaagttaagcgatttcattctttcttttttcttttttcttttttctttttctttttctttttctttttctttttctttttcttttcttttctttcttcctttctttcttcctttctttctttctttctttctttttttttttttttgagacagggtttctctgtttagccctggctgtcctggaactcactttgtagaccagactggcctccaactcagaaatcctcctgcctctgcctcccaagtgctgggattaaaggcatgtgtcaccaccacccggccagttaagcaatttcttatgatgtattcattctttcctgctacatttctgtgttgtgggaggaacctgtctaatcaaaacataagacaggcacatcaaggttaatacaacatagaaacttaagacatggaagtaactgaaacaacttgacaagtttaaaactttctgacatatgctggcaaaggcagagtggggggaggggcaagtatgcaattatatgcatccagtggagttaaaacaaataaagtctggacattaattgtagaaaagatgaagctcaagctgccatgttgaatctataagtactactcccttcatgtcttgaaattagaacacagggcaagtaagcagaggattggctcagatgcaggaggatgtagcaagacagattcttttaataaatctgaagacttttttgtaaatcatgtctgagttgcatataagctaagtagaaccttcactgcagtatttaatattttctctttggcaattaatggtgacaaaatctgataaatgtatttaaagtatgaatgtgagttgttctaattctgaattttcttgataaaacttcatggaatactagtacaccttggtagcgcttttgtcaattttacaataggttgcccagtctttttaatgaaatgattaaattattcagatctttttctaattatacagaccaccattaacatacttgtttactctgagaaggttgaagtgtccttttgaaataaaaattaaaggccattttgacctagttttaaaacaagcaacagatacttgggtagtttataggatgcacaaagaaatatttgccaactatcaaaagaaacaaagacgtctatttgaggatgactgcctttcacaaggttagtcactgaatcaagaaacttgtcttataatttttcaattgacttaacttcttaaaaattgagttgcaacttaagaaatctgcaaattacttacctgtcttcctaattggttggaaattctgaaaatgtgatgttcgtcttatacatatggctagtatgacagctgcttaaaatagaaaaacagtaaaataaccgtgcttttatgacacatttatagtttggcaataaaagctccttcctaaactcattctcccatcacagcaccctggtgatttgtgtaattattattttatctacccttttaagcaatggaatagacaaaatatgaactaatgaaccaggattcattttatattttaaccattatttaacacatgcacagtaacagtcatttttaaggaaaactaattcttttggtccaatacaaatattatgctactaaatcttggatcctgtaccaagtgataaataataaagtatacttttacaatcatggctttaaacaactttaattgttgacttatattagaccattaaaatgtctagaaaagcctttttaactgaatacttggaattccaagttaattttataataatatattaataatggaaaagacacttgcatgtactgagtgcctcctagaaacaaacacaaccacaaacaaacttatttaacagcaaattcacaatattgtgcagtatttatttttctcaccaattttatgaagaaaggatattcagccttagagatatttagtatctcttttactgtcacaccagctttgcagtgtcagaaccaatattaattgtgaatctgcatagtcctaacaaccatattccatagctttttaataaatgggaaatatatttgaagacaatttctaattcaaaatatatagggataactcaacaagacaaatgcagtcattctacttcttaaattgtacccaagacatttgaatgcattaaatgcataatgatatgaaaatttagagaattatgtttattacattaattctgtttgatatgacttcataatgattttatataagaacacttacatattatttaatagaaatatgagggaaagataggttagttcaacctacacattcaaaagattattaaagctgtggtttctactgttaaaaaaccctcatatataaatcaagtcagtgccaaaatagaaaaatgatatggactcataactaaactatctgttgctagctataagggctaataaagacattcttgtatgaattactctgtaaaagagggcttaaattaagtatcaaaagttgtgaaatgttctttagactttaagttataatgcaatcaattatttcaccgtgattcagtatttacctatttctgttgcagccaaagtccaatcactgtgaaaagcaactatatgattctattctacatgggtagaaaatattgcagcataattatagtccttttatttttatactaaacatttctgaacacttaaattattttaagattttcattttcaatccaattttctttgcagaatatagaaaagataaacccagaagttactcagttatttactacaaactttaaatttcccaaaaagtcaagatagataaataaggctctattttgccaataagtcttcaatgagtagttttcataatcctttaagtatatgtgacctgatagatttttctagactttttctgagtctattattttataatctatggaataagatactatttccctggccttcaattattaaaggaatataaagtgtagaaaaataatagtactagtactattattattaaatattaagtatagaacaagtcataattataatagtattttactagtcaatagtatcaaactgctcttgaaatgtgttgtatatacaattcaacactctatttacttatttttgaaaaattcatacatacatacaacatatcttggtcatatcctccccccccactctgttcatctccctttactcatctccatttcatatcatttaaaaatttgacttaatatctcatgatctgcccatgatattgattttaaaaagtaagattttagatttcacttgggttgtatcagttccatttgacaacaatggtattaacataatactctctcttttactagtattataaagacaatgaatcataattaaaagacatcaagcatttatttcccttttaattatcttcacttctttaagatatttgtagcttaaaaaaagtagaataacctgattaaatttattcatccaaatcacaaggaattctagattatttccttttcaattctgggagaacttaagccatctgttgccttgaagcagagagatttagtaatcaggcacagcagtaagaagatatttgtctagggatgctattaattaacaaacttggaaagcattctgcatttcttaccttaaagtcaaacacccctcacaagtacattggacaattagattagaaaacccggtctgggtcagatgctccttatgctccaacaggaaaataactcaatggaaagggctaaatccataaagatagcataaaatgcagtaaatgataagaattgcgaggctccaaatatatgtatatttagaaaccttcagttattctaaatgactatgttctttcataatccatttttcttctcttagaaagacctattctagtgttctttgtacttaatgccaaaattttaaactggaaaatctgaacatgaaattttgagaaaacttgaacattaaaaaaaaattctcatttaaaataaattgtattttggtataattactttgcaacaaatgcgctcattttaaagtacatgtactaaagtgatttgaccaatgcacatctacagaaacattactaagatttatgtcatagaatgttccatcaccacttcagatgttcctacactttttggagtcaattgtcaccatccccttcctgaaggaaacacctaactactttctttcaccccaaagattatcttcatctcttctggcgtttcattccagaagagaaatacttgtattcttctttttgtatgatttatttcactaagaacatggtattgtgttatggtttattttctatttcattgtaatagtcaataatatcaacaatttgggtgtgtttgtttgcttgtttttgttttctgttgttgattttttgacacaaggtttcgctgtgtagccctggctatcatgaaactcactttgtagaccagactggcctcaaactcacagagatccacctgcctctgcttcctgagttctgggattaaaggcatgcgccaccatgcctaactgatagtttcaatcttttttttttttattaaagtattttatttgtttacattacaaatgctgccccctttcctggggcaccatccctgagttcttcaccccccatccgccatactccacctcggagagggtgctcctataccctcccacccaccctcacctcacctatgatagaagttctaaggactacatgttgttagttttgttctttagtctttgttttactaaggactaatggtgttcaggatcattttttgagacatacacagtattgatatgcaaagtatttgtgccatgcaaagtatttgcaccataggctggctttgaaatcaccattctccattttcaagcgcctgagcactgtttttgtttgtttgtttgtttttgttgtttgtttggtttttgttttttttttctcccattttagttctcaagagagggtttctctgagtagctctggctgtcctagaactcttccctataaaccaagctgggtacaacctcacagagatttgcctgcctctgcctcccaagtgctgggtttaaaggcatactacaccacgtgcagtctgaggctgttttaaaggtatggttcatatgtttttatatgtgtattgaccatttttgcttttagttacatattggttcttcaaatcttctgcctagttctttttaattaggtatttagctcatttacatttccaatgctataccaaaagtcccccatacccacccacccccactcccctacccacccactccccctttttggccctggcattcccctgtactggggcatataaagtttacgtgtccaatgggcctctctttccagtgatggccgactaggccatcttttgatacatatgcctagttttaatgctcactcttctcttttgttattagtggcttacaaatgtcctttaaatattctatatactaatgtccttcccacgctaaagtcacatgaaagctgctttcatattttgtagctaatcttatgaatttttgggatagatgctttggaagccttaacaaacatttgatcttgaagttcagcttagcagttttatcactgattgttgatgggctttgtttccatcttatttttatatctgccaatatcatgacagttttctcccgtgctttcctcaaggagttttacattttggtctgtagtatattttgagggttttttggcatattatgcgaggtaagtgctgaattgcaattttgccatatggttatccagttgtgctggtatcatttacataaatatgctttgtatcgaattttacttttgattgttattttaacatcatttgaacatatatttgaatatatatgagtgtattttagggttctctacattgtttccttaatctatacatctgtataattacgccagtattatactgtcttgcctactgtagctttacagtaacttctgaaatctgtttccaaagtctcgtgttctgaagttcgctgtaaatcatagcacttggaggaagaagaagaaagagtgccatgattttgaagccagtctgatctgcacaatgagtccctctctacaaaaacaaaatacaaactaaccaaaacaaagattccccccaatttctttttattttcaaagacatttaactatttgaaataatttgcattttcatatgatttttaaaaatgagttctgaggtttcaacttggtttacttagaatttatggatcattttgagcagaattgcaatattaacatctttaatattatttataatctactactatggcatattttccacatcttaggccttttattgtgttcaataatggttttagttttacagtgtgcacatcattttcttctgttaaatttacacttatgtattagattaaacttcaaaaaggggatttgaaaaggagagagaagaatttatctgcaatctttgttaggtaaatatgttactattatctggtatacaaaacatgagtttttagttttataagatacacaattgtaagcaaatgtgactctataaacaagacattgaataatggagctgacgaaagtttattctaaaagcacctaattggagagggtaagggcaggcatgtccttaggttatggctgaattggaggccttcaaatttactttcttacaacaggtggtataaataatcgaataaatattttaatgacagttatttacttattttgtggggtataaacacatgacagaatatatatggaccacaaaggacatcttgtaggatgatgtcctcttttccttctgtataaatcctagggattgaactcaggtccccaagatgatagccaacaagtttactgactaaactatcttgttagttgtttagttgttgttgttgttgttttaattttttaagtaaatatatttaaaattgttttatttattcacattcctaatgtttgcccacttcccaatcctccttctaagagttcttcacccccatccttccccctttcatctgtttttatacttgggaattatgggcacaatatatgctaaaactttgtgaaacttgtaaaatggaattgatttgagtttaggaccttgtgtatgttagaaaaacactctgtcaatattcccaagctctcatggagccattatcatttcttttttactcttaaaatggaacgtaattgatatataccaattagtgtagtgtagctcagtcactaatcgtactgactctgagctagactccttagatttaaaatgtgacacattcctttgctgattatatctttttgaatggtccttaccttaccatacatcagttatttttagaatgcagtgttgacacttaacatctgatattaatatgaagagaaattaatactgtgaatattaactatctcagtataaagcacacagtgaaacagtcaataagtgtttgcaaaagtcactgctatcattacatctccgatattctcctcactttctcaacctcttgaaattaccttggtatgctttgctttcactactgcccttttgagctatattcataaaattcataggtatgtcaattgtagtatacctcttaaattcttatcattgtaacaatattgtaaatggtataattagcaaactaatccagccaaaccacacaaatctattaaatatattgccagactgattattctttaactcaatgactgtataatagcatgttcaactactcagcaaacatttattgagtacataccacatgtaaagcataattaaatgcttagatcagtgaacaaagctgaaattcggtgcttgaaaaacttatgttctacaaacaacagtcattcttcacagctgtcttccatccatctgctcaaatttaaggcagagccacaggtctttggatggcccttaagaagtcttcaccataaggtcaaaagaaagataacaaataattgataaacagctatatatgctttcttgtctttagctttgtctctagagaaaaaagttggtgctaagaacctagcgttagagccgggcatggtggcgcacacctttaatcccagcactcgggaggcagaggcaggcagatttctgggtttgaggccagcctggtctacaaagtgagttccaggacagccagggctatacagagaaaccctgtctcaaaaaaccaaaccaaaccaaaacaaaacaaaacaaaacaaaacaaaagaacctggcattaggttgtaggtgtctccctctcactccccctccccctcccccactctctctttcctgctgtgtatgtgtattgtgtgttataaagagtacatacatcaagaacatgatttaaattcaagcttgtccatttaccaccttttaacttttggcaagttaattaaccattctaaatttttgcttcttcaagtcagcattaataaaagcactatatgtacatagttattgctactaatggatgaggatgaatgtaaggtccttactagcagacttacataaaagttttcctatgcattaattccattttttctcttcgggtctcctaaaattgacttggttctcaataaatacttaatgcacattgtctttcccaagtcagaagtatgtatgtgtgtgtgtgtgtatatatatatatatatatatatatatatatatatatatatatatgcattatgctatttcccaaaactatcttctgtatcacattgtactcagtcatacaacattcaatggctccttattacctcctatgatacattaaaattgtctaatactagtagtggtctctaaatatcagcctatttcttctcaaccatccaacataaatatttcatatgaacccagttactcaatattagtgtttctttagtaggcctgaaaactgactagtttctaatgagtgagaggaatttgattttgacagtggcaggggtgcaggaggttaatggtacgagtgctgatagtctttcatatatgggagtgccggatcactagaaatatgtccattttccctctaatctccttcctgttaaactatactttcattatgcattaaattagcatgtaaatgtttgtttttaatcaatcagttagttactaggcactaactctgtgtaagaaattttcctaggaatgaaaaccataataatcattttgttaaagacttaaataaaagaggagacactgtgaatacaagtgtgtgtgtgtgtgtgtgtgtgtgtgtgtgtgtgtgtatctgtcaaatggaaatgtaagaaattaatgtaggctatttactgggaaggtgacagttgagtgttatcttgaaatatttggcactttttagtgaatgtgaacattgaataatattaagagaaggaagacatttgaaatgggggaaacagaagatgcaaaaagataaagtgggaaaagtttgatttattcagtgaaacacagaaaaacatgcaataaggctgtaccacagggtgtgaatagtgagagaatacaaaacaatgaaaaatcatgtttagagttttaattaaaaccaatgtggagattatatcacagcaaattgtgattatcatttattcaacacctactatatgtaagggactatgtaaaatgttgtctgtgccttgtaaaaagctttataccattcatataagatgtattttatgtataaggaaactaagtcaatgtttaattacccaagttatcatttgagaatggcagagagaggattcaggctagaaatataagatcacagaatggggatccatcccatatagtcaccaaattcacacactattgtggatgccaacaagagcttgttgacaggagcctgatatagctgtctcctgagaggctctgccagtgcctgacaaatacagaagcagatgttcatagccaatcattggactgagcacaaggtccccaatggtggacctagagaaaggaccaaagatctgaaagagcttgcagccctataggaggaaccacaatatgaaccatccagaacccctgagctcccagggattaaaccaccagccaaagagtacacatggagggacacatggctctagctgcatatgtaggagaggatggccttgttggacatcaatgggagaagaagcccttggtcctgtgaaggcttgatgccctagtgtaggggaatgccaggctagaaagtgggagtgggtgggttggtgagcagggggaggaggagaaggggtagggggtttttcggaatggaaaccaggaaagggatacatttgaaatgtaaataaagaaaatatctaataaaaaaatcacagacttaagaaatatgattgaatgatatatgacaggcagtaagattgtgatagaatataagacaaccgcgaggaatatagtattaaggtggtttgcatttattaaagaagagcatataggcattagcatataggccatagttgagtatatatggctgtggaccaatttataaagataaaagaagattgtaccaaagatggagttcagcttccactgagaatttctagaattttacttgctaaataatacaagatccttagagttacatgcagatttgtaaaaatcccttttcatttctattggattattagccacttgaggacattaatttctacaaattaatcacatttatcagatattcctacacatagtataaatacatctttaactttttaaattatttatttgtggggtgtgatggtgaatggcatatatatgtgggttaatggacaacttgtcagagttggttttttccttctatcattttggtcttagggctcaaactccagtcatcaagattaatgacaagtgtcatcaccgtctgtgctgtcttgtatatcctcaattcattctgttttatttctctacagaatttatagaatgttgttagggatagagctgtaagacggctctaattaggatctttctgtttgtttcttttaggagcgagattttgaactatgtactggagtcaatgaatactagaagaaagtgcctactttgctccagtataaccaagagctaggatgctttatagcacttaaatgtgacaacataattatataaaaggttcaccaataattatatcaacggttcaaagacgttttattctcagacttagtttttgataaaattagatgtacgacaagataattttttttcaatttgaccttcttcattctaaattaaacctcctatcatagtaaataaaccaactgtcattaattttacattttacatcatatatgacatatatgtataatttatatacatatattatgtacgtatataaatataaaatacatataaatatgcat

SEQ ID NO: 417 - DNA, 105049 bp, mus musculus; identical to SEQ ID NO: 416

SEQ ID NO: 418 - DNA, 105049 bp, mus musculus; identical to SEQ ID NO: 416

SEQ ID NO: 419 - DNA, 105049 bp, mus musculus; identical to SEQ ID NO: 416

SEQ ID NO: 420 - DNA, 184 bp, mus musculus; identical to SEQ ID NO: 36

SEQ ID NO: 421 - DNA, 165 bp, mus musculus; identical to SEQ ID NO: 37

SEQ ID NO: 422 - DNA, 249 bp, mus musculus
cagaccccgcactggccacggggaagaacggagccacctttccccagccagtcctccgctccaggaagggggggggggtgccgcaacgccgttcggggtcggagagcgatcgttttcgctcctggttgatgtgtaacacgctctccccgttttgttgttggttttttttcttttcttttctttctttctttcttttcttttttttctttttttgactcggtctatgtaggagggcgggggtctcgcccg

SEQ ID NO: 423 - DNA, 249 bp, mus musculus; identical to SEQ ID NO: 422

SEQ ID NO: 424 - DNA, 60730 bp, mus musculus
gggagcccagcggcctgatcccagcaccccccctcccgccacctccctcctactcccgcttcgcccgcttcccgggcggtgtggagaagagcaaagttgcgacagcagccggggggctctgcccaggtgaagggggcgctgtgacgggggcgggaacggcgtggccctgcggcgggggcggggggggggaggataaagaaacttgcttttcgcagcccccaccctgcgcgggttcggatcttgcgtgatccgagccctcgtggagacgctgcaccgccgccaggaccgaggccggcaccccgagccggactcagatagggaccgcgcgttccggcgggctgccgagggcaggcaggccggcacccgggcaagggcggggtgggtgaccgtgcaccggaccgaaccgcggactctggcggcgtgggcgcgggacgaaccgggaccgggccgagttgggtggcgaagtaggacgtggattcggggggcggggcgcagcgggaggggggagagcaggcccggcccggctggcctgggcgtgggggtggggggcgagttcggggcacttgctgggctctggaccgagcgctagggcggggcggcgctaggggctgggcccgaccgggaggagagggcgaggggagggagagcagggggtggagtaggggcgtggagttgcaagcggggtctggcctcggccgggggcgaaggtagatctgcggggccgaaagcggagggagggaggcccgaggcagcgcggcggcagcggcggcggcggcggcggcggcggcggcggcggtggcggcgaaggccagcttccgcggagtttgtgcccgggcttcccagctgggctccggtcgcctcccgcgcacaaatggggttaggggactgactggtaagcaactcccggtgttggacgggcttcccaggcgattcccggaaaaccgagggaagacgccgtctgcaatatgccgcaccccaccactccacctcttagcatctggattctgctcttcggggtcggtggacccttccccaccacaatccttccaatcttccagcaccccttccgtctccctcttatccttggccatctaaatctcctagtggtatgctttggaggggtggaaggcgtcgagggctgcactttccctcccttgggggcagcctagtttgtgtcttattcctgccaggtaatgttgcttggcatggtgtggacctggggtttagataatttaagccccggatccaagcttttttgatggcttttaaggaaagggacggatccctggattttcatgaccagaatggggtttgaggactggagttactctcagctcacttccagtaccaacctctttactatgaaccatttctgtgggggctcgaacgtggagggtgggatacgggagcattaatgtgctttgcttctctgtgtttccacagggtcagcgtggtgaaggacagctagtgtcagagggaaagtagacactagtccaactacggccgcccccactaatacttcggtaagggggacacgactaaggggatgctggtgggttggggcccagtataagagtagaggtgggtagtcgcccccaggactctttcctggcggggagagaaaggcgagcccctacttcggggagggttccggggaaggagatggagggtggcgactggggggggtgcgggaagaatggaagagtcacaccctgcttgcaaggggagcctcccttaggctcctgggaaaaggggactgaatacgtgtgctctgtggtaccagggcaggggagatctggggatggttcaaagagtgatttgcacactggttctggcactagtggcctgagaaagtcaggttggggcataaggtggagaatgttggaaggaaggcagacaaccaagcctctggccccagtgcccagatcatttcccttcctcaacctccctcctaaggggcatcggggtggggggcgtggagctcttggagccccgcggattgagtgcctccgcctttcttgggagtctatctttttgcccagcttgctacagctaccactgcctctctctctggaatctgctcggttctctctgcgatcccctcctcctcctcctcctctcccctcccctcccagtgtcaccggggctgcttggctctgcccccttcgccgccgcttgctcccagctttagtccctccttctcatgcttgctccctcccttcgcctcctcctccccatcccccccctcgccaaggccgcattctgggagttgtagtctcttgcagcgctggcaggcgccgcccgcgaacaaggctggactcgacttcccgtcgagccctgcgaccggcacccactccaccaggcttcgctcacacacacagacacacacacacacaccgctctccccctcactctttcgctcgccgcggcgctgccagtgtgtggctctgtctctcctccgctttgctgagccctcccttcttcctctcagttcctagagtccgaccgccgccgccgtgagaggagaaggaggtcggtagcgataaggggcggaggggggcatcggatgccggcagtgttaggcgggtggtggttcaaagagggtgagagggagctcgggtggcggcctgagcctccctgcggagccgacccgggaacaggtgcgtcttttttctctctcccccaacccctccaccccttttgactccctggctttttcgtattcccccacccgcttctttctatcctaagcctttccccaaccctgtccgttcctcttcccttagcttctcagcttgccccccgggggcgccgtcctcttcgtgtccccggacgtagagctctcgggagctctctctgtcctcgcccctcccttcgggacagctcccctccacttccaccttcgtaccccatccctgccctgccctatccccttctcgacctccttctcttttagccaggtgagacttgttcaccaggatccaagagagtcttcccctcggctgggcgggggtctccatggaaacgggggtctgtagatcctggggcggggggggtaaccataggaattaccccactgaacagaaaaggaggtggaggctatggtcttggaagtacctggccccaaaccctgatccatccaaggatccgacgatccgaagggaacctggccaacagggcagggcgaaaaagggcttgttattttttggggggggtggtggtgtccgtgatgaagtcttgaagagaccgggagaaaatgccctccaaccttagaggtggaggtgcgacgggagctctctcggggttgctttctcctcttttcaggggtgcaggaaccgtagggtaaggggtacccctaggtggcggcggggcctgggttcgggagtgggagtgctgtgatgggggcaggggcaattatccgagtccctggaaaaaaggcgggggatgacttcggagcgcccaagctccgctgccctcgctctaggggcgggggctaccgggccaggcgaggcggggagggtgctcaaattgaagaaggatgagatgggggcaattcatactggccccggcaagcctggtgggagacccagctggcttgcaagccctcaacccgcttcgcgccaggcctggaggctaggggtctgggaggaaagcagagggctggaaaggagggaggctccggttacggggccggatttcgggatcaggggcaatcccctggcccttggagagggagggagagggatggccgcgaaccccagggttcccccaccctgcttcataaggggcgtgaggaatggacagcaggcccagcggagctggattcaagcggatcgtggccagggagtgggggggcttagtggtggtcttcgggggggagtagtccggcggcggggcgggcgggcggggcgtggggctccggcgggcggcggggcggggcccgggcggcgctgctgccgctgccgccgccgccgccgctcctgctagggccgccgccgccgttgctgccgccgccgccgccgcttctgggcggggaaccgaggccaaagagagtcccgtgccggggcagagggcgcaggcggcgcgcggtggggaggggggctttctgcgggcgggggcaggctgggggtggagtccccgacggggggcggtacgagctaggacgacgacgaagaggagccccgggggcccggtgcgtggaggacgaggtgctgggagaaggaaggggggggggtgggtcccgcgacgggcctcgtgggcttggctcccggaggttcggcttcgggacggagccttgtgggggcgcccagaagccaggaaagggatagaggggtgaactggacggtggagggggccctcctcgccggggtcccgtggagaggaaggctgggccagagggacgtccgggcaaggctgggaggagccggcggcaccaaggctggggttttcgtgttatggaggtgcaggagattgttgtatcgaaagatgtggttgaggggaaaggcgggagggaagcacgctgcaaacccaggaggcccaacaccacaggccgttgggggtgcccttctgttccgctcaagcttcccctcctctccccattagaagcactgtgtttttgttgtattgttttgaaaatttcaaggttgcctgatcaaactgtcgacgtggtgatactttcttattcttgctggtttctagagtagacagtcaggacaggcttcagttggcgagcattcttccagcccagcgttttgggggctctttgcatgcccgtgggaagggggcttgtgaagcaaggcacagatgaatactctcaaggcgatttggaggtcgttcctatgacactgggtagagggcagctgcagatagctttggtcagacttctggggtacactcgaaggcttcaagtgttagtcccatgcgtctttcaacttagaagactatttctcggaatcacactgcagaaacgtttcatggggaaagaaatggggcatgaatttggagttgggagttgattaggctcataataaaattcaaaggatggctgggagttaccattttaatggtcatctagcgctgttctgtttagtgtgtcttgtccttgaatgttagcagtgaggggcctttcttattggggagactgcaggtggcatagtcaaagctaaatttgggcagagttttaggatactcgaatgtgatgtcacctggtggtactgaagatgacagtctgtaggaaagaaacttacaagattccactggggattaaagagataatcccgcaccaagaatcacccagaggctccaaaaggcagtaaaaggttgagaaggaacctgtaaaattttgacagaaacaaaagtagcaagccaaacagagggagcaacagggacatggtgagtcaagttaaaagaatccaaagttccattatgcacttgaggcttgccgtgggcatcttgagtagttcatgaggacctcggtggcaggtagtttttgcacctgaggagattattttgaggtggatctgggagatgggagcccccagggcttggcacaaaagctcgctaaaatggactttgttaatggattttcatgtacacttgagtgcaggcattagtgaaaagatagacactcggaaaaaatgaaatttattcttgtgggtatgaactaatcaagggaaagtcactcttaaactgacttttgaaagtctgactctttataggcacagacctttaatctcagtactcagtgggcagaggcaggtgagtctctggagttaaaaggccagcctggtctacagaataagttccaggatggccagggctacacagagaaaccctgtctagaaaccttctgaatctcttactagctttgcagaaacagtatgtaggttcctttccattctgacccagaggtgaagagagctagatacctagttgatacaggaaggggaagagatgcagaagtctggcttgaatagactagttctgtaaaacagtaataaggaagggacggctaattgttggaatagggcagggtaaagctaagtgagtcctagccagctttgctgttgtcaaagtagagggacgttgtatgagaaatggggccataccaaggcactcttctggatctagctttttttttttttttttttttttttgatttgccaggactggtagagaagatgtgtggcatcctggagattgcctttctttcttactggctttggggctcttgggaagcagaggaggtttctctgggggtgtgtatctgagccttattcatgatacagttccctaccctggcaaggaaatgcttggtgaaggtggcagaggatctcaagccttgattaatctgtgctgtgagctttagggaggagctttgctgagagaaacagaatcataggagcaaaagaggcttaccactagaaagaaggaaggcaaaagaagtcagggagaggggaccatagggcagggaatgggggaaggaagatgaagatgagcatcattgttcccatgtcaggtctaactaagaagaaagcagtaagttgaaacctccagggtaatgttttccaaagaaagttcgaagaacccttagggctctctacagtttagtactagaattgctaaggctggagtaagaaagaagatcttggataaaaataggctaggaagaaactggcatttagaaagaaatataaatatatttacccataaagaaggagaggtagtatccatattaagaatttaaaatgtacaatgtgggctgggcatgtaaaatgcttgcctagaatgtatgatggcctgagttcaagccttagcattgaaacggaaaaaaataaataaataaaacaaaaccctacaatgtgaaagaaaagcagatcattaaagagccaaaggagagaggcattcagatgctgttcaaagctgggattgaggagtgtaaagattaatttttgatagtcactactgtgggaggacccaggaaacagaatagctgggattaagctgaaacatttcttagcaaatccagatgaatgtcaagattctgaatgggaaaggggagtcttggtcccatcttgagtggagaataggagaaagtgggactacaccagtttttccagtctgtaagctggaggaatcctagatataaggaggtaagcaatagaaattccagagcaaaacaaacaggataaagaacagggacctgagagccttgggccagaattgaacagtagagttaagggcaccaaaaagagactttaatcaggatttgactggactatgtttacactggtttgtgaattctaggtggagctatctgggatggattgggttgaatatatagagctttcccagggtcagctagcctcttaagaagccatgcaagaattctgtgctgagtttggatgggaacatgaacactagaggggaatggagagactagagagtgaaacttgctactaattggacaggaagggggagaaaacacggaggatggctgtgtgaaggaagagggggcacttagatcagtgggagtttttagaaaggaaatttcttaatgttagcattggaagtcagtctgagtctgtgtctgctcgaatctttagtgccaggatagctaaagagggaggaaataagtaatctccctttgtgtcactaggggattcgagggcagtattttatatgatctcttatatgagccaggtattattcatgccagtctgtaaaatgtaggaaatcgtcctctttctaaatcatagcctttcctgctgttcataactttaaaatggtcttttatgttgaaaatgttcttttagcgaactaaagttgtgttctggtcaagagcaaaacgtaactctgtttctgtctccaaaattccagtaagctcttgtagtattttttttaaagcagtagcaactctttcctcataaaacatgtaaaaatttatcatttttagcatagtaagtgtagatttgttaaggaacaatgagaaaaactttggagtatgtgcatgggggtgggggggggcaggcagggaacaatactctgataggttgactattttatttatttatttattttgtcttttttttttttttttaatgagatatggcctatggagaccagactggccttgatctcacagagatttgcctgcttctgtctcagccttccaagtgcttggataagagtgggtgatactatgcttagtttcctccctaccaccccccactcccccccccacctttaaagaaaactgcaggtctagtgttgaggtggtgttttcctctttgttggtagataaattgtgatgagtttgaagatgtggcttgttctttgtaaaatgctgtgattttccgatttccccagtagagttaaataaataaggcaagatgtggcttcatttgtatttaaagattttaacttgggctaaagatttgggaaggcctgaattctatgtagcagcagttttggggttgagacatcgttactatctgctaagaaacaaaatttccttacctcattactaagatctatcttagtgttgattccatttaaagctacagtagaattttgccactgcagggctatgaggacaccaaggaggtctttctttttctgagttctgtgaaatgtataacacacagatatgatcccagggaggagatccactgaagacttggatctatgagaggattgaatatattttctcatgaagagtctttactcagttgaacttgggtcttctgccttgcccaggtggccttgcatcctaattaatctcctttggagacagagctgtgtctggtccttgttgttcaactttctaatagtatggcaggaaacaagtcactaactttcctgagcctcagtgttcttatctagacaagggagatgatactaaatatcataggatggttagaattctatcaaataaaatgtatataggcactgctaaggtacttaacaaatggaatatatttttagaactaaaatttcttgtgtcttatgacgttacttactacatacaaggcagaatgaaactaaaaattcattctgctatccacccctcatattagccctttgtcctttttctctgtaattctttttgattagtagacatccagggtttattgcatggtaggaagtaataccttaacacattgctgcatctgcctcagaggtggaggtggtagttgcttttacggttgtgccatgacaacatctactctttctggacaggaactgaagactgaatatcccattgaaactttaagggatcttttgcaccagagctatcaaattccctgaagctgcctgatgtaggtgctgggaacttaactagggttctctgcaagagcaatatatactcttaaccactgagccatgtctccagcccaaaatactgctttcagtaaaggactcttgtgttatattatggctggttaagtgttctaactatctctggaaatgctccgaaagctgatagaacccggagctgatgtgcttcgatgataaagatgctcaccagtgattgaatgggagagaataatactggagaaagctctgggttccccaaaccaaactttctgggcaaaggaaaaacagtggccttcaaagtagatctcctctctgcagctggagtggactttggtgtcaacaattgggtctctgttagttttgccaatacagggagagactgaggacaggccaattgaaaacggcagattggctgacaaattaacggtttttctgtttgacttagaaaatgcattgttattttctacctgtcctctagccctgagatttacctacctatttttcttctgtttaggcaaatattatggctgttccctgagcacacatctactggtagtccataagtctcctgggtttaaaaggtagctgtgggtgcagcacaccaagatagttggggagtcgattttattattttgcttggcacaattttagttgagttctgtgtttctctttattgtagaaataaagcaggaatagagttgaagtgagagcaaggcagtaaaagaaagacttgcatgcagtgctgttttgtttatttgatgtgtatgcccgcatgtgcacatgtgaacgaacatgtgtatgcacgtgcatgacagcttgcaggagttggctctctcctcccaccatgtgggtcccagggattaaattcaggtcatgaggcttggtggcaagtgcatctcactggccatgttttgttttgcttttgagacaaagtctcattgtattgctcaggctagtcttgaacttgtgcattcaagtgatcttcctgtctcggtctcctgagtagctgggactgcaggtatacaacgttgtgcttaaatatttctacctgggtacctggtctctctatgatatagtaaaagggtggttttccctagtagtttattttagcaagctattgagccatattgtgtgtcttatattatgctacaccctgttgggagggggctagtaaatctataggtgggtaggagagtgagtcatggagtttgcatactgtgtaataagagggataaaaataaaataatagcttctaatgaattatatacataatctatgtagtcatagcagagcctcatcttcagataaaagaacagaaaaagtaacctgataatggtgtctccaaatattcatgtacatttatggtctaggagaggtttacagaagcaaaccttaaatgaggaggaatcccctttacatgaaaaagtccatgtcatacctacagtacactaaatgttttcagagacccactgaagaccaagatggaggaaagccaactcttatttttggattaacagaaattagaagtctcacaaaatgtttctatttacgtagatgtcttgctgaagtagctttgctgattgattttataatgcagacttaagttttgtaggtatctgtgacgtgtagacgttacacaagaacttttaaaggatttatcctctctgtttctctctgtctctgtctctctctgcatgtgtctatatgagtgcaatggtgtgtgtgtgtgtgtacatgtatgcagtgcctacagaggacagaaacatcattggactcccttgagatgcagttcccaggcagttgtaagccacttgacataggtactgagaagcaaactctagtcctctggaagagcagggagaattcgaaactgctaagccatctttccagccccatctgtataaagtcttattagctggagcttgattttagtataaagttattaatacaatgatatgtttttcctaaatagagcaaataagtttcttttactacaggaaaagaaaacgaatagtgtttgaatagtaagagggaaaatcaaggcagagtgtagatgagctaacgcaatctgatggcatgaaaatggaagtaaaccatgaaaacttcgcttttggttcacatcatcctcaaaatatacctctggcccctgcaagtgcctctgtgttatgctcagttcttgactaataagatgaatatattatctggcatagtgagatggtcttgaggtggctgagaaatggagaaggggagtattttttaaggtttctaccatagtttaggctatgggtcctgtaatacatcactgttccaggtgatgggacactggtgctctaatactgttgctatctgattacattcatcttcttcctcttcctcctcctcctcctcctccctcctcttctttcttctcctctttatctttttgagacagggtctcactatgtgttacaggctgtctctgaaccaactgcatagcccaggctggcataaaagtaacctctctaagttctaggtttatacctccacacttatgtcatgaatggattatggctgttcctaaatatcgagtcatctctaaaagcatggggtttagcagctacagtagtgaagagatcgaaagggtgtatataatagttaggattccatgttagtgctctcaggagctctgtggaaaattgtaagccttggccgtctagtcactgaggtgactgcccagcctcccaaggtaactaaattcatcagaatgagtaagctctcatgtgtttaatagatagttaactttcctttgtatccagtctcataaatgtttataggcacatgttttaaacatggtggtacccaaggagtctatgaaggcatccaggctagaatcatatacaggtaatttcttaagtcttcttgttaaatacaagaattgtatcttggaagaaaatgcaatatcccctgagtctgctctcatatgatagacaccagtggacatattcagaataaaagaaagaaaaaccaaacttaagtgacccagaaaacgttagaatagatttagttagatcaaacggacagttttttttaatacgttttattaggtattttcctcatttacatttccaatgctatcccaaaagtcccccataccctcctccccactcccctacccacccactcccactttttggccctggtgttcccctgtactggggcataaaaagtttgcgtgtccaatgggcctctctttccagtgatacaaacggacagtttttttaaaaaggtgttatattcttgaggtgattgtttctggttgatccttgtgtgtgtgtgctattgcatggggctagaagggaagcacgggaaagcagttgggacatttctatgtcactcaagtttcagggatgatagctgattagtagctagaagagatgagggggatagaggtatgagggagggcaggtagcagaatagaagaccatttttccatgggaaatgactaaaacagagcactttcagggggagaaaacattctcattgggttaaagcttggggtatgtaattaaatggggaagcacaagtgttgttaatatcctgttcaatacacacagagggaggcagaacagtgctgctgctttccccaaagtgagctggtagggtaacctttcttttgcctttttaaagttttcttcttataagagtattgcccaaagttctgcatttctatcagaacagtaggacccaaagttagttttctttcattagtcaccaccggcccaaccctccttcttaaactgtctaccggccacagctataatctcaaggacagatttagggccaagcttcaagatgaatattttctgttttttttttttttttaagtcataattgcttccaggtcaaaggtcactaagcagtgtgggccaaaaggagtctgaaagagtactgccagagttgttttacctgagaccctgtcctgatgttgagctcagccacaaggaacagacaggtgtcacacatgggttagagagactgatgtgacctgtgtatctactgccacctttgctcatcactaattgagtctttggttgcaaagggaggaatgaagattttgacagattcgaggttataaactttaaaaacaccatctatggtggattatgtctgtaaccaaagcacatagaaaactaagaaatgaagattgcctcgtgtttaagaccagcctgggctacatagtatgggtaacaggccaaactggaatccatatcaaaatgctgtttccaaaatcaacaagcaagccaggcgaggtgacatatacctgcagtcctaacactcaggagacagaagcaggcagatcagtaattcaaggccagagtcagctctatagtaactttggggccagtctgagtgttgtggaagtccatctcaaaacaaaacaaaaaaactaatcccaagaccccaagttgataaacaaaaacccattatctacttccatgtaaaatatttgtcagattctttctctgatactttgctcttttgcttttttgtttgttttgtttttgaaacaaggtttctctatgtagccttggttgtcctgggacttacactgtagaccaggctggccttgaacttaaagatccctatctatcggtaccctccaaatgctgggattaaaagtgctggacaccatagcttagccatgcttggcttttaattgtcgtggaatcgacttttgtcatcttcctttcaaaacagattctgccctttggtaagatcttggtattttagggctgctcatttcctatttgtgatgcgcctaaccctgactgggggcataacttgttatatagaacctcttcttcctttttttgataacacattctctttaagcttttctaaaatgcttccgtgcttccccacagtatttcagtttggcttgtgatggtgaaatctttcaggttcccctatttcatttttcccgtttggttgccgtgtgtgtggcctcttctttccatgctctagcttctagcacattgtctttgcttttgcagttttttttctctctctctccctccctccctccctcctgctcttttcaccctgttaacattattgccctcccattactccattcctgccttggtgtcccctactctagtatggctgttatggcagatggtgtactttattcagccttcttcctaggcacatttcctaggatcccagtcagtctctgctgctagctacataggcatcctgaatggctaagttgtcttttttcaggcacacttgctgctttgagcgggtggaacttgtgttcttcattgtccttatcatgagttagataagactttttgagtgacttcgaccaaagtgaagatagtttacagtggtccctctcagtgctttgcaggcagtggcagcatttgagtcttgggtcatgcagcttattcctaacaatgacatagttgtgacacctgggaaaaccctttgaggtatttcatatccctgtgcctgtgatttctgggtcacttgggattaccgggtttcttctaagttccttttccgaactttgccttcacttgtgggcaaagaaagagagaaggaggaggaagcgagaatgcgactatccctgtgggtacagtgagtggaagcacgtggatcatgtgcgtttgtaaggtttttctttttctgctcacctccactgtgtacctatggtgagctttatagtgagtgattgctaacttgattagacaggatggaacaaaacgagatcctaggcttactgaatcagaatgtgtggagctgagacctaagatactatttggaagcagctcctcagggaccttggctggttgcattgactgttctggtcccgactactcctttgccagtggaagcctgtttcctagtgcagcatttgatgcttctattggctttttctcttgctacatgaatcttgccttcttatgtaggccacttagttcagtgtcctgcttgtgtgtctgctgttttccaccccttgagcacaaagactactgttaattagcaacagtgaacttcagatggtcaggagtactgctctgataaaatcaggagaaaagttacaaggccaagatttaagaagatgcccaattttcaagatttcatgggggccagagagaaggttcagtggtcaagaagaatgttactgctcttacagaagacagaatttgattcccagcacccaaatcaggtggcctatagtgacttctctaactccagcttcagggattcaacgccttctggtgtctgcactcataagtacatacacacacacacacacacacacacacacacacacgtttagaaatagtgaaagtcaattttaaaagagattttctgaaagcagaggtatccagagtcagttttgctctctaggttgttacacactacatcatgaacgtgtttgactttagcttccgttttgtttgttttgcctctacctttcctttcatgttttgttgggcctaaaagctctttatctaggggatgtttggtctattgctgtttccaaacactgagaatccccctttgacttctgtcctggacctgcaaacagcttatctcttcaacacagaacagaaataattctgagtgaaaaatcatgtggttggagccagtggtggtggtgcacacctttaaccccagcactagggaggtagaggcagtcggatctctgagaaggttttctgtgtagccctggctgtcctggaactccctttgcagaccaggctggcctcgaactcagagagatccacctgcctctgcctcctgagtgctgggattaaagtcatctgctgtctccttatgcagcccagtctggccttgaactctcagtccattttggattacatgtaccactaagcctagggaatagggtctttgttaaaaacgtttctaaaatcaccccagtgttagtaatgttaaaaggtaatcatcaggaaaaaggtaaggcattatgactccaaatactggaaagggaacacatggtacgggtctgatttttcttcctaattaatgagaaagctagacatgttatagctactgtaaagctagatgtgtaaagctagacatgttatagctactgtcaagaaaacgtcaagaatcacaaatttatgtggagtaaaggaattagatgtaaatggaggtgaaactgggttttccacagtgaggcagaggttggggcaggagatcaatccgaactttatggaaccatgacagagtttgtatatccatcagctacttgtaatttacagaggcgtaaagtagggcaaaaatggtgaactcagacagaatccagcaactgtgagcaaagtgcactatatagataatgcatggattttttttaatagtaagcaagtgtggtagacactttttcattttggttcattttgcttctagtgatttctcagaatcatcacctcagttctcatctagaattcagccccatataacatgtatttactgactccttactatgtgtgaagtattaagaagagccaaagaccagggggaaaaagaatgttgttccttaactgcagagctgatcctgtgctggagagacacacgttccaggttcccagctaactcacagcagaggagagccagagggaagaaggaagaaaagagaagaaagaggagaaaaaaggaagaggagagccagaaagggagagttaacggttcctgggctgaggctaggggagtgacacaatgacatttgagctaggctttgagggatggtagctggggaagaagaggcacagggggaggccatctcagagtgaagaaatagcagagtcctgaaactaggggggccaggagctggggtgccgaggatggcaggcaaagggccagatgcagcagaagaggagcacgcagaggtttgaggcaaggaaggctgtctgaagaattctgccttgggtgctgccttgattctgatggcttttgacgagagtagggaggtctgatcgaagcagcgattcagaagatgaattgattgtggaatcaagcgatgggaggctaagagagcagttaagaggccagtataatgttcctggggtgagatgatgaaggcctgtactagggcagtggcaagagggacagaaagagagaaggaattggctttatcaagacttgactcctgatttgatcagtgtgatggggagaggagttgaagaaatttcaaccaaggagacagaagtgccagtaacagaggaagcatgctgtggctgggcatggtggatgggctgcagagtacatttatggggacagataatgagtccactccgagatctcttggatttgagaggtttggtggacatccagttaactgcaagttgctggcatctggaattctgctctgggcctatggagagaggtcggggtttagagatgtccatatgagagtgaccagtccatctaggggtgaactgaatttgtgaaagctgagagagatagagggtaagggttgtttacacagcagggggagacacagaaagagacccagaagcaagaagaggagacgggcagaaagatgatggagggagacagaagtgagggtgggaaagactggaagggaggcaggtaatgagactgagagactaaagaggagccagggaagtgaggaggaggaagagacacaggaaggggaagcctgggaagagaggcaggaagggaaattggaagaggctgtgctcagagagttcctagaaaagggaagggagcacaagccgtctcaaagaaagattagagagagaatgaggagagtgaggaagagagcagggagagatcaggagagacgaataagaaaagacaagacagaggaggtagtaagagaaggaagattaaggtaaaggctcattttcagtgaacaccaaggtttttggggtagataacaggaggagcacatacagagaaaccaggcagcacgaagccaggaaaggctagcgaagggaagtataaagaaaagggtgagcagcagctgactgacatatgcagggacccacagctggacattagactaagctctggaagtcttgtgcaggagttgggggaaggattgtgagggtgggggtgggggaggggagtagggagccccagttctgttgtctgcctgtgaatcctatttccctaactgggctgctttgtctgacttcagtgggagaggatgcacctagtccttcagtgacttgatgtgccagggtgataccccaggggaacctccctcttctcagagacaaaggggaggggcaatgtgaagggggactgggaggaggggcatgcgcttgggatgtaaagtaaataaattaattattttaatggaaaaatacaaataattttaattaaaaaagaaaaactagaaaaggagggtaaggacaagagagcctgttggctgccacagagatggggttaggatgcagtcaaggaagagaatgggttggtccatttctgttgctcttcctttaccaccttccctgaatccagctacgatgacctcttggctctcccttgatctgagcaagcagcctcctcctgctttgagaacttttctttccctccacacatgtagatcactcattccttcacatcctgtaggttgttgaaatgattccatctgagggaggcctatgttgattgcctgattgtgactcatagcccctccactcactcccccgatactgtccccaggctccttagtgtgccttgtatagcttggaatgtactataacacggattactctaaatgtgcttattgtccttgtcactacctctagaatgcaagtgctgtgcaggtacacattttgtcaggttttgttagttcttgaatccctaggacctaggacaaatgtttgttgagtgagtaagtgaattatgttgagtatgaacaatctgtgaacattgaaaggctaaatggagcaaatctctgatgtaactgtactttactatgacatctttggaacacagagaacagcagacaagtctggtcactgtagggttctgttcagttgaaattggctgaatggtgattttagctaataggttaacacaacactggctcactggataaagctatttttcttgatctccctttttctatcaaaaatgaaatggctgcgtgatgattgtcagtagcaagaactaggctttggctcatgaaggggttagtaagccacggtggggattaataggaaaggacaaggacagaaatgtgtggttcctgatggaggcttgtttttgttcatttgcttgtggccggagtacaaagggtattgcacctaatttggcgggagctttctacaccttacatagatgtattgggacgaacttggaagcagagcagagcacttctgaaaggcttataaagaaagtgtgggcctcctctggagagcttaaattggccatgtaactcagatccttccctatccgtgcattcgcgagcaggagcagaagacgacccctagttgtctctcacttcacttgctgcttaggtctggacgcagcactctaactggatgtgcttaggctaaatggatgtagaaaatacactgtcccttaactgtatgcagcagattcaacttcctcaaacattcaagcatatgtgtctctgatgattgacagtgtcctcatctccatcctgagtgtgggttcctagaaagctgctgtgaagttggccttatttggaccttcatttcccatagcagactggcttgtgagagtgatcactttagcacttggaggccatgattgccttcattaagatgtttccgtgtaaaagatggctaaagcagctatacttgttctcagctttaactttttggtattcttttcccccagggggagtggccagagcagatcctatctggtggtgagtggctgtcatgatctctacagcaccgctctacagcggcgtgcacaactggaccagttctgaccggattcgcatgtgtggcatcaacgaggagaggtaaggttgctgtacctagtcccagggaggggttggacctggggacaagattctggtttgtttctgattttcctaaaacacaggggtcacctgctctaccacactgtcccggatccactgaagatgaagaaactatcagatgacatttgccacctagtattatctgtctagtgataaagaactctaacattgtggagtaaagaaaagctcggatgcctgtagtttctgattcttatgtcaaagtttggtgttcagaagttcatgtaagatattttcagttcttgtccagggcttagaagaaagttggtctcatcatgtagctttatggtggggagcaggtcatcaaaattctgggggccagtacttcttacctcaagaagctaccaaaatatgtcaggaagaccttatgacatatcaaaggaagatgaggttgctgaccataactttaatgtaaagttcagttagtgatacctgtctggtctgtgtgtccatgtttcagtttctgatatttggttgttcaagagaggcctttttaaaaattatgcatcataccaaggctagccaattgcctttcagagttgatatttcccttttatcctccttggccaagttgctctgtatggtggttatgaggtttcttcaaacttcaagagattgttctgtcatgcctgttggtgttttaatccattggctatctaaattcaaacatgccagaggattctgataggattctcccctccaatttaagattggcagtctttaaaaagaaaaagaaaatagatcctggtgtagatctgttaagatagttcactgggtaaaaatgcttgcctccaagcctgacaacccgagttaggtccccagaacccactaagtgtaagaggagaagtaagtcccacaagcagtcctctgatgtccacaatcacacatgactgtgccaccttacaccccaaaaaaccagagggaagtgaaagaaatagatccagagtttctcaagtaattctaaaaagtatttgtatgtcgggagaggtaatggtgatagttttagagggaaaaagagactatttttgtttttatattctatgggtgtgtgtgtgtgtgtgtgtgtgtgtgtgtgtgtgtgtgtgtgtgtatctagggatgggatactgggaatcctgagtgctgagtatgttctatacctctgagctacaccttcagcttcatgtttttatagaagtcattttttttcttttcctaactagagaagggtatatttgtctgagattagggttaggagaatagacttctattttcttaatccattcacacctgatagcttaatggtccctgttctgaggagtgtgttagaggtggacttcaaaaaggaatttaattttagaatacaaaaatcaaaagtaaggagaataaggcgaaattcttctgagagacaggagaaaagaagtatgtccctttgtgtgtgaggtctgctcttagaatattcaaagagatgctcctggcaaggcaggctgctgggtgctttgtgagcacgcactgacaggctgcattacagtcacaagtagttggggctgatgtagagctgtatgcctgagccttcaagaacttagtacacaagcaaggtgtgcttactcgcatctataatcccaggactcgggaggtaacggcaggaggacctggggtttgtcaatagcccgggctgcctattaacttttaggctagccttgtctaccaaagtgagaccctgtctctgtaaaacaaggctaacctgagaaattaaaaagcactggacaaattaccttgttccctccctgtctgtgctgtattccttgcaagaagggagtcagaggtagatgtgaaatctgattttctctttttacagacctttcttgggatgctaaattacccaatatgcccagtggttaagatgattttttttaaagcattgtcatttctgatcccatctaccctttgtcaccttcttaccactgtctaggctgtgttacagctgatttccaaatgtaatctcatcctatatgcttttagttcttcttttgagacagggtctctttctgtgtgttgcctgggctggcctggagcttactgttatagcttagggagacgtcagacttgtagcggccctcctgcttcagactgcgtgctagatgtcatgtgtgagctaccgtgcatatcataacatatataatacacatctcacacacacacaagatctatttctgtgtgtgcatgtttcacctccatgcatgtctctacaccatgtgcatgccttgggctcatagagatcaaaaagagggcatcagatcccccagaactggacttgcaggtggttgtgaggatctgggtgggtgttgggaattaagcccaggtccttttgaagagtaggaagtgctcataaatgctgaagcatctctccatcccccagcgccacccccattttaaagacaaggccttgctatgtagcacagaaagaaaatcttcctgccttagcctcccaagtactatgattacaagcatataccaccaagcccagctttatcctatgtaaaaaccatcttcctccatcctttccaacttgtagaccttacaaatttgaggtataaagctgtttttagggataaacttaaaattacattgtaggagtctgccaggtttatcaaatatggttggggcatatagaacagaaggcataaatcagcctttttgactgctctaggtggtctgtcagctttagtcaaaccttcggctaaatagtcttgcttgcctttagcattaattcattccttcattcaataagcatgtattcaatacaagagcaaactggtagttcgtcttcatacattgctgttgaatgtgtggactggtgtgaacaggtcctatggagtctagctggaagaatgatgtatttctttgggaatatcagaggacagtgtcacctgagcccaggctagacatgtgattaggagtttgaggtgagggccgatatccatgcatccttgattattaggggaaggccttggctggagtgaaggggggttctggtgaaaagtctcaggggttggtaggtaggtaaggtgcctcatgcattctgggttggatatttctcttagatattgttccaggcccaacaggaactgaaaaccgtccagtgtggcaggtcctgccgttaatctttaataattaggaaaatggccctgagagatggtggctggttttggttaagttcaacaaagccttgagcacaccagctgtcttctagtgagaagaaacagtggaactgatttctaatcctgcttggagcctcttttggcctatgtttcccccctcacctgtatccccataaccttgctcagttgacccagctccctcccctgcctttctgatcccaggctcctctctcagtggaacatttttttttttttttaatatttgcttagctttgcatccccttcagaggatttgaaacaccatcgcacacattttcctccctgagcttggggggctggtgctgcagcttaggcatggctggagtagccagaagtgctgcctttgctgccaccaccagcctctctgcctggctctaggcttcactgctaacctctggcttgtgagaatatagcttctgctttcttcttctgggcagaatttctgcccaaggaggagcccaccaagcaggagggagcgtggtcaggaggagaaagaatgtaaacaaatagggccttcccatgtggagttgtggaggggagaggtgcgccctccccctaaaccatccctggagagtctagttggaacatgcttctccagcccaaggctggctccatataggtcctgcttttctgctctctcaggagttgatgtgaaaagtgtgttttcccttctctgtagccctccatctctcctcttcctcaagacccctaactgcggtccaaagcccttgcctcacagtcctgtgttaccagcagtcatttccagtggtggaactgtcccacttctgccaccctagctgtttgttaaaggggacaagcctttcccccttgattagccccttctggagccggctccgatcctcattgccattcttgcttctcttgccccaggtacagttagaaagtctgtgtttcagtcggagggagggagttatttgcaggggtgctcctccttgctggagttgactgcaggcacccccaaataccctttagactagagtgtggtcgctaaggcagacgctgctgacttttcttcacgggctgtattggatctctggcagggctccaaagatggcaggcaaacccaaacaaagagcaggcagagcagccctgtgctttgcccacccagaaaacttgctgcagctttgttctttgaccccctacctcctctgcagccactcccacccaggcggctgccctattgatatggctcctgagcacaggggccgggttcctgctgcacttaaagcggccagcggccggtatggagccaccacttgtccttcgactttactttagcgtgtgatccttttatttgttcgttttgtcaaatggcacatgttttaggattcttacctgaagtttagagaattcttcttgagcagtttgggggagggggttacggttgaatttttctcctttgagatccagctttctggcctttagactttctttatggcacataccaatagaaatacagagttctgtggctttgaggcgctccctttgggaggagagaggatgtggtgatgcagagaggctgaaaggaaggtgcgcccatgtactgtgagaagagagcatgttgtgtggagccaggttgacttctagaaatgctcctttggagaaaaaaagaagtgtttgctttgttttgctggtttttcaagtaacacacggggtcttactcttactgtataggcttgctgagtctaagctggccttgacctcaaagagatccacctgcttctgcctcctgggtgccaggatttaaagacacacatcaccagtccactgcattttccttgttgtttgagacaggatcttctgtggcccaaatgactgaattccttaccttcctgtctctacttcctaagtactcacattacagacaggacacatgctcagctaaatgtcgtagttttaaagagcctctcggtgtcagtgaccagatggcctcacatcagtgctgtaaatgtgagtgtggttgggcttcaggcccgccttgcccgatagaggagcaaacgcttcagattttgactagattggaaagcactgtggaagtggagatttgcttacaaagaggtttaccctgaatggcacttcccatatagacttgaaacaagattggatttaaaataaaactaatttgtgtacccttgaggattctgggttacatctctctccttttgggcaatgccttgtatatcctggagtgaatggtcaacttgatggttaagctccaggcgaaaggagaaggtgctaaggtggggttcatctgcactttgggtgagaacactagaaagcacaataagtggcccccaaattctggtcagacaaggctcctcctcttcagcaacttgcaaagttgcgtgtggcggctccgctttgcctggttcagctcctagtcttctgccatcccctgaggtcaccatggaagtgagacaggagggtttggaaagctaggcaggcaagaccttctagaagtgtcagtgctctaagtccgggccttatctcccttttctgctgtgtcttccctgccagaagagcacctctttctgatgaggagtccacgacaggtggctgccagcactttggatctcaggagttttgtgtcagcagcagtttttccaaggtaaggagctatgtgctgtcacatgctacccatcaaagggtgagcttcttggaccatgtgcctagtttggccttcctgagactgggagcaagaagacacaagttgctgtaggtgagacagaaacggctctgcgcatgccctgtacattgcagttggttgagttgtcgagaggaccagcaggtacttcccaggggcctcagggtacctgcatcagttcccaggactttgctaagatggccatgctattctttcgtcgcaggtggagctcacggcagttggaagtggcagcaatgcccgggggacaaacccagatggcaataccacagaaaaacttgggcacaggtcagaagatcagtctgatgaccctcagccaaaaatggactatgttgggaatccagcagaggctgagggcctcctggtgccactgagcagcccgggagacgggctcaagctgcccactcctgacagcactgaggccagccacagcagagccaactgctcctggactcccttaagcacccaaatgagcaaacaggttgactgctcgccagccggggtaaaggctttggactctcggcacggtgttggggagaagaacactttcattttggcaactctgggaactggagtccctgtggagggtaccctgcctctagttaccactaacttcagtcagctgccggcacctatctgccctcctgcccctggatcggcctctgggaccccctcggttcccgatccattccaagttcccctttctgtcccagctccagtgccccactcaggactagttccagtccaagttgccacatcggcttcagctccttcccctcccctagccccagcagcgccctcggtgcctactctcatctctgattcaaaccctctctctgtgtcagcctctgtcttggtgccagtaccagtgtctgctccccactcggtccctgtgcccttgtcggctcctgctccgacccctctcacagtctctgtgtccgcacctcccttggctctgatccaggctcccgtgcctccctcggctcccaccttggtccttgcttctgtcccaactccagttctagctcccatgccagcatccacacctccagcagctcctgcccccccatctgtaccaatgcccactccgaccccttcctctggcccaccctctacccccacccttattcctgcctttgctcctacaccggtgcctgcgcccaccccagccccaatctttactccagcccccacgcccatgccggctgccacaccagctgctatccccacctcggcgcccattccagcctccttcagtttgagtcgagtgtgttttcctgcagctcaggcaccagctatgcaaaaagtccccctgtcttttcaaccagggacagtgctgacccctaaccagcctctggtatacatcccacctccgagttgtggccagcccctcagtgtggctacactgccaaccactctgggtgtgtcttccacactcacactcccggtcctgccatcttacctgcaggacaggtgtctcccaggtgtgttggcctctccagacctccgctcttatccatgtgcattttctgtggcccgacctttggcttcagattcaaagttggtctctttagaggtgaacaggctctcctgtacttccccatccagcagcactaacagccagcctgctcccgatggggtccctggacctttggcagatacctccctcaccactgcttctgccaaggtgcttccaacttcacagcttttgctgccagcccccagtgggagctcagtcccaccacacccttccaagatgccaggtggcaccgatcaacaaacagaagggacttctgtcaccttctctcctctcaagtcacctccacagctggagagagagatggcctctccacccgagtgcagtgagatgcctcttgacctctctgccaagtccaaccgccagaagcttccattgccgaaccagcgtaaaacacctcccatgcctgtgttgacccctgtgcacaccagcagcaaggccctcctttccacagtcctgtctaggtctcaacgcacaacccaggctgccggcagcaacgttacttcctgcctaggctccacctcttcaccttttgttatctttcctgagatggtgaggaatggagacccaagcacttgggtaaaaaactcaactgctctgatcagcaccattcctggcacatatgtgggagtggccaacccagtgcctgcatccctgctgttgaacaaggaccctaacctgggccttaaccgagatcctcgtcatctccccaagcaggagcccatctccatcattgatcaaggagagcctaagagcactagtgccacttgtggcaagaaaggcagccaggcgggtgctgaaggacagccaagcacagtgaaatcccgttataccccagcccgcattgcccctgggctgccagggtgccaaaccaaggaactgtctttatggaagcctacaggcctgacaaatatgtacccacggtgttccatcaatggaaagcccactagcacccaggttctacctgttggctggtcaccataccaccaagcatctctgctttctattggcatttctagtgccgggcaactaacccccagtcagggggtgcctatcaggcccaccagcattgtttctgagttttctggtgtgtcacctcttggttccagtgaaactgttcatggacttcctgaggggcagccacggcctgggggcccttttgctccagagcaggatgctgtcacaaagaacaaaaattgccgaattgcagccaagccttatgaagaacaagttaatcctgtcctcttgactctcagccctcagtcagggaccctggcactgtctgttcagcctagcagtggggacatgggagtaaatcagggatccgaggaatctgagagccacctctgctctgacagtacccctaagatggaaggcccccaggcagcctgtggcctgaagctggcaggagacacaaagcctaaaaaccaagtgctggctacctatatgtcccacgagctggtcctggccaacccacagaacttgtgcaagatgcctgagctgcctttgctacctcatgacagccactctaaggaactcattttagacgtggtccccagcagcgagaggggccccagcacagacctttctcagcttggaagtcaggtggatctggggcgggtgaaaatggagaaagccgatggcgatgtggtcttcaatttagccaactgcttccgagctgatggtctcccagcagttcctcagagaggccaggctgaagctcgggctaacgctgggcaagctcgagtgaaacgggaaagcattggggtctttacttgcaagaacagttggcagccagacgaggagacagaatctctgccacccaagaaggtcaagtgtaacaaagaaaaggaaattgaggaagaaccacggcagcagccaccaccacagccacacgataagcccatggtccggagttccttggggtccaaggtgagtgccagtatatggcctagaattcctgatggtcagcttcacttaggggtctctgctgcatcccagcccaccccctccctacagtgctcttgagcagctcagccgtgtgaagggagctgatgaacgaacgggaggcttccccctttaactcctgctctctctctgtgatattctcacctggaaagggcctagctcattccataggatataggaaatgatttcatctttggggctagagaagccattgtcctagataaagttggaaagcctgagaaggtattggtgaaggaaatcacttcatcacaggctcttccccaaggaacaattcttcctggttctttaaagatgatgaaccactgtctttggcagtttggggcccagggaggaaaggaaacgttgatagggtcattttggccccacttcttcatagctctgtgacattgattaatttctcttaccctcaattccttcatctctgcaatgagacaaataatacttatttagagaattgttggaaagattaaatgagctgttgatatgaaatatctagaacaggcaaattgataggaataagaaatagcctgatagttgccgagggctggggagggctggagggtttccatgcagggcagtgaaaaagtttctgtaccaggcaaatggtgatagttacacaattctgtgtttgtacagaaacaattgcattgtacatgtacgttagtgaattgttacagcagagctcagtaaagctattccaattaatgagatggcatataagtgcttaaaatagcactgggcacgtaattaagtgctcggttggtattagcggctgcttttgtttttagtatcacaaacagaatggccctgccctcatgcagcttaggtcttgccgtgttgacttaatgacaactgggcatagcccttccggtatgtgatggatagtttaataggctgattgaaagatgtggggggaccgagaataaagttccaggagaaggagaaggcaccagcatctccaggttttccctttggaaaccagacaatctaagtgtttcatcaggtcccattttcttgaggaacatgtgaactgataaccaagctaagatgaggcgttaattccaaacagcccattgctggggatggccaagaggcagaataagctccggttgcttgcttgaattatttttctttcaaatattttttaatacgtttgtatttcttttctgtgctcatgtgtatgtgtgtggtacatgcatgatgccacacctgaatgcagatcctgggacagttttcagctgctctctctctacctcagattgtcccatgtagcagcaagcacctttacctgctaatccatcttgcctgccaaagaatgaggtttcatttgatgctgcctgtactgtattcttgtcccttgaaacatatttcaaacatctcttaacccaaacactgatcttgctttctccatcctcccaacttctcatgcagttggagtgtgtcatagttttactttcatggctgccctggcaggagatacaaacggaaatctcttctagatgttctgttttacttattatttatttctttattttggtctaccttaggaagtaaaagttcatggtctatacttgaaagaggcagctaagaacatatttagaaataagtcagagatgttcaaattgacgcatttacctttatttcccctgccttaaaatagtttttctttggctatacctgaagttcagattttaaagtcatctctgtcttcctcttttctccctatagttctttgttttctaacaccttggttcatagaaattgccagtgacttacttttcattgcgcttagtcctctgctgagtgagcagagggtgggaagctggtgggaaatgggtgctccctgtgcctagagaactgagggttctttcccctcaaatatcccatcagtaagatggctgccaacctgcttcactgaaactagaggttgataaccctactggaaggttatatggatgtgattatgggtaggggggacatgtgtcagtctttcatcacagtgacttaagtatctgaagaaaaatgagagaggaaaggtttgttttggcttatggattcaaagatgtcagtccctcatagtgggaagagtgtagtggagcacaacagtagctcatagaaaccaaaaggggaggggggagggagggagggggagagagagagagagaatgagaatgaatgaatatgaatgagtgcatgtcacatgtctgcagtactggcctctcctttttctattttgtgtttgggtgtgctcatgtgcatgggtgtttgtgtataccggtacctgtgcagaccagaggtcagtcttgggtatgattcctcattagctgtccactttgtgttgtgacacagagtctttctctggaaccaagagctcattagttatactagagggatccacatagctctgcccccccagtgctgctagcaaaagcaggcaccaccacacttggctgttttctggtgatgactctcagatcttcatgtcttgtagcaagtatttgacctactcaactacccccccccccccatcaattttctgatttccacctgggccctcagcctactgtaggatgttccatacatagctttagggcaggtcttcgttcatccttagttaattcttcctagaacacaaaacaaaacacagatatacccagaggcatgctatattaattaggagcttgtcaatccagccaaattaataaattaagataaacttcaagtaggttgttgttgttgttgttgttagacaggttcctctggctgttctggaacttgctctgtagaccaggctagccttgaactcacagagatcttcctgcctctgcgtccgcctcctgagtgttaggattaaaggcatgagccactatgcctagctgactgcaaatatgtttaactctttctgtcttcttaaaacctaacttcacgtgccccagatcaacaggactaggaacacctaccttaccatttcttgtttagtggcatggagaaacctcacagcttgtgaaaatctgtggctttgaggcagagttcctacaatgtgtatgtaagctgataatccagtagtaggtggggatgggactggacagaaacagaggacagagacaacaaatagggaaggagatcactgaaagctcatgagaagagatccagagatgggagcaggagcaccagggcttccttccagctctatctatcttactgcagatgtaagggtgacctggtcaacggcatcccttcagttagtgtgtatgctagcttgtgtgtggcccaggaacagtcagttgacctcttctctgagtgtctgtctcttcatctgttcggtgaggtggttcttaggacgaagcaaatgatggagagtaaagcatcctttaaatacacccaacttcgctgtgaatggcgtcccagagctgcccctgttcaccgtgttaatagggaggtgggaatcgtacctcctacgtaatggtttgagtccatttcctgctattaactgacacatgagaaaaggtttccttgacttgcctgttctcagaattattatcaattgatagcaatgccatccacaaggaagatgtttgagccatgtagttacctaacttacagaaaaggcatttttgtttaatgcctatttctacttgggtttgggtgtgcagagtatggatcccaagtctggaccttttaagaaaaaacctttggatgtgtgttgaggggtcatgaatacagattctgtagatctctgatacaaatcactgaaggaactagcaaggacactcgactgagtccaacagaacctttataacccagtgtgtcctgtgacatacatacacactcccagtcctaactccggcatatgacatgatccttcctaagactggagaacattgttaagcagcaaggctgacctcacacctgacttgtcctaccttaacacagtgccggaagctgcctggagacccccaggaacccaccaagaaaagccccagaggggctttagattcaggaaaagagcacaatggagtcaggggaaagcacaagcaccggaagccaacaaagcccgagtcccagcctccaggaaaacgaacagatggtcatgaggaaggtaggtctccaaggccatgcatgaccttcaagcctgaactccagagggatccaatggaattttggtggggagagagttgctgagagattgagtggaaaatggatccttctttgctgtggaatagaaagagaattggaactcagaagttaacagctcaggaggataggtctgttctggtcatgagtttgtgagtaccccaccttctacagtcttaacattgaacaaagtgatttgcaaatggacacagaacactcaccaaccggttccatgaggtggcatctaggctcaaagaagaagcagctgtaagaatatttattcaaaaaccgtagaattgggattcattaccctgttttttctaccttttggtatgttagaaaactcccattctaagacctgaaacaaatagctggctgactagctagatagatagaaaggttaaacgatgtctcaaacttttttttttatcagctaagaatacccagaacgtttgatttaggtatagggtatacttgatctatatactctactgtagatggcccctcagtgccttcattggagataatccaggcattcctggccacagtagtccatgttcatgatcttgctcattggacatgacataccacttctattttactcttatatacctgtttctatgtgtccaccactcccagccttaccttgttttgtttgttttttattttttttgttttttgattcttgtttttttgttttttgtttttgttttttgtttgttttttaaagatttattttatttattatatgtgagtacactgtagctgttttcggacacaccagagagggcatcggatgtcattacagatggttgtgagccaccatgtgctgggatttgaactcaggacctctgcaagaccagtcagtgctcttagctgctgagccatctctccagcccttgtttgtgtgtgtgtgtgttgttgttgttgttgtttgttttgttttatttatttatttatttattttggtttggtttggtttggtttggtttggtttttcaagacagggtttctctgtgcagccttggctgtcctggaactcactttgtagaccaggttggcctcgaactcagaaatctgcctgcctctgcatcccgagtgctgggattaaaggtgtgcaccaccactgcctggctcagccttaccttgttaaggtccatcgaggccgtgcttctttgggacagctacagctcagttagaacttgaggaacacacaccaacctttgtgttgtgtaggcagagattatactttggagcaatctgttaaattgcttctgtgtgttgctttcattggtgtcagcaaaaatgacccagccccagttttgaaaaatcaccattcccagaaagagctgggtagtgatagcagcttaaggagagtcagttgtgttaagttagggtaactgcaggctcaatacaagcctttcggttttctcatttcagcatcccatgtgggctttctggtttatagatttcttttttttttttttttttttttttaaaaatgttcaacattcttttttttttttttttaaagatctattttattattaatatatgtaagtacactgtagctgtcttcagacactccagaagagggagtcagatcttgttgcggatggttgtgagccaccatgtggttgctgggatttgaactctggaccttcggaagagcagtcgggtgctcttacccactgagccatctcaccagcccggtttatagatttctaattgtgatatttctgccttctgcccctaaaccacacatcactccaggttccttggaaaagaaagcaaagaacagtttccgtgacttcatccctgtggttctgagcactcggacacgcagtcagtctggtgagtaagactaagggtacctttgaaaaggtagacatgaagtttgaatggttttaccattggcgtaagtagacattttgtttccctgtgacaaaatgacaggcattttgcaggaataacagagtcctgggttgggcagaaggcttgcctgaaattttagaacagtttgcttaacaatgttagattagagatttaacatcatctttggttaagagtcagtgatgcgaagaagaacggcccctgccactcaggaaatttgtgctctaacattttgcatctcatgatcattgaggcccatttgaagtcctcagactttcaacctttgggctttaatctcgtcaccctatgcataaagcattatcaaaattggaaggttcattgaatcctatgggctggcacaattacttttgctccacagaacttgtattggtttcggtctaaagaagatagttgtttccagtttgtgttcttctctgctggctctctgttgggtcacaggacagagatggttgcctgcattcacccagattgccgtgcaaattggaaggaatagagacgactaatccaacgagctgacgtcctgttaactggtccctcagcacatggcaagctctatagtaactggggcttagaatgatggcctggcggcctcacaaagtcctgaagtgtcctctgaatcatcaaagagtgattacattcttgccagtcccatttttgtgttaaacacattgtactgtatttgattctttggaaattggtgatttctgtgcgattctgtattaaccagaatattaggttaactagaacactctgttccctgcctggtccatataatgcaaagtttagtgggatagttgttgtctttaagcacttgagcaacttgaagctttggtctagggtggggtttttgttgtttgtttgtttggtttggttttttcccctccaaccacctttttcttctgctgaccttactagggtgtagatactgctgagttaacagctaggctttcgggagaaacatagtactgctccttctaaggaaggtgtgagatctgtggtgtaaaaccaggccaatttagggttgtgcttttactgttagccaagttaagggtaagtagggagagagcgaatagcctcttggcaaggtgacccaagaggataggaaagatgctgtttgtcctggggtgatcggccttgtacttgtccagcagcaaggaacagctgcagtggatgggcagacagactagagagaaaagtccatccttgaacttctgcaactatgtaagaggtaggattagtttaatggaagagggcctactgtactccactgggacatgcctgaatcagattgtggcataggaaagggactccctgcctttcctctctgtcagagacactcttcttttatgtcaattctgcttggccaaggtagctctcttggccatattggtggaaccacaaggttattaggacctaagttgtcaccccagacttccttactcatttgctcccatttgccaaccagcagaggactacagctctctcctgcccttcatgcagtgcttggctcctcatcatcactgagagtttgtgagtgggattcaagttaacactgcactggggaggagtgaggatggttcctagtacttcatggtattttggactctataaagtacgtacttaagagtggaagacttcacttgagcccccagaacagtccttcgagataagtgtacccctaataactgacagagcctgaccttgaactcagttctacaaatttctactccagggaagctgtgtcaataccatacgtaatgccttgaagaagtacctgaatgtcttctgtacatatcccatccgtaggtagcatctgtagctcttttgctggtatggcagacagtgacatgggaagccaggaggttttccctacagaggaagaggaggaggtcgctcccaccccagcaaagaggagaaaagtcagaaagacccaaagggatacccagtaccgcagccatcatgcccaggacaaaaccctgctgagccaaggccgcaggcatctgtggcgagcccgagagatgccctggaggacagaggctgcccggcaaatgtgggacaccaatgaagaggaggaagatgatgaggaagagggcctcgtgaagagaaagaaacggagacggcagaagagccgaaaataccagaccggggagtacctgattgaacaagaagagcagaggcggaaagggagagcaggtaaggctggctctaggctgctgttcctgttgtgacgtcagctggagccttaggactgacaggaacctggtactatagtcttcacatgtgggatacacagatccatcttgagtatgtgcctttgaatctagaatgaatgaacacaaactagtctacaaactagccttttaaaaatgtatatctgaacctgtggtccaagccactgtgatattgttggcttgggccactgtcttatcagcgagttatgattggcttgacagagtcaagtttttggagactataggttctttttttctgtgatattcagtttaaaagtaagacaagccaggtgtggtatatacgtctgccatccaagcagtcaggaagttgaggtaagaggacagtgagtttgaggacagcctgggttacatagtgaaaccctgtctcaaaacaaagagggaggggagggcattggctgccacacctggcatgcttctgctcacaaactaaaatgaaatgtagtaattctaaaggcaatagaaaacctgaaatatgtaaaactctctgctttctcaggtaaagccacaaggggtttttttagagttaaagttttgaggtgacataggtggccctgagctgtgaaagcaggcagttcaaaaagaaaactttctatggccatggctcatgcttaaataccatcatggaaggatagacagtcataaaaagcttgttcataccagggtacttcattaagtgccgctcaggactgttcccatagtggctttctaattgagcaaaaaaaaaaaaaaaaaaaaaaaaagctcatctctggattccatagcaacacatttgtctcttcttattctctggcctcttcccttgaaataacaatcgattgtctcttacagtgtattcacttttagctggtgataaatatgtatagtccccttattatctaaaacaaaccaagctcacattctgtaggccatagttcctgggcatgctataatgccgagaaggcttaacctcgtttctgactctgttgaagtggaggtgtatatgatacctgtccccacgctcaagagtaattgagctcattttcatcaactgtctgaacaagtggggcaattttgcccttcttttgccggaactgtaatggattggtcatgaatgaattgtcaaaccattggcctcagccgcttgttaggacgcccagcagtgtgtgtattactcagtcctctctaatgaaggctgcttgcctagcttgggagcctctcctggagctatcagctctttctttcttcttcttcttcttttaaaatctattttcctttccttttctttctttccttctttcctttctttctctttttctttttaaaatatcttttttatccctttgagacagggtctctttactataaagctctggctgtcctgaaaataactctgtagaccaggctggcctcaaactgacagtgatccacctgcctctgcctctcaagtactaggattaaaggcacatgatactagctctttcagtcagaaggacctctttggagttgcctggacctatttgctagctagtccataacactgagatagacgttgccacagcatgcatgataggggcttagctagccgttgctagaccatctgcagtaacatactgaataccagtgatcaaggtatcttgcttgtttaagggcagcccaaactattgagaagtaggtcattctccctctctgagtatttttgggagctatgcattgaagccactggtgttagcaaatcttttcatgcagaaatttcttaaaaaaaaatatatatatatttaaacagggtttctctgtatagccctggctgtcctggaactcactttgtagaccaggctggcctcgaactcagaaatctgcctgcctctgctttgcctcccaagtgctgggattaaaggcgtgcgccaccatcgcccggctaaaatatatttttattgatttttttatgtttatgggtgcttttcctgtatgtatgtctgtgcagcacatgcaggcacttactgaggaggctagaatagggcaccagaacctccagactgcaatacagatcattgtgattctgtgtgagtgctgggaatcaaacccgtgtcctcatgaagagcatctagtgttcctaaccacggaggcatctctctaaccccgggccggggggtgagttttgacaagcacgcccctcctcagaaagctcaagtctccttacctacactatttggctttcaggccagggtcagagaagtaggaaacggacaagccaggtagatcaccctcctctctaactctcatggcctctcctttcatcttgtgcttggctcgcttccttttcattctatgaaagaggtagaaacagctctttccatgtgcctacctgtcccctgcacactctgtgcttttgtaggctagcataaagctctggttcttctgcaactgagtacactccagagtttgccctgcccttggttacatggagtagatgcctgtttatttccttctttattgaactccgagatgtggttttccgtgctctccacggttttcacaaggcacagttctgtttcttcctcttgctttaaccctcttgttgggtcagaagctctggattaaggctgagtatggtgggtgtatgcctttaattatagcactcaagaagtagaagtaggcgaatctttatgagttctagactaacctggtctacatagtgagtttcaggtcatccaggaccatatactgagaccatgtctataaaacaagccaggaggtggtggcgcacgcctttaatcctaggacatgggaggcagaggcaggccgacctctgagttccatgtcagcctgctctgcagagtgagttccaagactgacagggctacacagagaaaccctgtctctaaaaataaaataaaagaagcagtgcagaatccctagcactcagggtgcagaggcaggtgcttctccaggcagccagggttttacagagaaactctgtctcagaacaaaagggagcagggatacctgctgggcaagtgagaattgggtttgttcaatgagtgtcgctgggtatatcaaccacacactagtccaggttgaatgcacacagtagttggctaacacaaaacatactccatgtttttttttaatgggctttttgttttgttttcatatttttttgccatgctgattcatttttgtttttcatgtttgtgttttaggtttttggagagagggaaaacattttaaaaagactaaaaatggggtaaaaagacctgagtttgaatgttcttgctggaagtgtcagagaccatgtagcacagcatttcttggccatattgtgaggacccactaatacactaggtggaagaaggatagtatgatagctagggcttctttcctaaatccataagctacagccagttgtgcaatttccttttattgttgttattgttttgagacaagttctgtctgcatagtccttgcagtcctggaacccacgacatagaccaggccgtcttccaactcacagagattcaaggcttgcgctacctcccaccccagccaattcactggtcttgaatagagactcctacatctgcatctgcctttggcagttttacagatgagagtccatttcaagtttggggtggcagtgagttgagaactctgggattccagtctcttcatttcacacatggtagaaactgaagttgcagctacttcattcatagccttactgatctgttgtgtgctaggcttggtgttcaggtttgtgacggagataccccttccccctagagcttgcactgaagtcatataataaatagtgcagcaacaaataagagagaccctccctcaatacaaggtggagggaggggcctgacacctgatgttgacctctgtaactgctcattacagcacctacaaatacagacatagccacacacacaagccatgcatctccattgccaatcgatacaagtgaatggtttatgtcacctacacaagaggtttaaggcagaccctatggggtgaggctcttgctagtggagtttgcagtagacctttttgaaattacaattttagacacatgttgttgccctgtgataccaattacctgatttccaatcagggaaggcagtatctttctgccattacacacaagtaggcctatactgcgctggggagtgtctgttgcatttaccttggtatcttcagacaggaactgacaggcagttagaggtgaggagaactgagctcgtaaagttagccctccactttgtacttgaaccccactgtacttgattgatacttcagcaaaactgccaagttgcttttgattttggagagggagggggtagagaaaggctgaaaagagattctggtttgctctgagctatggggagatcctttcaaaatgacccgcattttgggggccagttagatgggctgccccctgctggcaggtctgggaagcgcctcccacggatagatggggaatttgcatggtaaagcactaaaggatggtgttccatttctgtgacagtcgttctttcctgtttcttgttcagattcaaaggcccgtaagcagaagacttcctcccaaagttcagagcactgcctcaggaacaggaaccttctcttgtccagcaaagcccaggggatctcggactcaccaaacggtttccttccagataacctggaggagccagcctgccttgaaaacccagaaaagccgtcaggaaagcgaaagtgcaagaccaagcacatggcaaacgcctcagaagaggcaagggtatgtagccaccaaagggaccaatatgacgaccgtgggctagagaggccgactttctagcacgtctgtctagctgtaattctctcccagagggcaaaggaaacaagtagatgggggagggggccactgagctgtatgaaagtattctaaaagtattctagaaacgcgggacacattcaaacagtggaaactgaagttatagttaattatggggtttgacccctgatttcttttccctaacaatccttgtacctcatttttaaatatggcagggtattagcctgaacagattgttaacatccagtcaagaagctcctgtctgactttctgagacaactaaggtagagtgtaacttgttgaagccaggattttgttacctagaccaaggtttaagggtccaggttagctgctgtctccatcctgtcccctgttcctttgcctctggaggaagcctagcagcgaatgaattgggtacttagcagttagccaggcaagcattctttgaacccttttcaaaattaccagttcatttgcttctgcggttcataacacttgcagcgctgtcagattctacaatgtaccgctaaagaagaatggcatagtcctttgaaggaagtgagttgcaggtccagcgtgtacctgtgataggtatctgccattgacaacagaaaatcaaatgaccacgttgggctggtttggttagttacagctcttattcttctgtctggctttcaagtaggaattcccaaatgataccagtgagggatagatgcttgtctttgcccacctcttcctcccccgtgaatccttgttgcagcttagacaagacactcaagtctatttgctcatctttaaatggagctgatgctccctgccccttctgtctcacaggagtacttggggggaacaaaagcaatgtctgtgacaggctttgataacggaaagtgttctctgagggtcagtatgcatccttgcacttcaggcagagacaggaatgagagaactagagggaaagccagaccaactgtgatctggcatgccagggaatccattatcccaaacccatagactacaggactgataggagccactgggagagtacagacacgtgcttggctctggccgcctctttcttcttgtcactttttatttatttaatgtatgtgcttatattgtgtgtagaggtgagaggacaagctcgggtgtaggtcccttgtttgagacagtctctctgtttttctgctgcatgcactgggtaagcaggaatggatttttttctgtctccacctcccatcttcccatagagtactgggtttataggcacttgtatcacaagtccagcttttatatgggttctggggattcgaactcatatcctcatgcttgtatggcaaagttgcttttactccagctctcctgttggtgctcttaattcccaagtacttcttagaggtaggcacttatattccagtcattttacagtaaagacttatgagaggtgactcagtggtcctccttgccagaatcaggacatgaaacaaatttgtctgcctgaggaagaggcctaggttgtcaatgtgtcttgcagtctctgagtaactgctttctgcccgtttctgggcctccctaggaagtaggttagtaggcagaaaacactaccatctttaaacagttctgagacaggtagaggtccccgggtcctgccctccttcccatcttccctggccccatcccacacaaagggctcagcagcacactcatgcttctgtgtgcttgctctggctggcaccgggtctgctaaaatgttctcctggagagggttttgtctctccctgcagcctcccttccccctcctgcctttctttctctcccagtcaccacacctgctccagttgcccccatggcacggggctttgtagtaggaagcaaggcagggggaggatgggggatgctcctgcaacactaaagcgcagcattggacaagagcctcttcccacaggggctcagagccaggaggaagaggggggaggggtccccttacatggtctcacccctccccctctcgggcagccttcttgcctgctctggcagcctggctttcagaaaggaacttactggagctggcttagtgtcacaaaacctgagtccatttccccatggtttccagtcctggtgttatagtttccatcttcctagcaataaagcagtatcatatagttagtgttttcttgctagggattgtgcctccaccgttctgccatggaaactgatcaagacttgttgaaatttacccgagggcatagattccctggccctgtatcatttatctcttagtgccccttccttgactttatggaactttctaggtaactttttttgactccccaggctttgtacagggatagcttgaatcaaggcaacacataattgtaatgcgcccagctctgacttcagtgccgtaagcaacaactgagaaggtgacagtgggaccggtgcccctaaggaacttaagaactagcgagagctacgtgtagagggtaaagaaggcttgtttgatcctggagctgaaggccagcttaagcaaagtagtaagacagaatcctaatggaaattaagaaaaaaaaacttcctaggggtttcaagactcaactacccatggaaaacagcaagaaaataagaagtgagatgtcagaggataaactctgagtaggctttggacttgcagtggggccagagggcagaaaagtgcagaggacaggattggactgagcttcggatgctcgggggggctttgagtagatgctcgtgtttttagcataaacagtcactctgaaatctagcggccccgcataaccagaagcagatagccacgtatcatcttttagtttctggagctcagggtttcaggaacagcttagctgagcccagtgtggggttttgtgtgaggtcacagtccaggtgttaggcaggactacatcggtgtgtttctggtgtatgtagtttgtgcacgtagctggcaaaatgatgctgaccattgggaggaggcctctattcccttcctcgtggatcccctcaaaggtcttttctcacagaaaataatttgagagagaaccaaaaaggtgccatagtgtcttttggaacctgactttggaagtgacaccccattccctttgtagtcttacctgggtaaaccttatcccagtgtgggaagggagctacacagagctggaccctcagggataggatcgtcagggttcattgtggtggccaccccgttactcttctatctgctttctagtggattcaagtctctcatccatgcagggtctaaaaccctgctaacatcccctcaggtgaccttcagttcatagctttgacttggagccaggtgcagctgaggctgctcccatcttggaatccagttgctacagcgcagttattcctcacctagaacctgagtttgagatataagtgacctgtgcccctacagaccagaccaagggaggcacagtcgagcaagcacagaaagctcctatgtacgtaccttcaactcaaaatggggcagagggaagcacctctgtgtggcttctgcagacagacctctcagaacatttgtagtccacagcctttgtaggacttcattatttcagaagggaaaaatgaatgctccgaggagttaggctttacttaagggtcttaaagaatatatttattcatttattttatatgtacatgagtacaccattgctgtcttcagacacacctgaaaagggcatcagatccctttacagatggttgtgatccaccatgtggttgctgggaattgaactcaggacctctggaagggcagtcggtgatcttaaccactgagccatctctccagccctactttaggggttttaactagtgggtggcagaggcaaacttcaagcccagccctgtctggttccagggcctcacagtccactgcccaggatgggcctgaatataatcttaggccatggtatgaaaaaagctgatgcaagcttatgaggttggatatgggggcaggtttatagaggagtgaagggattgagaattgtgcctggtcagactgctgcctctgtgtgtctctttgttctcattacctatagacacagcttgtccaaaatgtcaacaagtggacgttggggccaggtagaaaaggcataccaagtgcttgagagaagctgggctgtctcgtcccaattttcaatcctcccgtcttgccagggtttatggggctgaggatctgatatttctaacatgttgtcttcttagtcagggtctctattcctgcacaaacatcatgaccaagaagcaggttggggaggaaagggtttattcagcttacacttccacattgctgttcatcatcaaaggaagtcaggactggaactcgggcaggtcaggaagcaggagctgatgcagaggccatggagggatgttctttactggcttgcttcccctggcttgctcagcctgctctcttatagaacccaagactaccagcccagagatggcaccacccacaaggggcctttcccccttgatcactaattgagaaaatgccttacagctggatcttgtggagtcatttccccaactgaagctcctttctctgtgataactccagcctgtgtcaagttgacacaaaactagccagtacacatgtatccacccatggaaatgcaggggctttccttattttgaaaataagctcacatgactagtgactaacctagcctccaggctcccaagctgacagtagactgggccacttggcatagtgtcaataaaggaaaacatgagtgccggatgtaacgaggtggctttcgcagccaaatggcatggccatgatgaattggatatgttgcctggcctgacccaggacttcatttctgttttccagagcaaaggtcgttggagccagcagaagacacgatcttctaaatctcccactcctgtgaagcccacagaaccatgtacaccctcgaagtaccgaagtgctggccctgaagaggcctcagagtcacccactgcccgacagattcccccagaggcacggagacttatagtgaataaaaatgccggggagaccctgctgcagagagcagctcgcctgggttataaggtgagtaagtctccctgaacaggcgatgacaggatgacgacgttggcctggaccttagggagcagctatactgttggttcctctgcatccgatggtctccctctactctgcacatggcctctgaggatgccccttatgtgcgctcctctttaaaatgtcagttcaggagaaatgcatttgaaaaggtagcacaatatcgtccactgcattcctaggctatgaaggggatttgaaattttcactttgtcttaggttaacaaaggggaagtaatggcttccccaacgacacgtggtgatgattactggttacacattatctatctcctgtggtttctcctcatttgggctttcaggtagaagggttaagagcctgttcaataatcctgggctaacccacccgtactacatactttcttaaacatgggaatgagaacaaacaaggcaggcttccttccttctttccttctttcctttccttctttcctttccttctttcctttccttctttccttccttccttctctccttccttccttccttccttccttccttccttccttccttccttccttccttctctccttccttctttccttctctccttccttccttccttccttccttccttccttccttccttccttctctccttccttctttccttctctccttccttccttccttccttccttccttccttccttccttccttccttccttccttccttctctcctttcttcctcctctctgtgtaatagtcctggctgtccagaagctcactctgtagaccaggctggccttgaactcagagatctcccccacctctgcctcctgggtgctggaattaaaggtgtgtgccaccatgcccggcaaaaggcagcattccttgagtacttattttatcatgttaaggcctttgattatagtaagtctgttgaggtaggtcttattcctagagttagcagtatgaaatgatatggcaagatgtatgtggtagattacccaggtgataatccaaagccctgggaagtagagataggcaagtcagcaattgaaggccagcctcggctacatagcgaattcaaagccagcctgggctaccaacaaaagaaaataaaatgtgtccaatatcagttatgacagtacttttgtctgagttcaaacacatcctgtgcctcccatgtgagatgtacctgaggctgtatgttggtgcacgtttttatccttgtctgctctctgttgaaacacatacctttggctatgtatctctgccccactgtgtgatggtttccttgggatttgcttgtggatgcggacttatccacattgcagagtttaccttctctattaggctttctgtacctgtaagggtccactctggtctgtgcaacttgcacggtgtctccatcaagctgccaatgtacctttcttgagtatttagtatggatgtctgcatggctctcagggagacctcaggatgtattgaaatccagtctccgcagaaacagcaaacaggagaaaattggagtaagactagaacagagctggacacccccagcccaggcacagagtagctatctccagacatcctctcacggtgtctcctgggcttcctgagagcactgacagcagaactagtgggtaccatgttctagaagcttcacccaatggaactgccaatctccatcccagtttattcatagctttgtcccacggtagcaggaatgcttcaagtcacttgagttctccctcttgtcccaccatctcagctccaggaaggtagcattacccgaggctgaatgatagaagtacattgtggctatagatctaactccattgctttgcctagcaggcacagagccctggtctcaattcccagtactacatcaattgggtagaatggtatacacctttaatccgaaagatctgagattcaagatcattcttggctatatagggagtataagagcagcctggctgggcagtggtggcgcacgcctttaatcccagcacttgggaggcagaggcaggcagatttctgagttcgaggccagccttgtctacagagtgagttccaggacagccaggactacacagagaaaccctgtctcagggaaaataaaaagagcagcctgggctacaacaagaccctgtctcaaagcaaaaaaccaaagtgaattgtggagttgtgcttgcctggggtaactggaatttatgagcctgtcaggagcagagttcccatgtatatcttgtaaagctcagaaaggtgattgctgggcagcagaggagcctctctgaagaccttactccaaagatcaccacccagatgagtgcccttggccataagaaatgtcttcctcctgccaagggaccagctcagggctggggcccagcaatggaggctgagaactacctttgttcacaaaagattttgaattgtgtcatttgtttcctcgtataaagaacaggctgtaaaacttgtcagacacttgtggagtggcaagtctaacagggaggattcaaaaaacttcagacttgtctttgctcacagagctgtctcccatccctacaggacgtagttctctactgcctccaaaagcacagcgaggatgtgaatcaccgtgacaacgcgggctacacagccttgcacgaagcctgttcccggggctggactgatatcctgaacatcctcttgcaacatggggctaatgtgaactgcagctcgcaggatggcacaaggcaagaaggctgttcctctgccaagtctcagacctcagttcagtccctcgcttcagagctttactcagacctggatatttgcagaatgtccagctgctggtgtcaaaaaggctttaaccaggaagccttttgaaaggatgtctgaagggagccagcttaggggcaggagctgatgagttcctcaatggccagtctgtatgggactaaggaaaggctgaggttgtccagggttcactctgtcccatgccaagtcaatccactcaaccctcctgaataccatcatcgtcgtgggccatttatctcatgtggaattgaggccttaggttccaagcagagcactaatctaggtttcacattccagattgggtttttgtaatttagtctctgtgaacatacaaaaaaattaactacctgggtctgtgagattggcttgatatatgtaggcacttgccttcaagcctggccctcttggctgccacatgatggaagaagagagccgattcctgcaagttgtctcctaacttctgcacacatattcatgcacacacacacacacataatacagaaataagtaaatgcactacaccatattaatgtgcacacataaacaaacataaaacctttccatgtctcagagaagtcacacccatctcctctactccaggggaagtgtataccaagtagaaggggccagatcaaagtgtacaggctctgcttggctgctacctggtgtggagcctccctacctatccaaccctgcccttgcgcagtcacctgggcccttcctcttccacaaccacccacacctgctttaattttaacttccaccagggacctgttctccactgaactcctagtagatcgacattgtgctctagatactgtccgaagatgcgggggaacacagaggagagacaaatatgggaaagaaaaagaggtgcacagagacaatatgaagcgtaggccagaggtggctcccctgctctcttacccatgttacactggggttacctcgaggtcaccatactatctttctcactcttcttccccctaatatcgcattgtgaaagttctccattaaatcctgtagccctgactcttatttgacctccacaggccagttcatgatgctgtggtcaatgacaacctagaaaccatctggctcttgctatcctacggagctgatcccacactggctacctactcgggtcagacagccatgaagctggccagcagtgataacatgaagcgctttctcagtggtaagcattgaccacagttgcagccagaatcctcagggtttgttggccttggactcctcaaccgggggatgggggaggtcttcagtcactctgtcctagacagttcccacaaggatgtgttctgtcttcacgtattccttcagtgtcttggcaatttctagctactttaaaaagtcccttgctgtgagtgtccacatcactacctcagtaaggccctcacctcctacagagattcatttcaccactaggtgtctggagcagacctcccaatgggaaactggctatactcttggctggaagcaggatatgttgacctgtgctatgaatggaatgtcggtggtagagaatgaataatccccattttgctgttgctgcagtctcttcttgattgtaattaaagtgggacctctgggacccttcctgatgcttgattctttgtggctcttctcccatggtaactttgatactttctatgcattccagtattccccttctctccattcctgcctcttctccaccctctgccttctagtgaagtgtcatgttcaggtccacggccagggccacaagtcatttcatagatttttctctctagtacgtagcactgtgtgtcagcaggtaggcaggctgatctgagttgggcagctaggatgggaatgaaagagaagactctacttacagcatgctcagtgtcagttccttctgccgttatctcaactctttgtgacatcatggcttagtccttcggattgcctgagtgatggatgctgcagttgggagttgcagccgtgaccctcttcataggcttcagttgtgatacaaacatctattcccctcttacccaaactttggcccattggtcaccaactacacctgccaatgatgcagcactgggttcccaggttaggcgggagtcacgcttgcttaagagaattttgctgagtagctaataatgtcaggagtaagagaacctatactaaaagttcccatgggagggaaaagaggtggggatattgtagaggctgcagggaggcaaggggatgacagattgcctaggaagggtttgacttgtgcccgtccaccctccaaacagtgcccttaactaacctctgagtataggcctcaggctttccagccttccttatcctcgggctaggggaccgaccggaggcttccttttttaatttcttccatgacgctgggtccttgagcatctggtcatcatgagacatagtcacttagggatttctttccatcagtcacttagtgtaggccagtaatgactggttattaatcctttcagcagagccactccaagggtgcaacatctgtagcctcctcccacgcgtgtacacctatgtatattctgtcttagatgtcagcatggctctgcaggacaatgaagcttctttgtctttcgtaacttgtctgatgggggtggggggctgcaaaccaggtagcacctctggttactttattgaatataagtgtaaacctttcctccctgattgatctgtcaaactccaaaagactttaaatgttgacactttgttgattttgagatgggatctctctgtgtagtcctggctcttctggaacttgctatatagaccagactagcagagatctgtctgcctctgccttgtaagtgctaggattaaaggcatgggccaccatactctgccaatactattttttaatgcctaaaaaatgagagataagaacttcttctctttttattttctataaactcatcccaatctcctaggtaattgttttaaaaaaaaataacacttttaacgataaggtctcactgtgtgactctaatcagaacttgttgcttatatcaggcaggcctcaaactcaagaggtctgaagttttgtcttaaataacatctgcttgcctctgtttcctgaatgctggaattacaggtgtgtgcaactacccccagccaaaaagaattttaagacatgtattacatgttttatgtaattctattatgattaatagaattaataaatacatttatcattatgtaaagctattctgggttacatagtgagttccagaccagcctgtcctccttaagtgaacaaacagcaagacactgcttaaaaaaaaaaaaaaggaaacgaaattcatctaatataacagtttaactgactaattctatgacattaagtgcgttcatgatggtgataataaccatcattgggggctctgatgcctcaaaactgagcagcgcctctcttccgtttcatccctggatgctacctcaccggttccccaggagccataaggtcgaatgtttctgaggtaggaaggtagggaggtgctcttcttatgttacaccatatatccagctacctatgcatgggcggcttttgttggtgttttttcagaggtggaggttgtttctggtattgctgttgttgttgttgttttaaatttcagttcacctgtctggctgagacatttaaaagtatcccattcatcttcaagcacttgcttagccaggtgctgcagacatgcattgtctgcgtcctccctagcccaagtcttccagtagaaaatgaggcaaacccatgtagggtgctaaggactccatattttgcaagcatcaggattgggcttcatggctagctttcctcattctgtgtaaggctcctgctctggaatggttgcctaggacggaactcttctaagaaagctatcttgtttacatggagcatggagctgtccaaacccccaagagatctaggaaaggcttcccccatgggccatcttgctaatttacctttgaccctttggagaaaaaaaaagagcaatatccaatgttactgcgagggaaaatagaccgagttttgcctcctctgtggaagcgcacaggaactgtgcagttagggctcagacattagacttctttccctttcactggggaaagggttagccaatgaccagtcaaggtcactgaagcacacagttttggttttcctgcagagacttctatgatatgaagccatattgaagacagctcatttctttttctcctttcatgtccctcagctggtgactttggttgggtagggtatgctaggatgctgggatctagagaaactctactagctccaattccatacgtgggaacaaggttttctctacttaagaatgaggtactgaaggccgggcagtggtggtgcacgcctttaatcccagcacttgggaggcagaggcaggaggatttctgagttcgaggccagcctggtctacagagtgagttccaggacagctagggatacacagagaaccctgtctcaaaacaaaacaaacaaacaaacaaaagtactgctgagggggctttcaataaaaaagtgtagggtaagattgatgaggtaaaatgactaattgatcaaattactgatcaccacgtgatcgtcggttcagtgccctttacttcatttacagggttccagccgctgcggtctagttctgaaacattatcatcgtccttgcatacaaccttgtacaaactgtttattcccgtcaccttcttctcagctcctgcagttgccaatctgcactcctgtctctgtggctttgcctattccagacatttcatatacatggaaccctataaggcataatcatgtagtatagtggttttatggcccatctatatgctagcatgtttcagaactacactcattttaatattctatcacactctctccctctccttctcttccttcaccctctgtctgtcagtttgtatgcgtgacaaatgtcagaggacaagttgtgggaacttagtctgtctttccatgtgggggcctgggattgaacttggatcttcaggctgatggtaggcacctttacctattgagccatctatctgacccaacattcttttatgactgactaatagtgtgtcctctgtgtgtgtgtgtgtgcgcatgtgtgcgcatgcacacgtgcacacactatttttatctgttcattcatgcatagccctttgcgctgtgtccatcttttagcttttccacggtgcagctttggtcacgtgtgctccaatccttgttttattggtcctggtgcatttgtatgtgaacaggaatgtttacgctcacaggagtttctcacacaacgggtaaaatcttgcaagtttgctggggatgaaggcagaatccaagaaaataaaggccactcattttgatggtagtcctatctgaggactatggattaatgctataccatcaggtgactccgcccacgtgtttgtcacgcatgggcctgttccaactttagcatctttgctcatgccagctaactttggcaggttcacctgtccacgacaaagctttgcaggcggtggagagaattagaggaatgtgctgggctctgaaggcgattcctagtgggagccacaggaatgtggtgaacttgacctgctccagtggaatcctgtgtgactgcgggtagggggacaggggcggcggagtgcatatgttttggcacactgcttaagcaagccctttgctgtctcactttattgtgattctctcctttctccttagtcatcctcttccctagtatgtttcttagtatgttcttctcttagtatgtttattaagctcttcttaggggccagacactggagttccggcaaaggagggacagtagttaacaaaaagtagaccctgttccttccttttacagaaagaagggcctccttcctttattttctatgatacaaagcataggactagactcagagtagactagacacctgcccaacagatgcttctggaaggaagtccttgtgatttaggcagtacagtgtactgaagatgtggaggctgtcagcggggcctccattttatgtggggtgtacagagatctaacctccacaacgtaaggtgcctcactctgctgttactttaaaagctattccctggtgccttcccagtgggagcctgagctcgtcatgtcttggaagatggctaagaagggagtggctttggaaggttacattaacagacagttcttgctgctggattggtccagaaggggcactgggtggcgatggtaccttcagtggaggaagcaagctgcactccttggggggaataactcccagtggaattctgggactggctttgcaggtgaccaccctcatctccttgtgttctttgtgttctcttctttcctgttacctaggtgctacttgagagctggtggcgatcccccatcgctcagccagcctgttaattgtacaattgggcacactggcaacttcctagccttgcactcacaggcttcatcaggaaagcctgctttgtatctgggtggggagaagaggtgaacctgtctactgactgatgctaagaagcagggaggctgagggcgacctgaggcctgtctttagagctagccaatgaaaggtgggttgtaaacccctttcattgtgggagtagatacatagaagaagttagccacttgagacagctgtgtgatggagtgttgttgagtcacagtgttgtactacagtcaccactatctgctttcagaacttttttatcattgcagagggaaaccccagatctattcttagtcactgccctcccccccacacacacactgccatccatgcttagtctgccttctgtcttattgactttgcctagtctggagatttcattgagatggatatatatatatatatatatatatatatatatatatatatatatcctttgtaactgattcttagtagcatcatgtatttccagtatgtgacatattatcactcttttttgattaatttttgtattcgctttacatcacagtatcacccctcccattaacccctactcttttctttatatggcactttgtgtctggcttctttcacctaccattcatgttgttcctttttatggtttagtaatattcttctttgtggatattacctcattctgtctgtccattcatcccttgacggacatttgggctgtttctgacttttgaccattgtgaatggagccatgtcagttcatgtggacagaattttgtttgaatacttgtcttcggttctttttttaaaaagtaatttattgtgtgagtgcatgcatgtttgtgtgtgccacccttacaggccacatcatgcaggtagcagccactgggcacgttttggggtggtagtcctctcagagcaccttgttttcaagcaggatctatttttggtgtgatgtgctccagcctagttgagcttttagttgactctcctgtttctccttcaagtcttgctggtggagttctgagactataaatacttcctaccatacccagctttttccatgcctccaaggatcaaactgttaccaggcttgtgcagcgggcactattacctgctgagccattttctagcactgcctcttgagctcttttgggtagaagcaaaggggtttctggtttgtttgtttggttttcttttttttttttggttttgttttgttgagacagtgtttcttctagtggcccaggctgacctcaaagtcagttttcttcccttagccttctgagtggtagggtgtgtgtgtgtgtgtgtgtgtgtgtgtgtgtgtgtgtgtgcacgtgagtgccaccctgctgttatttatgtattttttgagctataaataaacttagattcttgcatgtgctaagcatgcactctaccactgagctaccccatagctacttaccttactttatagaagctagatcgtgactggacacacattcctattgtgataggcgtgggattctgcttgtagaggaatgccctgtgccttttgaagctgaggtccccaagtaacagccttcaggctgacgtgtaagcgagaagaggcccagtggggactggaggctgtacatgtgtcacagtgtcctctggccaactgttgacatagaggaatgcagaggcagtgctgccagatcttagaatttttatcttttttatatataaaatgttggaaatctatttttttaatttaaacccccatttaataatactagagggtaatttttccttttattaaaaactaggtcatacatcagtgaggctacatgggacttctgcttgcttgcaatctgttgtgtctctttcctgtcacccctggccactcttgtagccttgcccacttcccctcccccaaccccatataagctaatcctcaagagctcctctgtgtctcacacctacctctgttctctcatcagatcacctctcggatcttcagggcagggcagagggcgatccccgtgcgtcctgggatttctacagcagttctgtgttgggtaagttcagagtgggaagaagctgggagggctggatgcagctccgtgtggctcagaggtaggagccccgctgtggaggcagcctttcctcacctgctagtagctttacgggccctttcagccctccccctcagtctcaataatcaccagtctgaagcctgagatgccacaaggatttgcacaatgtcatcctctcctgccttgtccctttccccacccgggatgctttgtaatcctagagttacctcaaatcctagtgttagccccttacccggcagctttcattgtcccccactctgtccctgtgacattgccctcattcgttttttttttttttttaattttcttctgggaagggtgtggtggtggtttggtttggttttcttgtttgctgctctgttttttgttttgttttgttttgtttttttgagacagggtatcaatctgtaactctggctggcctgaaactcacaaacacccttctgcctctgcctcccaagaacagggattaaaggtgtgggccaacaaggtgctgggcttagctcttagtttttgagattgctgctgtcctgggcccttaaccctctgtcacaagcactgtgcagcaggaagctcagcacaccagtgtctgccatcatccagcgtttgtctagtgagctgggggccgaggagtaagagcagaaggctgagatgaaatacgtcgggccgcacccggacgatcgatcgggtggagaagggaaccttctgagtctatggaccttgggatcgggcagtgaggtggatggaggaacctgcagccagaggacaggtggactagcccgtagtagctgctagtgtcttccgtctttatctgcaacagctgagcttgcaaccttcagggcactttgcttttcccaaccagagggtggagaaggataatggccttctggccacagcatagttccttccaagactagaactttcctgtgccctctccagaattcgagtccatagtcgatccagccaggggcctgtggccctgtatttatcccctaagtggtcccttcatactcctttatggagccgttcctttccttcagttttgtgcttgtagctgatgccccatgttctcatcctacagagaaaaaagacgggtttgcctgtgacctcctccataatcctcctgggagtgccgagcaaggagatgattcagaacaggatgacttcatgttcgaactctcagacaagcctctcctcccttgttacaacctccaagtgtcagtgtcccgtgggtaagtgtctgggaagtctatggagactgtgtgacagtgtcctggcaacctgtggcctgcttagggaaggaggagctctgcagaaggaggcacaggctgtctggggaatgagtgctggagcagaggaaagacaccctgttcctccagtccaaactcaagcttcacagacctccagagc

SEQ ID NO: 425 - DNA, 60730 bp, mus musculus; identical to SEQ ID NO: 424

SEQ ID NO: 426 - DNA, 38882 bp, mus musculus
cttctctcatttttttaaaaaggcaaagcagagcctctgctctggctggtaaatgcagcgtgggcgggtgacaaggcgcctcctctgctctcactggtgagcacctaagctgcacaagctactacactcccacgccttagctctctctcccgaagcctgcaggaaggcgggtggctagctgccgacctttttgcacaggattctggactctggccttttgaatttaatggtttcctttcattcgcgccttgctttttccaggctaggagtgggcggagtttaggatggctgcgccactgttgccgaggcgacgccttggttacttccgtcggtttcaatgcttccgggttggcgctgcggtggcgtttcctactgtggtagcctccgcttcccagtcgtctgctgagcttgagcaggtgagggggatgctcctggacttccaggttggggagcggggctgggccgcgccaggccgcgcggggccgggttggcttggttcccggcctgggaggggcttaacggtcctttgatctctctctctcccctcagctgagtcccttccctgtctttcactcttctggcatcggtggctttacttcttcgattgagctctgcttcctcgaccccccgggaggccgcctccttcaggcgcctcccttctctctacgaactcgctctgacagccgaggaactggcaagatcctgcacccagagggtgaatgggtatctttcccggaataatcctaatttttctaagggtgaagtttgcaacggcggcagtgattgtaagcggagtaagcaaccccctccattgtataagtgtgagggatgctgttgaaagatgctccccatcacttcctatccccctgtcactcgtgaggttcaggcattgaaggcatctattaaaatgcagttcagttacttgattgggatcacagctattatcaacatgaattttgtttctcagacaaggtagtagcagggacatttatagttttctaccagtgtgtccttgcccaaaccatagagatgcctagactagaaattaactctttcctcctcttcatttatatcatgaagtgtcttttgtcaatgtctcaacagtttaacctcattgtcaattagcattctttttttttttttttgcctgcttcccactctcctaagctattttcctacctcttctgtttgcaatccaccgtgctcggggtccctagtagctaattacaataggctattaccttaattcacttgcctattaatagatctagtcttcctccagcaccttgtttccaagccttccagtagaatctaccccttttacttgtttcagccaacaaatttattgcttattctgctcgggtccttcatttctgtctcagtacaaaccattggtgcacatttctacatgagtgtgcgcatttgcacatcttaccccacctagatgtctcccttccctgctccttttttttatattaaagatttatttatttattatatgtaagtaccctgtagctatcttcagacactccagaagagggcatcagatctcattacggatggttgtgagccaccgtgtggttgctgggatttgaactcaggaccttcggaagaacagtcagtgctcttacccgctgagccatctcgccagcccctccttccctgcacctaaccagattcagtcggctctgtggaaacccggcttaagttctctcacttccaacagcttttacaagttgtttacacacatgcgattgttttctgtgcttctcttgatctcatagactgctctacgttttaacacttcatttttctctaacaaagtattcaatttcatccaccagatgattgggcagaaaagataggaagaatggcaattactgtcttttgttagattatatttgtgaatttattggttttttttttttttttgtaacagggtttcgctatatagatcaggctggctgcactcaccgagatccacccattttatctctcaggtgctggattcaaaggcaggcatcaccacaccctgctgtgattacaaaacaaacaaacatgaccaattagattattaacaaattgctggtttgagtattgagtatgccttcaacacatagatttaggctcccaattgctatcttctaaacatgagaatttctaatacctactctttcttaaaggagaaaccaagaaggttaaccagaatttcctgaccagactttgaagtaagtgtaggggctatataatatggattctaggatcttttattttcacttgttaggctatcaagatagccataatcagatcttatgaagagatgtacaaattctgaagccagattttactggtatctttctataataaaaatatttagggtactgtatttatattgttccttagataatgacttctgtattttcacccaaaactgaggttaacatttacaagtcaaaataactttgaaaggagtttggtatactttacaaagcaattctctgcaacaaaaccaagaggcaagggtttgtaggtagaaactttggcaatgagagtgttgagcagggtgtatagtatagtctagaggcagcaaattccttttgcggcttcctctataatggtttatatacagttgcatacacaagatagtcaacgactggtttgtttggactcattctgtgataactcctatgaggtttataagaagttttgcaaagtgtggtgtcgtctttttaggaatcttacctatttaagaggggaagagacaggacacctagagaataaacctcaccttactcatcattttatgcctgaatttaagatgtcagagaaaaaaggttctcagaaatatgcatagctgtagaacaggtgggacataacttgcatacatgatacagctttgtgtgaaagacgggtatttgctggaacattaatgtttcagttgtggaatgtgcctctctcaaagaaacagaggttttcagccttagtaactaaattaaaacacataggatgtaggaaacgatcaggagtatttagtctgagaaagaaaatatagaaacatgaaaactgactttaaatatttgaagggctcctttgggggaaaattaatttgttcagtgtacctctaaattgttctagtatgaggaaggggtggtataaagtctaatcagaagtgatacaaaatttctttcgtgattttcctttctaacattgaactgaaagagtttatcttgtgtgactggggaggtgctataagggaccatcttgattttggtcagttgtctacagggttgagtaattttatgggctaatgaaatttaaatcaaagtatggtggtggggatacctataaagattggtatgcttattttatcaaataagggcattaaatattaactactcattaccattatcattttatataagatgatttgtcagtgtcccagggataatgatataattaatagccatctaatggcatatatttagccggaaaaaaaaagcagctctagatatttttttcatataagccctcaactgtgaaaacttcattgggggaacccctgagctacaggacctaggatccagtgactgatctttctgcttcctagtgtgactctgtcccgaactttcaggaattcattattagagagctcctgcactctaggcacatcttccttaattaaaagattgggtaggggctggagagctgtcttggctgttaagagtagtagcagctcttttagaggatccaggttcaagtcccagaattcacatggcagctcacaaccatctgtaaccagttccagagaatggaacaccctctaatggcctctgtggctatgaggcatgcctgtggggcagaggcatacatacaagcagacactcatatataaaacagtgagaaaatgttgagtagtaggtagtagagttatggtagagttcttttattcctcctgtactggcaaaggatgcaggaagttgtaaagggaaagtttgggggagcagcacagcagacatctgaaccatcaaaggctatttaggggaaatctcgacatttgacaccatagagtaaattttcctttattttttttttctgtgcattcttttggagacagagttctgtggcccaggctggtctcaaactccctatgttacaaagggtgtgactttgaatgactgatcctcctgactctaacttcccaagtgctgccattacaggcctgatttcacatttcatgtctgatttcacatttctttttcttgtaaactcaggaggtatgccacagttctatttttcccatcaattcctaatttgccctttagagttttaatgaactctcctccaataggggtgatctctcacatactcaatattgtactatgtctgaaaggcagtttcaacaatcatttttgtagtatggtaactaagacatttatttgcatgctcactagccacgttttactttgtttcagagaattgctttggtaaaaaagaataaatcaaaaccttgtttcctctaggagcagactgtggcttcaaggtactaacccaaactggcaaggggagcatcgagagcaaatgctatctattaagatgtaaattcagcaatgtagtactgataattgacttattgagcagacttttctcggtgttagatatatatctatatctatatacaacacaacaaccctatgacatacgtttttattattattgttttcagaaaatggaggcagagaaagattgaattactttcccagagccacgactagtaagtgatagtcaagcactgaatccggagccatgattcaactttagatgatctaattacagagggttccttttttgactgtaaatccttttgaaaatgggtagtatacacactttgaaactctcaagaaagaaagaaatatctcaagaaaattggagagtctataagaatgagtatttccaagtggacctggatttaggaagtgatgcctacagcagtagtttttaaaggaggaagaaacatcagtattctttgagaactctctgactctcagggcaagacttaaaccaccagtcagaaactctgtggggagaggcttagtggcctatgtttttacatgaagcatgtagcaacgggtgactttgaacttactgatcctcctgactctgcttcccaaatgctgggattacaggcctgtgtcactacgtctgatttcaaatttatttttcgggttaactcaggaggcatgccatagtccatagaggcagaagcaaggcgaattgctgcttagctcagcctgggtctcactgaggagcggggatttggtgtatagctcgctcagttcctagagagctgagatgctaaatttcagtggagagctgagagggttgagaccattcctgcgtagtgttgggagcttgcgctttgtgcctaaatcaagctaactgaataccacgaactgcttttataagatgcctcagcctatgtaacttgagttctggttcccttgactcgtgattgtctagttgaatgtcagagatgggtgtgctggatgggctgaaacgtctttgggtggggaagagtgttaaattagagagaatgccagtcacacattggtttcttgagtgattgcatgccttccctccagaatgacattaaagaagaaactcatgaccatccagcacatgaaacaggactctccatgctgtctcatttcacttggtggcttttagtttttcctctacatttgtatgatttgccagttctacttatttaaatcatagaatcaagtattaacaaatgttctcttccttctcgtgccccgttctgattcgtgtttgtttttagcatcagaaaagttccactttaagccatgagatgtctggtctgaactggaaaccttttgtgtatggcggccttgcctctattgttgccgagttcggtaagaattgagaaaaatgacaaatctgagtttcatgtcactgagggtcatgtatggaccaattatttttggagaaaatcagtggggaaaaatattgtcatcttttgttttaaaaattactgttgtgtggctatcaagtaatattcctgaggaggttctagtcatgatatagggaatgaggttaagtcaaattttgaactttttttgataacgtagtttttcaagtcaaatatgcatggttataaaggactatatatgatagtagtttctgtgtattcctgtgctaatggtctttaatttatgctaaggttataatttcttcttatccaggcttcttttttgcaaacccctcttccattttagaagcaaacaagatcattagattgtgacttcattttctagattcctctttttcctaactgattcctcgttgtctacaatccagcagtgtttgttaactttttttctttttggtttttcaaaacaatgtttctctgtgtagccctggctgtcctagaactcactctgtagaccaggctagccttgcactcagagatccacctacctctgcctcccaagtgctgggattaaaggcatgagtcacctctgcccagcctgttgattttcttgttatatgctctggtcttatataatccaggtcacaaaagttcagagctatatacataaagagcttactagttttagatctttaaatctttcttaaaacctattttgttcatgcaaaaaccacttttatgtgctgatataagaaaaaggagctttattgaagaatcctgctagggaagacaaggtggcccagcaggtaaagtagatgcatgctgccaagcttgatcgacctgagttggatgggaaccatgtggttaaattaaaggacagatctgactcctggagatttgcctctgacctccatacatacccacacacatacatgagcacacatgagtaaataaagcacaattaaaaataagaatggcctaaatactctgctggtattggtctgcaatcatccaagacaccatggtgagtagacccacgtgagacttttaccattttctctcataatattaggaagttgtaaacacacccccccaccccccacccacccacacacccacacacccactattgtaataccatgtaggaacagctaatgctttcctatgcttgtgataatgtgaggcgaggaggtgtggagacttgagatgggaggaaaagggtaatgaatgccactgacattggtatgttagagacagtgtgaaagacatgtctaaatccctttgcatttatagcctattattatcttccagcattttctatgtcagtgtcaggtaccctgtgcagcaagttgtacttcctagaaaggctagtacatttcacctatagcctttatcctctggcaatgatggtagaatagatattcaggtgttatgaaaatgattgccttgtatttccagtattctcatcgcccttatatttaacataactgttatttgtaaatacttaggagtctgttccttcataggcactttccctgtggatcttactaaaacacggctgcaagtccaaggccagagtatcgatgttcgtttcaaagaaataaaatatagagggatgtttcatgccttgttccgaatctataaagaagaagggatcttggctctgtattcagggtaagactggtttctttttttatatcatgaacagaatgttttttaaatttttttagaagaaaccatggatttaatctgcatgacagtttacactcttcgcatccaccatttcaacttataattctgtattgattaactattgtacatgtaaaaatgtataatatcgttgcagcataagcttttttcctggcttcctgacactctgtttttttttttaaagatttatttatttattatatgtaagtacactgtagctgtcttcagacactccagaagagggcgtcagatcttgttacggatggttgtgagccaccatgtggttgctgggatttgaactccagacctttggaagagcagtcgggtgctcttacccactgagccatctcaccagccctgtttttttttttaagatttatttattttatttatatgagtatactgtagctgtacagaaggttgtaagccatcatgtggttgctgggaattgaactcaggatctctgctcactctggggtcctgctcgctctggggccctgcttactctggcccaaagatttatttattattatacataagtacactgtagctgactttagacacaccagaagagggcgtcagatctcattacagagggttgtgagccaccatgtggttgctgggatttgaactcaggaccttcggaagagcagtctgtgcttttaaccactgagccatctctctagcccttcctgacactctttgatggctattgtaaaagcagcaccagttagctgtacacattcttgtgagaaattttcctagcatcctttaagacttcttacataaaacaaacgttattctggcagtttaagtagtagtgaagactaaaagaatggagaatcatcttttttcatcactcttgattacccatcagtttatgatttagtgttcagtttgttgttcatgtgctgcagatttcctaggtcatccgaaatctaggctaccaatattgctgagatgattgaaataaaatttaccagtaacctatgttgggcttatttaaaatataattttcttggagaaaaaaacccaacaacccaagccagatcctcatgcagaagtgagtgattcctggaccatctcttttaccttgttctttcattagcatagataacctcaagatttttcttttcctgatacaagtaatagagtcagaaagattcatatttagtcattcgtttctttttccttcttccatcctaaccatttgagctgttgctttagttctatttatatcccctaaagtatagttctgcaatttggaagaatctcaaaggaggcatgagtgagaacatcttcagtttatgagcaaaatttaagtaggttgagatcttggtgttgttgcttcctttttcattgggttaaagatgtatctgcagttgttaggaaatagaggctgattttttaaaaaaatatgtggtataggtaataatgtctgactctttttattattgctacattcaatttgttcgtcttttctgaaggatttttgcatctaagtttatgtgtgatatggatgtgtattttttatgttccttttaaacatttttttatttctgtattttttaatgtatgagtgctctgttagcatgtgtgcatgcatgtgagcagaaggcatcagatcccattacagatggttgtgagtcactatgtggttgctaggaattgaactcaggacctctggaagagcagtcagtgctcttaacctctgagccatctctctagtcctaggcatatggtttttatttgtactattttttgtttggtttttgctatcaaggtaatattagctagagtgatttgggaaacattccctcttttatttctggagagttttttttttttttaaataagattaatgttaacttttcaacagttttgtggtatttttcagtaaacttttctgagcttggaattactatttttttgaactttaaaaaaaaacaatgagccaggcggtgatggcgcatacctttgatcctagcacttgggaggcagaggcaggtggatttctgagttcgaggccagcctggtctacaaagtgagttccaggacagcgagggctacacagagaaaccctgtctagaaaaaaaacaaaataaataaataaataaataaataaaccaaccaatgaattccatggggcaggaaccaggccatgtttacaattgcgttaatatcagctctctaaaatcagctagtgacaggagccaggtgaggatttgacaccctagtcacaatttatgctattcctttgagcctgtgaacgcttacagcagggggttctgctcttgctgtccttttcctgaataatgcaatactgttaataccttaaacccaaccctcctccttcctaggccatggtaaattcttgcatatgggagtaacttggctgctcttttaaatgtctgtagggaatctccatttgtcagaagaactcactaactttcttctaatatgcaatgtagtctgccacacctgactgtaatgaggattctaagttttactattttgaactagccctgagattactagctcctatctggcaaactgtgagatgcctgattactgactgtcaacactggggcatttcgtctgaatgagtaacattcttatgaaattccaagcccagggtcagctcctggactgcctaggacattggtgaaggccaggaagcaaaagttcaacctgatttagatatttgacaacttatttcttggaggcacctataataaaacaatactgaaagaaagcacacagatccgttcactgactaatgcaaggacaagtttggagcattcatgttacaggatgccaaggctccaggagactaagtttccgtgaaattttttgctcaggactgcatccaagcttttgggcttgtcacacagtcttcctggagtgggtgtggcatccactattggtgattgaatgcaaggtttaacacttggcatgcaagtattctatcagtgagctacctagtcttatcgttttatagtaagacagggtcacgccaagctgttcaggctggccttttactcaccccagttcaaacaggccaggaactcctcattctcttgctttagcctgcaaggagcagctgggattgctgacctgtattgctaagtgtggctgtgtcccatgttttatttttttaaatttttataatatttttaattttaaaattatgattatataatttttttcttccctttcttcttccacccactcccatgtatctgtttgctctctctcatattcatagcatcattttctttagttgttgttataaccacatgtattttataggacatatttgaaattttactcaggcctatacattaatttttttacaactttctataacccatatgttgtttaaatatatgttgtttgatttccaagtgtttgagcctccttaccagtttccgatttgcttccactatacattctgcataatttcagttcttgtaactttgttgacatttgttttatgacctgggatgtgaactttctttggcagtttttcatggatgattgaaaaaacatgcttattattgcttagaaagatacagatttaaacattgtaaaatctacaaatgtgtgttaagtaaaattaacttttctttatttttttctctttggtttttttttttttgttgttgttgttgttttgggcagaattgcccctgcgttactaagacaggcatcatatggcaccatcaaaattggtatttatcaaagcttgaagcgattatttgtagaacgtttggaaggtcagtatgctcaactttcttttgagattatcctccaagggattgttgaaatcatgcttagtgtgaaatgtttatcatcttatgttggcagtccatgaaaggtacttaatgcatgggtaaaggtgagcttgtgttgaggtgggctaaatccatacagaggggatacatgggttagaggacctgctcttcacatatatcttttaccatcgactaaaaaacgtctaggctgccaagatggcttaatgggtaaattccatgcaagtgtgactacctgaatttgatatgtagaacctttgccaaggtggaaggagtgaaggcattccacagagctgatccctgacctccatacatgtgccatgtgccatgtcctcccccaaaggaagaattcctttttttgttgttggtttgtctgtttttgccaagaagggtttctttgtttgcaactttctctgtaggccaggctagcttcaaactcagagatccacctgcctctgcttcccaagtgcagggattaaaggtgtgtgccaccaccacttgacttaaaataaaaattctttttttttcttttgcttgttgtttgttttttgagacagggtttctctgtgtaaccctggctgtcctggaacttgctttatagaccaggctggcctcgaactcatagggatctgcttgcctttgcctctcaagccatggaacaatatgtatataaccactaccgcctggataaactaagaattcttttttttaaaaatatttatttattatatcttaagtacactgtagctgacttcaggcacaccagaagagatcatcagatctcattgcaggtgattgtgagccaccatgtggttgctgggatttgaactcaggacctctggaagagcagtcagtgctcttaaccactgagccatctctccagccccaagaattctttaaaaaaaaaaaacaactttattgttattcttgaagaagcctaggtcagccatgttcttgaaaatgaatacacttttcattagttagaggacttgacactttctaaatgtcaattttggtaaggtttgggtaggtagataaattttagtctgttacagtctggattcaaggattccctttcatcttccctgaaactattttcctttcatagatcgctcacatcgatttactaattttctagttctagactcttctgaggaggaggaatggtaaagatgagattttcgctgtagaacaatatgtcctgttgttcctctccttgtttagttgagggaatttacttctatataatttcttctggacatgagtattactgtgtagcagagagctggcttatcgtgtccaagtctctccgttcatcccccaatgccagggattatactactgctttttcatatttgactatagaagccttctgtacataaatggaggctgggagatatataaagccactcaaagttaatatttagataactttgttatacataatattaattttttaacatctagttattaagtctttaagttgactatccataaaaagagttaaaaattgaacaaggatgttaccagttgatatgccacactagacagggaaaagcccacgaggcttcaactctacactaagaactgtcagcaaatacagaaggctgggagcaggggaggcggtcttccccagggaagagagcacatcaattggttgtccaatgccaaatggtcagcccggaaaacatatatacaagtaatgctatgtggggtaaacattatatttaaggatatgtatctatatagagccatatatgcatgtaataactatatgtgaaaaaaagaggccatgaatttgaaggagactgcggagggatatatacaggagtttagaggaaagaaaggaaagggagaaatgttgtaattataatctccaaagaatttttttttgagacagtgtttctctgtgtagccctggctgtcctggaagtcactctgtaaaccaggctggccttgaactcagaaactcaaaagaatttaaaagacaaaaatcagatgcattaatatgtttgaagtggttgaaatggaaagacaatattctaatttatataacattctgatagttatgtagaagaatatgaataatggttttatggaaataatggtttgtattgtataatttgtacacattttgtattgatttgggatggtctataaatacttcagagactttactttgataaactttgaagttaatttttaagtcatctctccagaaaagattcccttcatgcaatatctcaggtagtccagaaatcagtacttaataaaatgaaccttcattttttttaaagatttatttgtatgtagtgttctgtctgcttgtgcaaccgcaggccacaagagggcaccagatgtcattacagatggttgtgagccaccatgcggttgctaggaattgaactcaagacctttggaagagcagtcagaactttcaacctctgagccatccctcagcccatgaaccttcttttatttatttcttttgcacttttacagatgagactctcctaattaacatgatctgtggggtagtgtcaggagtgatttcctctactattgccaatcccactgatgttctaaaggtaagagacattcctgccatggaagcccgcaagctttgactcacattcaagttgccatctttacacaatctattgttagttctaaaatcttgggcagctctcttaactatgtggtgtctcattccttccttgttttgaaatgaagataaatgcagtgtttatagcataaagttgttaagaattagagataatacatgtaaacttgtctaatattatgcatcacagtagatgttcaaaaatagtttaatgtgatgtccattaatccattggttttcagcctagggtttgtgatcctataggctaggttcaaggctaggtcttgcataacctgggacatcaaagggatagattaaagtagagatctttacaggagtttcttttcataactgctttaccttaaatttatactgtttctgtctttccttagcctgtccatgtttttattaaggatgagctttggcttatgtaactggactactactttttttttttttggtttttcgagacagggtttctctgtgtagccctggctgtcctgaaactcactctgtagaccaggctggcctcgaactcagaaatccgcctgcctctgcctcccaagtgctgggactaaaggcgtgtgccaccaccacccggcgtaactggacttctttagtgttttatcaatcacagaatgaaacattttaacgccagccttcagttttatctgactaatagtaaaaatcttctatttaattaataaagcactaaatgtatgattaaactgtgtgaggggaccacaacttaggatttttgtttgtttttctgagacagaatcatatgtagcccattttatcttggagctcacaaagtagcaaagaatgaccttgaattcttgttcctcctgtcttactgagaatagagctatttacagctatgaatctcaagtttaaaaagtctttttatgtgtgtggggttttgcctatgtgtatgcctgtgtgccgtatgcatgcagtgttcgtggaagccagaacagggagtccctagaactggagttaaggactgttgtctgctgccatgtgggtgccggaatcagacctgggtcctctgcaagaccagcaagctctcctcattgctaagcctgacctccagccatgagctcggagaaaagaaatcaagtttgttatttctaataagagaaagtacaaatcaggatcgaagttagctcaaagcaagtgcaggagactcaggataagcactgttttatgcctgataagctctgctgttaactgctgagtttccaggactttgtgcagctaagtaacaaaatccttggatgttcaagtcccttacatagaccaaaactatttatgcataatgtgtgtgtattcccttatatattttaaaacctctttagatttacttatgtttaatgtaaacatataagaatacttgctataatattccagaaataatgacaaggaaaaaagtctacatgtgttcattacaaatataagttcttgcaaatatttttcaattggtgattggttgaatccacaaatataagactgctgactatgtgccaccacgcccggctatcattattattattattagtagtagtattcattattttggaggggcacgtgtatgcccatgtagaggtcagaagaaaccatttgcaatccgttctctgtcaaccacgggccctagggattaaactcagtgctcatctgtaaactcccattcatatgtaaacctttgttaatatttgggtttggatgctcatcctgttttttcactgtgttttaaaaactttacatgttttggtaagaattatatatactgctttgcagcacttttctgtttaacaatcaattttaacagtttctcaaggctacatatattttaagagaaaatgttatgattctactgtattttgtgaaatgaatgtgtcatcagttatgtaaccaatatgttgttgctattggtttttggcatttgaatcacccctattttttactggaactaattacatatgtttgtctgtctgtctatctttcttgaactaattacatatatttgtctttctttctctctctctttctttctttctttctttctttctttctttctttctttctttctttctttctttctttctttctttctttctttctttcgttttttccttccttccttccttttttttttccagacagagtttctctgaataacagtcctgtccatcctggaacttgctctgtactccaggctggcctcaaactcactgagaattgcctgcctctgcctccagagtgctgggattaaatgcatgtgccaccactgcctggctaatacatatgtttttattcaaacagggtcttactgtgtagctatgggtatgctggaactccctctgttgatcaggctggccttgaactgacagagattcacctatctctgccttctgagtgctgggattaaaggcatgtgcaaccatatctggctcaaactagttatatctcactgaatgcttgttactgtcaattccagaaattatggatttagtatgggggatatgagatctaatgaaaatctttatagatacactttggcacaaattatgttttatttgtgtacaatttaattcattaatttcaccatggtaacagctttaaaaacaattccaaaacctatttttttcttaatatttaaaggagtgaactatctcattttggtttttgctgtcaaaataaaatattctatttttgttttagattcgaatgcaggctcaaggaagtttgttccaagggagcatgattggcagcttcattgacatataccagcaagaaggtaccaggggtctgtggagggtgagtccccttttactggtgagatattacactctacacttgagtcttcatattaagtcatgagattgtgacttataactccaagcaaagcaaggtgctcatgctacccatgaaaggaccaaaacttaccagtggctcctatttcgatagtggtgttcagctgtatgtaagaaacatgtataatttgagatcgccattttgttttcctaaactttatagtgaatttgtttcaatgtagttttgtcagttttggattaaacacattaatatgtgtttatgatggtctctgtagtgcatatgttcaaagagtaggacagtatttttaatcttataaagtaaatgatatatgataaaatattgataaaatttacaaaaaaatggggaacaattccagcagtcccagcactggagagaatcactgtgaacattttgttatcttcaaatatttatttatattttatcatttgttgtattattacaatattttttgggtttgttttgagacagggttttctaagtagcccaggctggccttgaacttttgatcctcctgcttctgtctcctgagtcctgagaagtcaagtctgttccactccacctgtctcttgctatagtaactcttctttctgagactggatctatgtagccctggctgtcttagacctcactctatagaccaggctggtctcaaactcaccgagttccccctgcctctatgttctgagtgctagaattaaaagcttgcaacaccacaactggttattggataactttttaatctgctgtgatctctgaattattctaacagcaaataagagtattattagaatatgcagagagtgagtgagcgagagcgcagaataggatggaaataaagttttgttattttctttctttatactttttatagctaattttactttaaaacttcaaacaaaatagagctgaaagaattgaattacaaacacacatcatctagattacacaactcataaagctttggcacaattacttgatctgtttctgattgcatagactcatatgttattttgcacaacaatataattgttgtagacattctaaaagttccacaaactgtccgtgatgtatctcctaagaaggtggagagatgtctctaccattaagatcacagacagctctggcagaggacccatgtgtgggctgtgcagaatgcatgcacctgtgctcatgtttccatatcctctcagacacacatatagttaaacataagttaaaatttaggaaaagtacaagattctctgatatcagtactattgtcgagtgtaagaaagtaatttttaaggggctggagagatggctcagtggttaggaacacttgctatgcacattttatgcagatggatctgtttgaggccagcctggtctatagaagagagttaccattacacagaaaaccctgtcttgagaaaaccaaaccaaaccaaccaagcaagcaaacaaaaaaatacttgctgcttttgtagagttgggtcgccagtccccacgtggcagctaccaaccattcatggctccagttccagggaaacaaagccctcttctgattttttttttgcaggcaccgggcacacacatggtatatagacatacataaaggcaaaatgtgtgtgtgtgtgtgtgtgtgtgtgcatgtgtgcatgtgtgcacacccgtgcggacgtattgcctgtgtatgtatgataaataactctgaaaaatgagcctaatacttgaaatcgagaccatattaaaaattcacctatttgtgagctgaggatatggtgtttatatagtgttatatagtgttttcatgtctttggcttgttcctctattgcctgaaacttgagaccactagctttattatagtcattctaaaccttttgcatcaagtaaggtgtgcatgtttggttacaccacattaaacagtgcagagattgcctacttagtcatatgatatccagcatatcttgctgttgtaaaaggtaaacttttcttttgcaattagcaagtaatttattaggtgaaattctgatcacatgcatatgtcccaatacctaataatcaaatgtaactacttttatggtcatgttacttgtatgatcctagcacacaatgctacaggaacaaagtacattatgctatgtattctttggataatagatataacttttatgtaatgatcacagcacccactagtgatgcttgaggtttgagtcttagtaacaggcgggtagactttcttgattaatccaatttaaaaccagagtagagctaactagaacattttcatgaattggtgccaagagacaaagagcaaacagcaagattataaattaggtgggggaactgagacattttctttttattcactggtaattgttataaagtacaaacaaaatctcagtggcattggatatattcacattgtttgctaccaggatccagaatttaaaaaaccgagcatatgctgatgagttccatgatattttaatccgtgtatctgatgtatttttatcacagttactcctcattaccctctcttgctgccctcccactcttgcttactccttcctctttcccatttgtctcctctacttccatgtttttagttgtgtactgatgtttcattagttttacttataggaatgtggacaccttaccagtatctacaccactgaaataaaatgtcttttcctccccgcagcaaccgtgaactgtctatggatccttgggcaggggtggggcctcaggagcccctcccttctagcaagtgttaactgcctttaaatcctcagggaggagtggggcctcatgagtctctgtaatccatgatgtatccagaatttatttcataaactgaaaccctataatcactaaacaaccatccttcctctccctgctctctggcaaccccatactgttgtctgtctttgggaatgtgtcaagtctaagtaactctgagtggactcgtgaaagtttgtccttttgtgggattttatttagcataatgtccctgaggttcatccatgtgctagaatggttttgaatttctttcctgttaaagattgaaaaaatattatttatacatttcacacactcacatgcacacacacacacacacacacacacacacactacattttatctattcaaccattgatggatgtttgggtgtctttcattttttgggtattgtgaatgatgttgcaatgaacctgggtatgtaaatatccttttggggatactgtacttagtattttgggggatatatctagcagtgctgaactatctggtagttctgtgtttaagtttttgaggagcttgacagttacttttattttccagaccacttaacataatctgggtgtgtaacgagaagcaaagtgtattttggtatgtgtttccttgagataggtatatcttatataaatatataaaaatggttctgggaaaatatagctcagtgatggatattttgcctagcatgcataaatccttaggttcaaactctagtatgcctgcacgtcaatttatattaaaaccttaactgcaattttgtttcaaaaactttaaaaatttcaacaaagaaatatttatttttccctctgcagataggtgatctttttagtctgcttaatactcttgctttggttgtagcagttgctcctgggaatttttcatgctgttcctaacttcactatacaaagaaacagcagcaaaatagaactaagagtaggagaaagagttgtatggtgagacttttctggtgagctggaacacaccttctctgttcagtagggtacctgctccttagctgtggcctgttgccagaacacattaatgagaaactgagtgtggttaagttttcacttgtttttttttttttagatttttatgtttattttatatatatgaatattttgcctgaatgttatataaatgcaccacatgcatgcagtgccagcagaggccagaagagggcaccaagtaccttggaactggagttagagaaagttgtgagccactatgtgggtgctggaaagtgaatttgggtcctccgcaagagcaacaagggttcttaactctgagctgtcactccagctcttaaagtttgacttttcaagagaagctagaaacttgcatttctttgcgaaacacctcaatcaacagctaactaaatcttttaagaatattctataggccacatacataaatacatctgtgggctgaaatcttccagtagttttagggccctattgttcatcattggtcttatggggaggtcacactgtttagtctaagtaactctgagtggtgaagcagggggaagagtcctagaggaagctactattaggcgaggtcagcaggatcagccttggcacagtcacatcacctgtatatagggtttgggagttcagagatgaagttagctcaaaaagcagttatctacataatatggtattttcagttcttaaactttatttattttcattgattatctttattcaagtacccttgcacataattaagaagtcctgtggattgtggggatatttctagtggtaaaatgtttgatgtacaaatgagtatggacccaagtttgagttccataacccccataaaagtatcaaaagctgggcacagaggtgtgaatttttttcatgattttcttttctttttattattgactgttttattagatcttttacagccctattaaagatttttcacaagcctaatttaatagctagatattcaaattagaaattgttacattatttttcctttgttatttaaatctgtctcattttattctttatcctttttccctgtttatgtttttatttcattctattttcttttttcttttattggatattttatttatttacatttcaaatgttatcccctttccaggtctcccccccagaagtcccctatcccttccccctccccctgcctctatgagggtgctcccccacctacccacccacccacccacccacccagagatgtgcactttaatcccagcactggagagacagagatggacgagtctctgaacctctctggccagccagcatagcctaatatgtgaagcccaggtttcgatgaaagtttccgtgtcaaaaaacaaggtacatcactccaggggattgttcacgtgtaaacttgcctccacacacaatgaataatgttcacgtgtaacttggctccacacacaatgagtaatgttcacatgtaacttggctccacacacaatgagtaatgttcagttaagcttatgacggtaaagaacctgctgtgaattagtaaaaactgctggtgaggtgcttcatgggatgatgccaccctctgcaagcctgccagcttcagttcaatctctgagactcacacggtgcaaggtgtcccctgacagccatgtgtgtaacatgatgtgtgtatccacacatataacacacacacacacatgcacacacaaaaataaagagggaaggtataaaaatcatctctaactgtacaaacacaaattatctcattatatttctttctgaagagtatatattcctttctctctgaacttagaatagcagtgctggatataatttcacatcatgcatttgtaaacaatcattagaatgatttccttgtataattaatattcttcaaagattcccccctctctctctttgtgtgtgtgtgtgtgtgtgtatgcctgcatatgtgtatgtggctacacttgtgtgcactgtatgtagcggccaggggaaaactttaaacgtcatttttttttttgagacagggtttctcattggcctgttactcatcaggctagagtaggtgtctagcaagccccagggatctgcttgtctctgttctgggataaggagcagctttgccttgtgcgctgccagccctctgtggtctcatgagtgggataggaatatcctgctagttgattggtatcgcagtgcaggaaggccttcaggggagcaccgtttcctccttgctctttcccttcagcctcagactcgtgcttccacccactctcatccttggttcaggaatcaatcagggaagtgtccctctcctcactgacattttttttttcaaattttagagacaaaaatagcactgtgtatctctggctcgcctggaacttgctgtgtagacttgaactctggatctacctgcttctgcctttcaagtgctgggattaaaggtgtgcaccaccacgcccagctgccaatgtttttattattttgtccttctaatgagtgtatactcacgtctcgtctcctcttgtctaaagaaattcttctcctagtcctgcagattgaagtcagggcctcatgggtcccactgaactgtgtcagcagccctctttctactctgtcatgctagccatgaactcactttgtagtcagcactaggccctgaatttaggattcttctgcctcagcatcatgagcagctgagattaattacaagactgtatcatcgggcctatcatgcttttttctttttaaaaacctttttaatcagtgtatattgtagaaatgtgtttcatgctgatattttcatatatgtatataacatactttgatatcatcccttcttgcatgcactttccatcgttctcacagattatcccctttctgctttgatgttggtgtgtgtgtgtgtgttgtgtccatgcatttgcatggatgacagtgaataacttcaggtgtcattcatcaaaagctgtctactctgttgttttgagataggtctctcactggagggagccctctctgcctccccaatactgagattctaagtctgcatccccgtaactcactttctattatgtgggttctgagttgaattcaagctttcatagttgcatagcaagtttagcactttactgattgggccatttctctaccctcttaagtctttttgaaaatgtccttttagtcatcatcttcctccttgttgtcatctttctctttttctttccttcttcttcttcttcctcttttccttctcttctttttcttcttttttttttttttttgagacagggtttctctgtgtagtcctggcagtcctggaactagctccatagaccaggcaggccttgaactcacatagatctgcctacctctgccacctgagtgctggtattaaaggagagtgccaccaccacctggctgtttttatttttaattatgtgtatctgtgtgtgtttgcaggtgctcttggaagctagtggcattgggtgacctggagctagagttccaggcggttgtgacctgcttgatatgggtcctatgaattgaacttttagcaactgagatatcttttgagcacccccttaattttttaaaaaagatattctatttatgtgtatgtttttttttttttttttgcctgcatgcatgtctatgtaccacacgagtgcctgatgactgcagaggccagacaagggtgttgcatcccttagaactggagttccaggtacttgtgagttgccatgtaggtgactggaactgaactatgaaagaacagccagtcctctttcttattgctgagccttttcttcagccccataggctttttaaaacaattgatccagggtctaactatttattagccctggctggcgtgcacttgttatatagaccagcttggccttggacttaaagctctgcctcccaagttctgtgatttaaaggtggtatccaccatgcctgttcccttaaaactttgtatatgggctaaaataggatctgttttgtagaaagttctacgggctactgagaagaatttatattagacaactttgggctacaatattctatagataatattttgtcaattttacctgtataaacaggtaaattgtgtaactgaggtttctttccttttttgcctagatgagctttgttggtggcaatgagttactgaagtctctcactgtgattgcatctgtattcacttgttgctctatgttagttaggtttgttttatgaaattgcatgtcccaatatttggtgcacatatatctacagttgttatattttcttggttgattattgtattttattagtgtgtggagaccatctttattttctttgctgtgctagagattgaactctgggccttatgtatgccagtcaagtagtgtactgctgagccataatcctatctagagacttttaacttttcttaaaaatttcattttgaagtcagcattgtcacctatcgagtgtagttatttctgtttgctttcagattctctttgctttgaatataatttttcattacttcccattttagtctcagtatgtctttgctaatgaagcaaatttacagataacaaacacttagatcttgagtgttctcttaattccatatagccagtttgtggcttttaattagagacataataccatcacattatgttaaggttattattgaaaaggtatgtactcttcttttccttatcttagtaattggctcatttagcatttatgtgggctggagagacggttcagtggtcaagacttattccagagtacctgggttcaattccagcacctacatgttagcttaccactgcctgtaactccagttccagaagatctaacatctttacatagacatgtatgcagggaaaataccaatgcacataaaataaagataaatcaatttttaaaatattcttttaaaaaagagttaataaggtttgattcttttctcctaattcttatttacccactctatcaagattagtctatcaagatttattgtgtattttaaaaacgtttttaattatggatacttgtatgtatgtatgtatgggcatgtgttcaggtgcctttggaggttaaaactgaggcatggaatccttctggagttggagttgcagtcagttgtgatctacccagtgtgggtgctgggaactgaactcgggacttctgcaagagcttagagttctcagcctccaatgtaacataggttgcaagactcactgctccctatggaagaagggagcgcattctacctcatgcgcctcaaacttccttctacttctacttaacattcagtaggtctgtgtctaacttgccttctctatgtgactttttctgatggccatctcctatccaggcactgtgataggatatccttcagcatcctaggcatccttatcactgacattgtgattttttcccccttgctttcagttctgtagattagctcagtcaagcaatggttcccttctcaaggtggtatctgattattatgctccagcatttggggagtgacagtacactgcttctccaatgttagcctgccatacaggagcacttaatgtggcaccaagtctccatatttgatttaaggcttgcaggactgccacttagttgccactctggctgcttggactctcctgcttatgtgttggttgctacttggcatccttctcacccttgtgatggggctggagctgcggacttgtccttaggtttctttgcctcacctttctgtatctgttttttttttagctgtcttttctcctcttgattgctcattattttatgtctttttaatacagactccctgttgtcctgatttgtatagagattcatagggaaggaaacttctaacctgccaccttaccaccaacctctgccctcttcagtgctttttgctttctgattttattttttctaacagctttatagagaagagtcacatattgtaaaacttttcagctttagaacacacaattgtatcaggtggtttcatgctctatgccagtattgctactgtctaagttgagaacattttaattaccaaaaagagactccctaccgtttaatagtcatttccaccacggctaatgctcagaacactgtaatacactattccttttattcatatacattggcctactttatgcatttcatccaagtggaattgtattatgtcagctgttagggcatagatatgcacaccttccctccctctccctattcccctcctctatttctaagtaaatactctggcgctgagctaaactccaagtcccagtatgtcatttctttttgtggctagatagcagttaaattttggggatatgctatatttttaatttatatactcaataattaaagagcatttgtattgttttgtgcttttcaataatatgctggctattgctatgaacattgatatgtatttttgcataaaatgtgctttagttcttcttggtatatatatctacttatggaattgctagatgatatggtaattttatgtttaatatattaaggagatgccaatttatcatgttggtgctccattttatatatttaccaacagctggtaagggttccaatttccccacatctttaccaacccttactattttatttaaaaaaatgactagagacaggcccaaagtgggatccagctcaaggggaggttccaaggcctgacactattactgaggctatggaacactcacaaaaagggatctatcatgactgccctctgaaagacccaacaagcagctgaaagagtcagatatttgcacccaaccaatggacccctgttgttgaattaggggaggctgaaagaagctgaggagaagggagattctgtaggaggaccagcagtctcaattaatctggacccccgagatctctcaaacactggaccaccaaacagacagcatacaccagctgataggaggccccaacacacatacagtagaggacttccgggtctgcgttcattcagagatgatgcacctaacccttaagagactggaggccccagggagtttagaggtcaggtagggtgggggtgggggcatccatgtggaaacagggtgtggtgggaaggaggtgtgggatgtggaacagctggagggtgggagcggaggggcggggaatggaatatggagtgtaaaaaatgaattataaataagattaaattaaaaaaatgactagagtcatccaagtaggtaagaaatggcatgtcactgtaatgtatatttgtttgattttgagacagggtttctctgtgtagccctggctgtcctggaactcactctgtagaccaggctggtctcagactcagacatagctggctctgcctccttaggtgggggaatgaaaggtgtgtgccaccaccacccagctgtcatcatggttttgatgtacatttttctaatgccttaattctttaagatttttaaatatttctccatcatgtgggttatcttctcgcttacgttgtgttatcttttaaattgcaactttttaataatggtaaagtctaactttcatatttaactatttttcttttgtctcttgtgctttaggtgtcatgaatggttttatttgtagtacaacatttatggatagggaattatcagcatccagtattagccaccaatttgaaagactgtactatacatttcagagtttattttctgacagtttccactagtgacaattgttttcacttgaagacatatgtgactctcagtagtcctctgatatcactttggttttacagggtgtggtcccaactgctcagcgtgctgcaatcgttgtgggagtagagctgcccgtttatgatattaccaagaagcacctgatagtttcaggaatgctgggagacacaattttaacacactttgtgtaagtgaattatgtttgatccattctctgtgtttagcagtttgaacataaaaagcctcttttactaacacttatctcctatggccaaaatgtcaagccttctgaattttttataatttttaacttattgctatatactaatatataaaatggtgggtttttctaaaaaatttgtggaatttccgattttacttttctcattattcattatagaagattgtgtttcagtatgacattttcttacattagtatcacatattatgttcatattcataacgtgcatatgaagcactctgattatattccctcccccacattacccaaatttacccacatatgctgtggatgcctaccagcttggcagttgggtgtagtttggatccctactagacgcttttgtatctccttttttgttgttgttttttttgagacagggtttctctgtgtagccctagctgtcctggaactcactttgtaaaacaggctggcctcgaactcagaaatccgcctgcctctgcttcctgagtactgagattaaaggcgtgcgtcaccatgcctggcaccacttgtctcaggctggcctcagactttgaatttctgatctgcctgtcttacagagtgctagcattatagatatgcagtgtgcaccattacaacctgtgtatttggtactaggattgaagcacgagccctggcaaaaattgttttagcttcagaaactcaacaaattttaccttttttttttcttggctacactgagaggaaatttgccttctggtcaagaacaaaaataaataataggttgatggagctgaggctgtagctcattcacagtgttggacagcctcagctccatcaacctattaaaatttgttgagtttctgaagctaaaacagtttttggctgaagattatttctgctctcatactgcgttttctttgtcatgatatgtcatgtctgatattttgctacttaaatatatttgacatatgatgctgtgttttgacagttgcacgtaactgatcaatgttataggacatgtcctgcttagggatgttgttaggtttatggactatatcctttaaaaacgagtctgagtttcagaggatatgaaagggacaacctttgaatgatgcgtcattagaaaagattttctttctctttagattataattgaagggagcccagattttatctgacggatggatctaagttattatactttttgcatttggcctaaattctgtttaagtgggcaagtgtggaagtgggtggggataacctatgatcttaaattagttttcacctttagttccagtttcacctgtggtttggctggggctctggcatctaaccctgtggatgtggtgagaactcgaatgatgaatcagagggcaatagtgggacatgtggacctctacaagggtactttggatggtattttaaaggtacgtacaccgtgaagtttattacaaattctgttttctttaatgtttaagacctttgccaggccttattcttcttgctaggtattctgaacatcaaacagccattatgtgtatttttctagtagcctctgagaatcattccaaggcaaataacccatctcttaggaaaattgttaatgcatattgcttctttttttttttttttttcttttttccggagctgaggaccgaacccagggccttgggcttgctaggcaagcactttaccactgaactaaatccccaaccccgcatattgcttcttaatattattccaattcgagtgctttaaaatacaggatacatatattaatagcactatgaagaattactgatatcaagatttaatgtatccgaggatatggaaggggaagttagaggggagcaggagaaacggaaatgaagtaaatgagcatttatctgtgaactgctaatttttaaattaagagatggagagatagttcagcagttaagttccaaaggccttgtgttcaattcccagcactcacatggtacttataactctaggggatccaacgccctctgctggccttcataggcactgaatgcacatggtaaatgatacacatgcaggcaaaagagctatacacataaaagaaacaattaatgagacttactatagcccatattttccaaccgcaaataagagactctgtagtagaaagccctggtacttaacaaacctcaaaacccagtccatgatttaagttccaggttgttctgttgatcacattttgcctttagtatttctgttgggactgaatatcataaatgtatacagaagtattggttacattacttctataaaaaattcagggataaaatgcgaagggaccatgtttttctttctgctgttatcagtttcatagaacagctatttattatttatgggacacttttaactgctacagggaaattattgttattcctaagtactggcacttacaaacagataatcaatacagcctaataagtgataaactcagaaatctatggtaggaaattatagcccacacttgagaagtttgaaataaactctcgggggatatctgtaaattgaagactaatagttcccatctattgtatgctttattgtatgacaggagctgttctaatgagacttacatgtattcagacattgaattctccccattatcccataagatagatagtgaagcactgaacttcacgattagcaagtaggaatgctgcaataattcagacctttgggttatagaagcagtcttaattaactaatatacctggcacttttctcattggtgactgtaggttggttgggttataaagcgtattgagggttgtactgagatggttggagatactgaaagcgttaaccgggttccatttgtagtttaagcagatcactttgtctttgtggaaataggatctaagatagtggttctccatcttgagtgcacattggaatcgctaatttcacagctcccaggtttgccttagatcagtcaactcagaacccaggttatcagtatttttagaatttcatatgtgattgtatgttcatttaaggtcgaagaccaccaatctaaggggataagggtggaacagtaagtgtgtcttctaaatgtaacttgcttcagaactatcggaattaatttaccatgtcaaaaatgggacctgagaatttgtatttccagaaaggtcccaggtagtagtgatgctgatctgattgacttaattagccattgatctggaggtaaggttgttgattgaaagtcttatattatctgagtgatgaaggatgaaggcctgaacctcaatatgactgaggcagaaggatgggacagaattgagactaatttagttgattaagtcagtacagttttgttgagatgatatagagaggtacaaggaagagaaggtgtcaaagatgacttcctggatttggtgaccacatggtgacatttggtgatgatggacaaatcatgagaacagggctcagaagttaaaagagcattgggtactcttacatagaacctgggttcagttttcagcacatacatatcaatttatgaccatttttaactccagtccaagggaatcccaataccatcttctgacctttatgggtaccaggcatgcatgtgatatacaaacatgcaggcaaaacatccatacatataaaaaataaaatgaaaaattaaagaacagattttgcaagagacatggtttttgttggttagtttgatatgtatgggggaacagccggtgatattcagggacaatagttctaacttgggggaagtttgtggttggaggtaagcctctgtgggaccattcgcatacagtcagagaaggtagagtagttcacagcctttttacttgctgaggatgctaaggtactatataattgttagcagtaaagtcttgttacaaactgtaatctccagagaaacagtgccccaggcagtcactacttctgtatagttctttaggatcctttgcattcctatgctcttttttcctccctttttctacattccagatgtagtgaaagttgtgccttctgttttccccactcctcttcattctccagatctcctatctcttcccacaaaggccttttctgaccattgtactaggttatatatgcaggtttttttcttttttcttttttaatttatttttatctttctaaaattaattaattgaaaaagtatcttgctacaaagctgagactggtgtgaaactcactatttaccccacactggtcccaaatatacaattccccaggctatgccttttgagtgcgcaagaaaggtttcttatagtccctgtcatagtattacctaaccccacacattctttctctctctcaatatatatttaaatcttccctgagaataaattcacatattgtcaaaaataatttattcaaaatgatatgtagtagacagtattatagtaaacatcagtgatatatgcataacacttggtcaattttagaacatttctatcacctgaaaaacgatttatataccctgtacaccacctctgtttctcccatccatttagtcctgagtaaatactagcttgcttgcttctttctatcaatgtctgttctagatatttcatagaaatagaaccatattgtatgaccttttaaattggtttctttcaagtaacatgctttcaatgttcatccatactagcatatatcaagtctttgattcttttattgctaaataaaacactaaactgcatagctacatcacattttattcatatttagtacatttcattggatttgcttttactggttgtctcagtaaagtttcatggaaatagagatacaaatatttccatttattacatttccagggcagtttatttactaaatcactttatttattacacagcaatagataacttatatagtccatgctcctatagaatgtatgttctagtgaggctgacaaacaagtacacaaattaatatagacaggcagatattggtagatattaacatattgatacatatatttttatatatttaatgcagagccctgttatctgtgtttacctgcagaagttgtttacacacaatctgattcttcaaatatcctggggatttataaagattcagataagtcttagaactgttagagcatcatactatttttgtgtgtctttatattcaacaaatttatattttaaaaaactttaatgttccaagatctgtgaggtggtggggatatgaaggtgaacacggcaaacactgttcatcccctattggaaattctattgtagttgagaaagatagacaaataattttagaaagaattaaaactatgtggaaaataacagcatattgaaatagcaacttggtggtctgaatttcttcagctaggctgcttaacaaaagcttccggataatttggatgatgggaaggagatggccatgtggaataattccataaagagcagattataaagggtctaactgatttgaaatgggtttgacatattcaacagttaaaaggattatatggctgagtgtggcaaatgaatgagaaaataataggaaatcactctgcagcgaggaacagggcctgaatcatgtaggatcctgtggaccactgtttgtttcttgagataaggcttctctggctgtcctggaactccctctgtagaccaggctgactttgaactcacagagatctgcctgtctctgcctcccaagagctgggactgaaggtgtgggctcacctcccccccacatacacaccaacatggcatgatttagaattcctgaagattgattttagtttgtaggtggagattgttggtcagttaggaatatcatggtgactgagataatgataggtttggattatctctgaggtctcttgtcatttgatcctgtaattttaggttatctgcatgtcaactttattttggcctgagtccttcagattttactggaggtagaagcatattaccaaaggctgtgtataagtagtaactttactatgttgttatctatccccccccaccccagtgattaataatgacactaatttctgggatcttaaatggcaggatgagaaaagagccacttgtaaatctggcttctcatattattattttattaaaatatgtccatttcttaaaacagtggtaaaattcatttcactaatgaaaaggcagaactacatttttcagtatctcacagaacgcccaacatattgtcatgacttaatagataactgtctattatataccacacatggcagaattcagcatatgacatcagcttttgaccttcctatgtcatcaagttcttgaaaccacttggtgcatagagagccctgccgtataaatcagggcaccaaaatgcaaagcagttcctattgttcctcacacaccatcctcaaaggattcacatgaaatgtaccatggagtcatggcgcagactaacccctttttttgggtctcctatctgcgtggaacgggtctctggttgcaggtgggcgaaggagtcagcgaatgacaaacagatgcgacacacgagagagtgagagaacgtattgtatctgagggtaatgccacaaagggaacactagtcttatacagaaagcaaaggggtaggatgccatggcaggcaaagtacattgaatttatctgacacaaaacagaggaatgacttcaaaaggacttactggagccaggtaatgtttacagtaaagatagaacagccctgcctagggtcagctaatgacaggtaaggatttcacaatttgtgctactcctttgagccttgtgaaagctagcaccagggggttctgctctagcagaccttctcatgaataatgcaatatcccaacccccctatttcccaggccttgatagattcttccatgagtgtaacttggctgttattttaagtatctgtgaggaatctccatttgtcagaagaattcaccaacttgattctaatatgcaatgtagcctgctatacctgactgtagtgaagattctaagtatactttgttaagcttgctctcagatttctaactctttttttttttttttttttggtgtttggagacagggtttctctgtatagtcctggctgatcctggaactcactctgtagaccaggctggcctcgaactcagaaatccacctgcctctgcctcccgagtgctgggattaaaggtgtgcgccaccacgcctggctcagatttctaactcttatacagtaaaatactgtaagaaatcatgcaagaccctccacgatattgcagggacaaatctgggccattctagctatgggagtgccaaggttccaggaggctgagtttccttgaaactctttgcctcaggactgctcccaggtttttaggcctatcaagtgagtcacttactggagtggatgtagcagagtcacactaatttaaagtaaaaaaaacaagagccagaggaggaaatagctttctccagtccttattcacatccctggttttctttatcccttttataacttctggatataatatgtgtcaacatattagtatctacgaaaatctgtctataaaaatgtgtgcagttgctcgtcaagttcactagaatatgcattccatggtgacatggactgtataacttaggtatagctgtgtgtcttaaaagaacagttaatcttttccaggttttgtggatcaggattgagacgcagcttcattgagtgattcaagattaaggtcctctaagaggttgtaatccatattagctagggcttcagtcatcctttaatggggctagcatatttgcttcaaagatgactaatatgggtgttagttaaatgcctcacttctctatgatgtagtcctcttgtcatggtatgacagctggtttctttcaaagtaaataattcaataacagggataggttacggtctgttttggtgacacataacagtcctgatatgctatagtgtgaagactatacacgggcatggatggctagggatagggacctttatgtgtgccatcactttatgtagctatctctcttacagcagacactctcccctgttcttcagtttcattacacttatacatatcatgtactatgatgtacttggatgaattatccgccattatcatctcttattcctgttcttctccctcagaactccttgtactacccagcacctcctatttgtcttttttgcttgtttgggacacattacatttaaatgctgttttgtttttgtattttgtttttgtggtttttttttttttttgagagagagacagacagacagatcatatagcctagcttggccttagtgtagctaaggatagctttgaactcctgattttatttcctctgttaccagagtgccatgcctagctcttatttacaattatattcccagcactaagaagtatgtgttgtaaatggtgggtattcagtaaatagttgttgaataatgaatggtttgaatggatttagactacaaagtacatcttcagaaaagagactattcgtagtagcgatagttgccgggatggccatgtaaaatggttgtcaagtgtaatcaaagtgtaatgcgctgtttttgcttatgtctttacctcagatgtggaagcatgagggattttttgcactctataaaggattttggccaaactggcttcgacttggaccctggaacatcattgtatccttttagaaactgagaatggaaggcagtgcctcaaattgtcaggtgatgctaggttatgggaagagagatttaattattaaatcctttatgggcaagtaagaaactccagcatcccattggagaccactgtgaatggaatcaagtagagatacaactttctcttggaggcaaatatacattgagagggacagaaaagatgagccaaacattcctctctaaataaaaacatccgatgagatggctcagtgggtaaacgtcctcgcctctatatctgatgacctgagtttaatcctggggacttgtggtgcacggagactactggcttctgtaacgttgtcctctgaactccatatacatgatgtggcatgtacatgccctccccactccccagcaaatacacaaacaagcaagtaagcaagcggacaagcaaataaatgtaataaaacaaaatgtcaaccacagccagtcttaaaagggctctgaaattttttagcaatatcgatggaagatactcacaggaatgtccatgctattgtggctgagatttcttaacctataactatgaaacccaaatagctggaaaatactaagaggacacaaatcattgatagtatgaaagaatccacagccaagtagagatcttttgctgtgggtgaatctctctctttcagatgtgttgagtgcctcccatgtacagagccatatgctggatactgtgtgtggtgctgtgtgtgtacctgtgagcttagcagggttgaaaaataattcactgcctttctggaatctgtaggctgaacaggcctttatttggaattgtgtataagagcttttctagcaccgaggggtgtgtgtgtgtgtgtgtgtgtgcatgcacgtgtgcgtgtggtgtgctgtttgcttttgaatactcttataatgtgttttcattgctaagtgctcccgatcataatgggtacatggtaggtactcaacatattttatctcaagaaaggccttttaagccaattccctttagactaagtgaatgaggagaacgaaatgcacaattttaaaactgggcttagctctcactctccacccaacgatcttccataactcattcttcagttttttattacctatgagcagctcaagaggcttcagatctaagacctggaaacccatcagcccagccctgccaccgtttctaccggtcctctttgtgttcctgatgtattttgacaaagatgtttgtgtttacagaagcagcgggctgaagagttgtagggtgactgaaggttgttttgcatttgtgttgcctcttccctgagaggaagtatcgactttgagagtgtgaccccagattggtgtcttctgtgaagatggatactggtgggtgacattcaaaagggccttcttttcaactgtgagttaaacgtagttggttttccccagacaggctacagcagcaggctaccagcacagttcctgctatgtatgcttttgaccttggttctcattaaagtatttattggttgaa

SEQ ID NO: 427 - DNA, 881 bp, mus musculus
aaatgaccaaaaaaaatcacacccagacgatgacagctatattgtgcgtgtcaaggctgtggttatgaccagagatgactccagcgggggaaggttcccacaggaaggaggcgggatcagtcgcgtcagcgtgtgtaaggtcatgcgccctgaaggcaatggacgaagcggctttctcatctatggcgaactacagaaagacaaactggtcgtattggaatgctatgtctgaaaggacttggtctacaccaaagccaatccgacatttcatcattggaaggttgataacaggaagtttggacttactttctaaagtcctgcagatgcatgagctcagagatgatgacgttttcacgacagctacggacagttcgtctaattcctcgcagaagagggagccgactacgaggacaatctcctcccccgcgtcttgtgagaaccagaggatttatacccttgacccataccccatggaccattaccaccctgaccagcggttgccttggtcctacccccaggtcatcttcccagaagatgatgaagaaattgtacgcatcaacccccgagagaagatctggatgaccggttataccggcacggccggttcgcggcaaatacttagacaccacagaagacacagactcctacgtgcgcttcgccaagggtgaagtccccaaacacaaatatacctatgcctatgttgattcttcggacttcggcttcggggaggatcccaaaggtagtgtgatcaagacacagctgcccagggccaagtcccgtcggcggaaggagaactgcgaacggtcgcggtgtgtgtacttaatcacgagagaaccgaaggggccactgccaagacacgcccgatgccgtgagaacttgca

SEQ ID NO: 428 - DNA, 881 bp, mus musculus; identical to SEQ ID NO: 427

SEQ ID NO: 429 - DNA, 79518 bp, mus musculus
cttctcttccccctcggggcctagaggaggccacgcgcggggtctccgagctctagggtccggagctctagggtccttttatgtagcaaagtcaggcctgggaacagaacttcatgtgcttgtaaaaagtctcaggtgcgtcctcgttgttttagagacttggagaggaatgggggcggggggaacaaaatccgaggacagtcgagccaagaaaagtcggggcttctaggatgccaaccacgccaaacagatcaaaaccaggactggaggactgaagatgaagccggcaaaaagtcaccagccacggctcttgtaaggtaggtggtaaaccggagaagacatggttgtttctagaagattggaaaacgagcagaatttttaaagcagtattctaaacatttactatattttaaaagtgttaaagctacatatgaggaaaactaatgatttcatgcccaaagtacaagggaatttgccccttaaaataaaaacctatatattacacatgcaaagtgaagttacgagaatgtgtggcaagggcggttttggtttggtttgtcttgcttctcagattagtttgtttttactttgtaatttctcaaaattggaatactttgccagaagtgggaaaactttgacaatttcttgggatagaaagggcttctggatgcagacataataatgatgccaagcacttagaaatctgcagtgattgccaggggagcaaatggtctgtgccgagcactttctgcgctgccgtaccctgcgtgcatcgggttatatttcagaagacgcaagcttgagtgcgtgcttatacgatcctttccttgtagacattgctaaaggtttagactttgaatcctggtcagtgttaaagccggcttgactgtactattcaacgtgaacatctcagccaaggctgtgtattcatagctatgttgtatttatatttttatacaaccatcactgcagtacaaagggtgtgactgcacctgctggccccttttctttgaatatccatctgtgtgactgaattttggaaatatctattccttttttaaaaactgccttagagatcaaaacttgagcaagtacagcgactacttatagcttttttttcttcctttattgaaatatgcttaaaaaagaaatatgcttaacacatgaaaaatcgggtgtatttggtgcatacaacacatttatttttcctcaaacgataagcacaatcaagtatcacaagttacatgtttgaaatttactgtgctgacaatattcaagagaaatgctaatggcaaacttcattaaattctgtatgttgtacaggttattttttaaagatttatttgcttgttttacgtaagtatactgtggctgtcttcagacacaccagaagagggcccggattccattacagatggttgtgagtcaccatgtggttgttgggaattgaactcgggacctctggaagagcagtccatgctcttaaccactgagccatctctctctctcctgcccgtcttacagtttttaaagacatttttcgagatggaaatttgtagcaaattctgcaaagtgtacagctagaattcctaaggccacacacaccccttaagacagggtttctctgtgtatccctctagctgtcctggaactagctctgtagatcaggctggcctcaagctcagagattcccttgcctctaggatcaaaggcgtgcacccccaccacctggctgagttcctaagtttcttaagctttattgtgtggacctgtttcgttattatgtggcaatttaggtaaggaaggacttgataataaattccttaaatgataatattatagatactttatattgctgtatagagttttaaatattaagggagaagctagtgttctttaatgaacagggtcaatatagaaactctttggaaatttcttatttatctaaaatccagtcctttgaaatatttcaggatattttaatctacccagaaatcagaagtacaggtttggaatttaaaatggtgtgtgtgtgtgtgtgtgtaaatctgactttattattgatttgttgcaatttactggccataagtacgaaactatatgtgtgtactcaaaagaaaattggaataaatttgcaaagaattatcagtgcttgatccaagactttatgacattgcttttgtttctgatcaagatagggcggctttctaaatcctttgcaagcactgtattttagggaagaacactgtaagacttactataataaaaacataggaagcactcgttaatgattcatgtgtgaagaaaatgtggttgtgctctgtcaaatgaacctatgagacatattcaagtcccatttgactggaatttttagtcactccaggagagacttaataatacggagttgggatgtggcctttcctgggtcctccatttagagtcccagccacgttgcctcctactgaacacagaaggccaaatacctcggtgagaaaatggaggattccctaggaatctgatcctgagacctaagtcacctgataaggagcctaaatttgcatttccctgggagctaaattccagagtctttgttttcttcagagggactgctctccgaagcacacgattagggtaagagtagggaaatcttggctgaatgaagggcaggtttgttgcgccttgctagagtacagatggaattcttgaagaccattcatagctaaataaactgggtgctacatgcctgtatgatgtcccccaccagaacaaacggggtggcacctttctttctgcaatctcttctcacaagtttttttttttctttcaaccaaagagtaggaagtagaaggggctgattaatcacgtttcccagaataatactatcacccagagggaggtgttttccagtaccctgtggtgagagtgtgtctaacagttaagaaaggttggctctttggttaagtgggtctaggccctgaaacagaccaccttcaacttcaaagaaggagcttgagacaaagatgggatccaagggaagaaactaaagaggaattgacagggtggttttgtgactgaggacagctgcctgataggccagttattgcaggtcctgtagctcagagtcagtgaaatcaggcaaaaaccaaagcactcgaggagctttgtggggaggtgctgggcatttgttttctggctctgcttcttgaccaaggtgcaggagctgaacaaacctgcccttcattcagccaagagtccctactcttaccctagtcatttgcttctgtgagccatctccgcctaagaaaacaaagaggactctggaatttagctccggggaaatgccaatttaggcaccatatcaggtgacttaggtctcaggatcagattcccagggaatcctccattttctcaccagggtatttggagtctcaaaagacactcagaattgatgctccattgccaagatggaggagagcctaaagagaagaggtaaccttttccaggcctaagagataacagctacagtggcagtgaaggttttccccacggtctagtggaaggcctgctctagactagtgtagctctcaaccttcctaatgctgtgaccctttaatatagttctcatgctgtgctggcccccaacatagtaacatcttcattgctacttcataactgtaatcctactactgttatgagctgtaatgtaactatctgctttctggtggtcttaggtgacccctgtgaaaggattatttgacccccctcccccaaggggtcacgacatactggctgagaaccactgctctagaaggacatgctcttacctcagttttcatgaggtgagactttgcctattaaaactggaagtcagtctagtaataaaagtgaaacttatgctacttgagacctaacccttgattcatgttagttagcaggtgttattcaactgcctgcttcttagcagctttcaaatggagattccctataggccttctaggatatcctcttaagagagttttaagcacaccaggaaccctaggactcttggtgtcagcatagtaagaaatattgattatttcatagtcactgtacatgaacatttcccccttgtaatggtggtgttggtagctgagcactcacaagagaggaaggaacgctagtctgctgtactgccgtaaggaacgctagtctgctgtattgttgtaaggaacgctagtctgctgtattgtcgtaatgcttgctcactacttgaactcctttacccaggtatgcttcacctctcctgctaagtcttcatccctgtctatgaggacaaagaagttacgggttaaattggcgatgggccaggcgctccttgaggatgctctaaaggtaagccatggaatgaatggagacatttgaaacagcttgtttccaaggtcttgagtagtatgtgacagtaacccatgccttcttcggctgactgtaggtaagcaggtggtgagaaatgctacacgagctaggttaagctgtgcacactgaaggcatagtttccccttgtgctagactaagggggttacatgtgtgaagatagtgcattgttcttcaagttagaattgtgggccacagataaggtagcacaatgccctaaacatcttaaggtacaagaattttgtagtcacatacattaagagattacatctagccagaaggtgagtggaaacctaaagcagtagtaccttcctgggtcccaggaattcaaaaatgacagattgcagctacggctaacagatagtcttcaaactatttgtgtcagttcaaatggtatctcagaatgaaagggtcagaggaacgaaacaattcagtgaaggcataatggacccctgacttttcctgtgctgaagttaagctacagccccctaagtactgccataatgcccccatgctttaagtgagcaagaacatgaaagcaaagtcattgctacaactcagtttgtgtgcagatttacagaactgtacaaactctagccagaaaagcaatgctgttcattgattcgccgcttccaatgtcaatggttacgacagttaacctttctcatagacatctctttgtccaaagactgcctcgtgaaattggtcacacagtcacgctctacaggaaaggtaggcacaaagaggaagggtgaattccttttgtaagagtaccagtggggtagggaaaggggggcatttcctctatgcaaaatagtcgtcttcaacttttagaacattgaaagccatttccaagtcctctttaggggagagatagctgcctttgttttaggaatgaaaaaacagatttttgtttctttcagatgaagctattttggttagagaataggtcaggagccatctaggacaggttagaaggtggccttcctggaggtgacccacagttttgcatggacgaagatgagtgagctctatgaggcaaggtcccaaagagacttcatctcaggactgcttcttgcagctgatatgcctttcctatcattattaatattatataatacttggacattagcttatcctattgcagatttcttgcagatcaacataaagatgaactttcatgaattcatgctatttagatgaattagtaattttatagagtacctaatttgattcaaataatcttaggaagaaagttttaagagacagttctagttgtttgctaggaagatgtaataaagttaaaatcaagaatagaatgtgcctaatcttcagaatagtaagtaaaagttacataataagaaatacagtgagctttcatgattactccaaaaagagatacaggcttgacaagtttgtgttcaaggtaaaacattcaggtcccaggatgaagccacaggtgtgtactatgataaaacaaggccatgagaaacttgctttggacttacaatgagtatagagaatggaacactgctttgaacttaatatcaacagccttttgtaacttccatttgtggagtcttttacctatgaggtaattttccaagaacttttgtctattaaaaggccagagaaaagaaataaaggtggtgtggtgtgctgtgctgtgctgtgctgtgctgtgctgtgctgtgctgtggtatggtggcttggggagctctgcctcatccatgcatccatccatgcatccatccaaaagtgtatgtctgtttgtttatatgtatgtatgtaggtatatgtgagtgtatgtaagcatgcacaaattcctgtggagttaattgagagaggtgctcaggcctgaccagagtgtgggtgtatggatgaaaatgtgtcggtgcgacgtttcctgtgtaaaggattcttaattctcttcctttccgtcctctctggttcgcaaaaacttaactagccaagctagtgaaggacttctgcgtgccaggccagaaaaaaagagtattagcattaatcctttagctaacctcccctacccctaggtgttaagcaaaaggtgattaaattcacctgaagccattggcttctggccctagtataactaagaatcaaagagagtgaatattattaacactaagcaacctttacagtcgtgaaaccacattttgtcccctgctgacttactgcccaatcagccgcagaggacacaagctgggaaagctcctggcaggaatataagactttctctacttatttattatacacatgtttaaatatgttcttcacagaaacatggtgagcaaaatagtgactaggtccaaaggactaattgtgcaactgccagttgtttattgccttcaagttgttaaaaatctgttattagcattattattctcactaattttctgtgtatgggcatttggtcggcatacgtgtctgtgtgccccacacatgaatggtgcccacagaggccagaggagggcatcggatcctctggaactggaggcaagagttgttgccagccaccgtgagggtgtttgttggtaaaagaattcaggtctcctggaaggacaagtgctcttaaccactgagctctctactcagcctcagccttgaagctttgatttattcttatgtttagaattaaaatgttgaaaatagaaaacacatatttgaatttttttaaaaaagaaaaaaaaacaagaaaaaacccggtaccatttaaaaacataactgaaaaatagccacgtctttttctctaaaaaaaaaaaaatcatatttctatgcaaaatttaaagatcactttttattggcatgtattaactgcaaaaaggcaagtttcacaattgtatttcttttcttttgtggggaggggaccagcgtttgagactcatggtgtagcccatattgtcctcaagctgatggccatccttttgtcagcacgcatgagccgtcacacctgctagttagggcattttcatatagctgtttatgatattttgataacaaacatcttttctgttaccttgtaccttcttacatactgtctttccctcttccatatccccatattcccagtagcccccaaaagcctccctcttaaaagacctcactcttaatttttatgcacgtggaatgctatcattaatttctacgtgtaataacaagggttatgatatgaggcctgagaatacaggtgatagaagtaactgaagaggcaaggatatattccttatatattatacaagtcagagtcaataccaacaaattccatcagcctgtatataaacatgtgctatatgttgtcaatgtaaaacagcagaatgcaattgatcacagataagctagctatacagcatctaagagtatttgtttcagttgctgtttttgtttgtttgcttgcatgcttgtttgttgtttgccaatatgcttgctagtctttgtatttgttcagctacaaggtaatactaggagggggctggagagatgatggctcagcagttaatagtacttactggctgttcttgcagaggacctgggttcgattcctagcactgacattgtgactcacagcctcctgtaatttcagttccagggaatctgatgccttcttctaaccatcacgaagacaaggtacacatgtggggaacatgcaagcaaaacatattataattaaagtaaataaaaatgtttttaaaagaaaatgctatgttatttacacccctccatacacacacataccaaaaagtcatgtttcctgtgaatagtttattcctgtttgttgagtgatggactaatggcatcaaaccatgtatagtgtaataagaaaagaaaaaaatgaaaatgtatggtatatattttttttaggattatgcaagcataccacaatttcagcatatcaggagttcagggccagcattaagctacatagcaggtttgaagacagtctaggctgagaccctttctctcacacaaaagaatgcaggttgtttaataatgagactaaatcgatttaattaagtaacaccagtccttttaaagagttgtccatcgcttttacaatatgccggagctaggggtacatctcagtggtagacgccttacatatatgtacaggagcctgtgatgaacctaaacatgcagacctcttagtagtctttcagggaaattgagtttggagtgaattgagtccacttgtattagagaagttgtatagtctagagattctctaagaattgagaataaactcagaataaatatgtgtcgaaaaaaatcactcaagaaatgtgatctgttgaccacttgtgatttaatatatttgtttttccagttggtgatagaaaatgggagaactgaagacaaccactttataaaacccttgcctgcttgaatttgtggtgatggtaagttctgtattttttgtccctgactagtctgcaattttaagaaatgttacttccaaaaccacagaagttaaagaggaaacattaaaactattacatattctagggctaggtgtggttgctttgaatttaattccagctctcaggagtcagaggcaggtagatggatctctgagttcaaggcaaccctgggctacatagtgagaccttgtctaaagggggaaaagtacatattccaaagaataggacctcatgcttgtaggacctcagactatactaagaaaatggggaaaatgagagaatgtatcatgaccttctaattttgattaaagtgcctaccatttttttggctttatagatctcaaaatgcaaacaaattgccagcaaccatgcacatgcatacacacacacacacatacacacacacacatgcatgtataagtaagctagaagaggatctacttttaagaataaatataaaatgttttccatttagggaaaataaattaatatgtaagtattctgagtgtacagttggtacagaaggctatagagaaagctgtactcagtatgaatcaaatcaccattaaggtggcaggactatgtgcttatagacatatgtccataacatgtagcagtatacgtaagtatatcaaacaaaataagcatcatttatagtgattcacttactaaaaatgagaacttgaaaaatgaatatgtaattttgtcagactgctcgggaatgaggagtgaaatctatctgttgtttggtttctttatttttcctcctttttaaggtcacaaattagcttagctttgcctggtaacacttgtggccttggctggcctcaagcttgtgctattcgtcttgcttcagcctcccgagcagtaggatgaccaagctgactcaccacacctggctcaaagcctggacatttctgtgcgaaccataatgtaaaaacatgtcattttaatacaaatttctcgttatatatgaaagtagactttactgttgaaagggcctaaaggaaatactctgaaagtttatcagtgatctgaaagactgtgggagaagttggtctactgcatggttgctttcggaatctttgacttgtactgtgtggtagagcctagtaagaaaatagtttttatacttttctctacaatacagaagattgccccaaaatactgaacgatgtcagattatagaaagcagttgaaggctatttaatgacatggcaaagtgtccatgcagaaacacaggtctcacttcaaagaagataagagatgatggtcatttctgaccatgacccaggaacacaaatactcttatgttccatagttgaagtacttacctgatattttattattaaacaaagtcataaatcaaaatatttcccaaatgtattgggagaggtcacaggtatgtgagttataaccaagggaagaattctgatgtaggtttcaaaatagatatcctttagattggtgaaagctagtggtctgctaagaatatattttaaggtgttgatagtcacaaagatgtcacagacaccagatggcagtggatggctttgagagggattgaaaatagcacaaggtagttcagccttggtttacaatacctgtataaccttaaagttcagtctagtgagcctaaagttgactctgtgagcgtggtggctcatgcatttaatcccatcacttgggagacagaaacagaaagatttctgtgagttaaaggccagcctggtctacaaattgagtccaggacagccagggctggttacagtgagaaaccttgtctcaagaaaacaaaaataatagccgggcatggtggcgcacgcctttgcttttaatcccagcacttgggaggcagaggcaggtggatttctgagttcgaggccagcctggtctacaaagtgagttccaggatagccagagctatacagagaaaccctgtctcgaaaaaccaaaaaaaaaaaaaaaaaaaaaaaaaagagagaaagaaaaaagaaaaaagaaaaaaaaaagaaaagaaaaagaaaacaaaaataaataaaacaaagttcagtctcttggatttagcacagggtcagcttctgttcttccttctggtagctttatttgttcataaaagcctaagaaaacacttgagtaatctgactggcatataacacacacacacatataggaatcctaccatgtattgcctaaaatgatgagagctcttttggcatcttaaggtcttggccaaatggctgccaacaattcagcctataaagtctttttcagaatatggtgagttacttgggtgatgagaagatgaaccaaaaaaggactttacctagagaggtattcctgagctcaagttaccatatcttcccttcctcccctcccctctcctcccttcctctccccctccttcctgtcccttttctttcctttcctcttctgttttcttttcttcccttttcctccctccctccctccctccctccctccctccctttcctcctcctttttcagttttaatttttcttaggcttagatcctttatttgtcttggagctaacaacttgatgacttgggagcctacgaggggtgtgtggagctcagtgaacgagagagcagagctcggagggcaagggcctttgttgtattgttttgcttgtttcttccatagaaaatcttaggttaaggctggtctcctgcatcagctgagactgttagggactctcaacagagctctgcctggactgggactcactctgtagaccaggctggcctggaactcacaaagacctgccttcctctgcctcctgcgatcaaaggagtacccaatctaaaatttagaatattttaatatttttttaaaaatcttttcaaatctttttttttttttttttttttttttcttaatgcttgatgggcacaatgattttctgcctctggttttaggtttagaaaaacagacaagaagttttgttttttaaatgatcctgttagttgtgcttgctggtacctttttctttcttttttgcgagtgcgatgggcgggagaagaaaggcgcgcagcctgaactgtctgtctagatggagcactactgccatcgtgaggatgtaagttcaaatcccagcgcgcagttattagcgaattctcgagagcacttctggtttttccaactccattccgtaaagaagactacccggccctaacatcaaaatggcccaccgtttcccttctaagttagtctaggcgttctgagctgaagtttgatgctgacaggaaaacatttcatccagtgttgaaggcaggagctgcccgccactttccggaagctgggaggcgggactttggctgcggaagccttgagcctagagtcagctagctgcctatcacccgctgactggttcaccttttactgaagcaacattacagcttaagaaactaactgaagggctggtgagatggctcagtgggtaagagcacccgactgctcttccgaaggtccagagttcaaatcccagcaaccacatggtggctcacaaccatctgtaacaagatctgacgccctcttctggagtgtctgaagacagctatagtgtacttacatataataaataaaaataaatctttaaaaaaaaaaaaaagaaactaactgaaagtcttacccgccaccaccaactccctgttgaattaattgttttgagacagtccttcaccgagtcaaggcttccaaggaaactattaggtatcttctttatataatgaatgcaaaagaatgcaaatccctataagaaaaaaaaaaatctccggtcacactaaagtacaagagaaaaaaaaaacttaaatttttttccaaattaacttcagtgaaggaacattccttttctgtagtaaacccccatctacctttgtagctccttgtatcccctttagattacgtatgagagagaataagcgatacttttctctctcaatattatatcttgttttcagtagtggcagatggagactaagttttagagccaaccagaaacaccaccaaaaatctgaaatagatcttgatttttttcctaatgcagatatgacgagccagttaaagaccgtttttcacttcagtatgtatgacttgtgttaagagatgagtcaatgacacaaagtctgagcagctgctgtttgtgatgtatgtatgtttgagaaatttactgctcaaaatgagatactgacatggctccaaagaaagatagctgagcacgtcttctaggaatccaaagcaaataggtaccttccatttcatttactctagcccagtaaatagagaaggactatctatagcctccaatggtagcagtctccttggctagactttatcttaaaagaaataagcttttgtgggtttctccttctctccccaccccccagtttattcatttattcaatcatgtataccccagtgcgtctgaaccattaattagtaattaattaatttaaataattgagactcatctttggacagtagagctagtcaggtggctataagaagcctgttgatactgccccattgggaagacatttcccatacactcattttccccacttcttaactccttggctgtaagtccctgttagcctttgctgtcttcaggactgagcctgccttatttctcccttgttgagagatttatttatttatttatttatttatttttgagacagggtttctctgtatagccctggctgtcctggaactcgctttgtagaccaggctgggctcgaactcagaaatccttctgcctctgcctcctgagtgctggaattaaaggcgtgtgccaccacaccctgcccgagttttttatttcgagtcttccttgttttaacaatatctaattttatcaacaatagtaataagtcaagtgaggttgcttagaaatgcctacctctgtcattgatttttctgaatttctttatttcccttaggccaggcttctgaagatttgcttacaaagcagcaaacaataatttgggttgccaaagatatgaaacaaagagcagtagtatagtactaagaaatcaagggtcgtgctgagaatggtggtgattaccatagtccccagtttggcttcagacagaaataacaagtttactgtgtggcttgtccaagcagggcaaatataaagcagctgccatgtttcctgatgctcttgcttttggttagcattttcgttttcgttttcgttttttttttttttttttatagcttggaaaggcggggaaggagtagggcatttgtatgcatacctggaacgttactgccatcttgcggaagtagcttcattttgaaaaagacaaggcgattgtttcagtggtgctaatagctgtagtaatctaggcccttgagaagctgaagctggcatattttggtgagttctagactggtcaggtctgcatagtgagtcttcatctgaagaaagaagaatagggtcatgaagacgtcattcccatgttctagcagctaatcctgcttctggggagatctcagaggcttgcactcagacttggcttgcttttttttttttatgcaaatggctctggaccctgatgtattctattctctctgtggaccaagagctgtcagaagacaccggcacaggaagtgaaggggcaggatcgccactcctcccagtttgctctgaactgtgagccccactgaaagggtcagctttctttggtgctctggctcagacagcactgtcacggtgagcactccctccacctttggctggctggccaagacattcattcacagatcaaatacataactcatgcttgtaagctgccctttactgtcctgtccaccatactctgaaagaaactaagagaactccaaagcctagtattactgcaggaaagctaattcttggtccacaggacgagactcagaggaaaatatcccacaaaaacctggatttatctccaaagtcctgcaagtcttagaagagaggtattacttcatcacttcctgagtctgtgtgccctggaagctgcaggtccctgtccacaaggcctctccagctccaggatctgcacaacggaagttttaggcttcagatcataacccgggccctagtaataatgcttatgcctaaggaagtctagctaagagcagaggccagggctttccaacccctcgggcctcatctttgcatgctgctaagaatcatgggaaggaagctgctaggacgtgtgttgctttcttcaaaactctggccgcgtggtggcagtagggctccagataccacaggccgccatctttgcatcctctactcccgcccttctgtgtttgaaaaaaaaccaaactgttctctgacaggaaaaagtgctgaggaagactgccctccgttttgtgaaaatcagtggagctagttaacagcagccattttgcttttgttttcttttgcaaagcagcttaagggctaaaaccacctgctccgttcagacttttgtggtttccctaggtaaattgtcactggatttttgttcactaaagtgtgatttctttcccagagtggttcatgtccaatacattagccgttgcctttttaatgctgtaaatgatgtggacaaaggcagaaaagggaagacatttcgtaagtcagtgcacaagttaagttcccctttagttctttgtgttgaacccagatccatgagtatattaggcaggctcatttgctataactttagatcatgtgtgtatatgtgcatatatgtatatattacgtatatatttgtagttatataattttatgtagataatatataacacacactatatatacatatacaactatatgattatataattactgcatttatataaccatatgattttacatacatatttgaactgcagattgaacttggggcctcaggccttggggccttccctgaggtggggaagtgagtcctctaccacagagccatacatgaagggcattttccttttgaagcaaggcctcccagtgttgcttcgcttgcccaggaatttactctgttgatccggctgctctgaaaagtaagatccagagcctctggagtaagtggaattacaaatctttcccttgttggacaccctgctttccttttttccccctcaggcaaggtcttactttgtgagaccaactcccaagtctcccgctcctggcctatctaggctctgtctgagattagaagtttgttctatcatgcctcgcccaaatagcctatgcactgcttactctcctaggcaggaggaagtgctttgtggtttcgcattggcctgaggcatcagagaaggaggattgcagcaggcattcccacacctcagtcacttatactgctctactgagcacttaacagtgtctatccgaagtcactctgggttctgtcattttctcccatgagaattcagtacattccaatgtcatgagttatgttccatcacttactgtgatgtttattgggggaatggtgcataggagacattgtttcctaatctttggtagatagagtaccttgttgttgagaaggagtttctctgtggagccctggctgtcctagaactcactctgtagaccaggctggtctcgaattcagaaatcctcctgcctctgcctcccaagtgctgggattaaaggtgtgcaaaaccagtacctggctggtgctgtatcttgtatgatgtctcattactaagttaagaatgacactttcacagcactccgaaagacagcatgctggctgtaaagtagtgccaacatttgtttcaaagcaagtgataatcttgttgagtatgtatgtgcacatcatttcacatatacatgcatgcatatatattttatactaaaattggatgggataggtacattatagtttggatcagatcagtttatatttcacaaagacttgaggaaaatgagattacaggaatgttgtcaattttgcttatcaccatgatgttataaaagcaatgttttaaaaacgctctaaaattactttagaactatagatcgagtgaggtgcttttgtctgagctaggatctctagtactagctggcctgggaatttgcagtgatcttccttcttgggataattatcgatgtgggcaaccagagcaggcctgtgagatattttgtttatttaaccaacctgtggcttaattgctggtattgcataattcctttgtaggaaagactgacacaaagtacgcgttaatactgatgtgagaacaggtgttcagatccagtggactctgactacatgaacgggttaatcactgttggaactatatacgatgttgagagaattgaagttgacagtgaggttttgtgtgtgtgtgtgtgtgtgtgtgtgtgtgtgtgtttgtgtgtgtgtgtgaaaggctatctatgaagccctagttgcattgaactacatgaaccaggctgctcaggacccgagttcaatcagacatcaggagaaagcactggaggctgggtgctgctggatccagatgggagcaggtccagcctcctttgatatgtcattgataaaaaattcaaaatggaaggtaaattctaggagtacagcattgcaagcttctgacacagacaagggaggctagaactgcacagttagtggatactgcctcagtttgacattttttttcagtctgtgaaggcggggacagagagctgcagtcaagacaccttccctgctctggggcaacactgccatcatgggaaaatgtttcctgtagactagcacaggcacacacctcctcctccatcctgcttctcctcagccattttgaagcagggaggatgagggggattcatgaatggcgaagcttgcccgttttactatatttctctcctgtaggcagactgtcatcacaggacccttcagagtattaatgcagaccctggtgacagaggtccagtaccaagtgctcagctgtgctgaggtgcagggacaggaagcagatgggcggtttccagcccgctcagctggccatggtaatctactagctggtgtcctagggcagcaaggcgccttcctctccaggttctgaagagaaagcactgcagtcccagtttctgttggggtctgaggagaaggcaaggcagcccagctaggcacccacagctgctcctgctgtctgtaatcggccgccatcttctgccattgctaggaatcatgggaaaaaggagagtggctctgtgagttttgaaaccgtgtcctcatggtggcagtagagctccacacaagagcttgtgagtgcctctcccccgcccttcctgtctgaaaaaacgccaaggatgcatgtccaaacttttacccaactttgagtaatttaaaagttattttatttttttggtcatgtgttccatgtgaagccaatctgagacgtacttataccctaggcggtgggacttttccttcagttatgtagggtttttcccttttctcgctctatagctatggatttttaccctaatccgatatttaatggtgttaaaattttgtctgattaacttttgtaagttttaaatgataaagatatgatgggagatttagaagcaaaggactatgctgagccgtggtcctagtgaactacaagaggcaggctggcctgggcctttccaggaggcttctggtccatgttaccatgctcagcggacacgagtaggtttaaccttgtcttaagtaacatcagcaaacaaacactgggcagttgataattatatcccagcggcgatgtccatgctgcccagttttctcctctgtctgccttcatccaccatgtctaccctttgaggacaagtcactcgaagggaagtataacaggtctgaatggagaggggacagtggagaattactggtgaaaaacagtaacaaagtcctagacatcctcgatcctgggcctttgtctctagatattggttatggtatttatttttttaagattgagggtgggagagaggtagtccaggatggcctttgtgaccatatgtggtgtccttctgccatcctgcaggcagagctacagtgctgagccattaaaatctcattcccatgagtcctagcagtggggaaacaatgccaggttagatagtttgggttccacactgggacccggtgcctttcctctagagcagaagtgtgggcaccagtaatggcttcgagctgaaaagaaagacaaaggcgaacagcagagctgtagggacaagctgacacaggaagttgttggccaggcctttggttcttcctatctggggcatgacaagaagacaccacagggaaaaaatgcaggctctttgtggagaattcggtctcctgctccttgtagcatgtgtaggcaggattttaagccatgccttctttctaagacacagagactccctaattagtccacgctgttcaagcacacattatgtagctcaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgaaaatcagtgacagatcttttggaaatcagtcattggagagacctatgtttcttcaagtaggcatgttcatagcattcagtgttgacaggtatcagcatcctctttacagagccactaagtgagcctgccacaggacacacaaggccttttgtctggggctcttgtgtggatctcacacagagcatgatacccagggaagtgtaagtgtgatctgggtaacaaggacatgacctgacgcctaggtttgcttctgttgatgcactgaggtgacagtgtgttctttttctccctagaaccggcccctgggatttgctgctcagaacctgagttcactgagacatcaggagcaagcactggaggccgggtgctgctggatcctgatgggagccatgcaggacttgaccatggcctgcacacacttcttcccaggagaaggggaatgaggaaggtgggggcctcaaggctttctttccatctatttgtgttgctatgttcttatattcctttttttctgtttaattatttatttagtacaaaatcaggtccagcctccttaggtatggcattgatataaaatgtaaaatggaagctaaattctaggagtacagcactgcatgcttctgacacagacaagggaggctagagcagcacagttagaggacactgcctctgtattgacatttttttcagtcagtgaaggcggggacagagggctgcagtcaggacatcttctctgctgtgggacaatactgccaccatgcgggaaatgtttcttgtagaccagcgcaggaacacatacctcctccatcctagttctcctcagccattttgaagcagggaaggtcagggggattcataaatggtgaaatttgtccttcttactgtatttcactccttctgtaggcagactagaatcacagaacctttcagagtattaacgcagaccgcagtgactaaggtccattatcaagtgcgcagctgtgcttcggtacagggacaggaggcagaagggcaggtttcaccattgctcagctggccatggtaatctactagctggtgtcctagggcagcaaggcgcctccctctccaggatctgaagagaaagccctgcagtcccagtttctgttggggtctgaggagaaggcaaggaagcccagctaggcacccacagctgctcctgctgtctgtaatcggccgccatcttctgccattgctaggaatcatgggaaggaggagaatggcactgagagttttgaaaccgtgtcctcatggtggcagtagagctctacacaagagcttgtgagtgcctctcccccgccctttctttctgaaaaaacgccaaagatggttgtccaaacttttacccaactttgagtactttaaaagttgttttatttttttggtcatgtgttccatgtgaagccaatctgacacatacttctacccgaggtggtgggactcttttcctttagttatgaaggttacttcctttttctggttttataagtgaatttttaccctttccagatcgtaaatggtcttcaagtttggtatgattaattttgtgtaggttttacaagataattttatgctaggagattcagaagcaaaggacaatgctgagccctggctctagttaagtacatgaggcaggctggcctgggcctttccaggaggcttctggtccatgttatcatgcccagctgacatgagtaggtttaaccttgtcttaagtaacatcagcaaacaaacacctggcatatattatcaaattatatcccaaaggcgatgtccatgcttcccagttgtctcctctatctgcctacatccaccatgtttaccctttgaaggacaagtcactcaaaagaaagtatacaaggtctgcatggaaaggttgcagtagagaattactcctgaaaaacagtaacaaactcctagacatcctccatcctgggcctttctctctagatattggttatgataatttttttttaggctcgagggtgagagaggagtatccaggatggcctttgtggacacatgtggtgtccttctgccattcttcaggcaaagctacagtgcagagccattacagcttcattcccatgaatcctagcagtggggaaacaatgccaggtaggatactttgggttccacatttggacccagtgcctttcctctagagcaggaggagtgtgggcaccagtaatatcttggagctgaaaaggaaagataagggccaacagcagagctgtagggacaagctgacacaggaagttgtgggccaggcctttgggtcttcctatctggggcatgacaagaagaaaccccagggaagaaaatgtaggctgttgctggagacttctgtcttttcctcgttgttccatgttacacatgctacacattttaagctatgtcttcttgctaagaccagagactcccaatttactcccaagttgccctggcatacattatgcagtccaagctcctctctgagatgcataccttagttgctaagggaaagtacaagactgaaagtataataaagtataaagacaataacaggtgcatgtagtgaagccacgggaaccggaaatcaggctgtaatgtaggaaatcattgtgtccctgctcctgtgtgaactaatgaaaatcccattgagcatcagtggcagatccatttggaaatcatagccattggagagacctgtgtttctccaagtaggcatgttcatagcattcagtgttgacagctatctgcatgctctttacagagccactaaagtgagccttctagaggccacacaagacctttggtctggggctcttgtgtggatctcacacagagcatgatacccagggaagtgtaagtgtgatctgggtaacaaggacatgacctgactcctaggtttgtttctgttgaggcactgaggtgacagtgtgttctttttctccctaggactggcccctgggatttgctgctcagttcactgagacatcaggagcaagcactggaggccggtgctgctggacccagatgggagccatgcaggacttgaccatggcctgcatacacttcttcccaggagaaggggaatgaggaaggtgggggcctcaaagcctcctttcctttctgtttggcttcctatgtctttattctattttttgtatctgtttaattatttacttagtacaaaattcaggtccagcctccttaggtttggcattgataaaaaatgcaaaatggaaggtaaattctaggagtacagcattgcaagcttctgacacagacaaggaaggctagaactgcacagttagaggacactgcctctgtattgacatttttttcagtcagtgaaggcgggggtagagagctgcagtcaggacatcttctctgctctgggacaatactgccatcatgcggaaaatgtttcctgtagaccaacacaggcacacacacctcctcctccatcctgtttctcctcagccattttgaagcagggaggatcaggaggattcaaggatggggaagctttcctgttctactatatattttctccttctgtaggcagactggcatcacaggacattttagagcattactgtacaccctggtgactgaggtccattatcaagtgtgcagcggtgctgaggtccagggacaggaagcagaagggcgggttccagcccgctcagctggccatggtaagatactagctggtgtcctagggcagcaaggcgcctccctccccaggttctgatgagaaagcactacagtcctagtttctcttgggcctgagaattcaaggcagcccaactagggacccacagctgctcctgctggctgtaatcagccgccatcttcttccattgttagcaatcatgggaaggaggacagtggagttgtgagttttgaaaccgcatcctcatggaggcagtagagctccatacaagactttgtgagtgcttttcccccccgccctttgtgtctgaaaaaaagtctaagatggctgtcctaccttttatgcagctttgagtggctttaagagtattttaattttttgtcttctgttccacatgaggccaatctcaggcctaattcttccctaggtcattgtactccatgccttctgttatgcaggatatttcctatttcttactttataaccatttatttttccacggtatatcaaagtttgatatacttattttttgtaggttttacgcaaccttagtggaaggtctccagtgtgaaatactagccaggtctttcggttgtcatcttatggtctctcaggtcacacaaaatcagatattggttggttactctcacaagctttgtgccactggtgtttctgcagattgtaaggtttgcttctttctccttccatgagtcctagtccttatagagtaggtgctagtaaccttctctgtgctccatgcgtcttcagcagtttggccttgctgtcagtttatgaagggccacaaatagccttcataatagcctggattggcccaatctccatttgaagtaattcacccccagtactgaaggcttcatttagtgacaagaggagtctagttggagatgtttctacccttttgattcctccccatattacctccctcctgtccctttcccctccctctccttacttgatcctccattccattcccccactctgtgttccataactatcagttcttatgttccccttggaaggattatcaaaccgtcccccataggtcctttatacataacctcttgttatatgaactgtactttgcttctctgtgatttaaccgctaacattcacatgtgagtgagcacataaaatgtttcccttttgaccgggcagtggtggcacatgcactcaggagacagaggcaggcggatttctgagttcgaggccagcctggtctacagagtgagttccaggacagccagggctacgcagaaaccctgtgtagcaaaactaaaaaaaaaaaaattcccacttttggggtctgagttacctcaggatgattttgtttctctttctacccttttactcatgaatttcatgatttttactttgcaaagtggttgactaatattccattgtgtaaatgtaccacattttcttcattcattcatgtgcagacatcaagatttccagtttctggctgttccaaatagagcagcaatgaacatggttgagtatctttgtagtaggatgaaacagtctttagtatatatccaagactggctaggtgaatcttgaggtattgccatctttctgaggagccatcacactggtttgaatagtggctgtaaagcttgcacgcccagcaatggaggagtgtccccttaccatgcatcctaccaccatgagctatcctttgttttgttgatctcagccttcctgattggtgtaaaatgaaatctcaaagtagttttgatttgcatttccctgaaagctaaggatgttgaacattttaaagtatttcttcaccatctgagattcttcttttgagaattctccatctaaaattgtagcccgtttttaattggattattaatgttttttttttttagaaaacttttattcttctttaatgtattacttctgtaccattttcaacctcctgtcacttaaaccgtatccccatgtcctgtctctgccagatcaactactgctctatacccgtcaaaataagagaaggacaaaaaggaggagaaaagaaaagggaagagggagggagggagggaaagagggagagagagtgcaagagagagagagagcagcagcaaggactcctcccacagggtatgaaaagggttccaagcacagggaaagattcagagacacatgacctcccgttcccacaattaggagtcccataagaacacccagctgcacaaccacaaggtacctagctcagacccatacagggtccatgtttgttgtttcagtctctgtgaggcctgatgagccctatttagtagattttgtaccctgtgttttcaaggttcccaaacaatctgactcctacaatcctccctttaatgggtttcctggctctacttagtttttggctgtgggtctctgcatctgctcacatcagttgctggataacaccactctgatgactcttgggtggcgtggatctgtgagtatagcagaatatcattaggaatcacttccttgacttttttggatactttttgccaatcatgattggttctatcctgggtctcaggctgtccttcctctgatcctggccatccaggcagtgtcagccatgggacccctctcctggcagtgtgggccaaaagttagaccagtcatgggttggctacttttacaagttcttggccaccattgttctagcaagtcttgcagataggacatgataagtcaaatgttttgtggctgggtaggtgtcccagtccaaaggctaggaggcttgcctggttataaatgatggttggtttaggctctgtatcctccattaccaggagattttactagggttactctcatagattccaaggagtttgtaatgtattagatttctacaagtatcacccccaaaaggacccccaattccagttgtctctcttaccccccccacattctagttccttcaaaataaaggtatgagaaattatacatgatagattataatataaacacaaatttagtgaatgttcactttcgtttacaggtcaaacatactccatgatctatgtgattaggagttatagtgatttccatagctttgtcaccccaaatgctatggagcattaaattttgagacctacctagatcatcattacaggcaggtagtcagattggctggacgcccacccaaggccagttgtgtaagaaaggatggggtatggtgaccagggaatctgtgaagggaatcaggcagagacccaggtttcctggttcctaggtttgatcttctccagaccctgacttggcaacattttctttcctacctagaactggacgatgaattttaacctccacaccacaagcactggggtagaagactgctgctgggtgaagaagagactagacttgatcattgagcagccactcactgatatcttcagtgctgcatgaggaaggtgggtgcctcaaagctcctccatccttctctttccttcctgcttagatcataaattccaggcaatttccttcttacagcagagtttattcttctggatttggtggtggattctggtgaagatacagatggatgctctggctgagtcgctaccttgaaatgaaaatgggaggtaaactctcccatagatgaatcttcctcattttgaaggtaaagggtaaggaaagctgccatagttgttggactctgtccattattggagtttttttcagactgtgaaggcggggacagagagctgcactcgggacaccttccctgctctggggcaacactgtcatcatgcggaaaatgtttcctgtagagcagagcaggcacacacacctccgccatcctgcttctcctcagccattttgaagcagggaggatcaggaggattcatggatggtgaaatgtgcccgttttactgtctattttctccttaagtacccagactagaatcacctgacccttcagagtattaactcagaccctggtgactgaggtccagtaccaagtacacagctgtgctgaggtccagggacaggaagcagatgggcgggttccaacccgctcagctggcaatgataatctagtagctggtgtcttagagcaacaaggtgcctccatctccaggttctgaagagaaaacactgcagtcccagtttatgttggggccgtagaagaagtcaaggaagcccaactaggcacccacagctgcttctgctgtctgtaatcggtcgccatcttctgccattactaggaatcatgggaaggaggacagtggcactgtgagttttgaaaccacgtcctcgtggtggtagtagagcgccacacaagagcttgtgagtgcctctcccccgcccttcctgtctgaaaaaacacaaaagatggatgtcctaaggtttacccagctttgagtagtttaaaaggtatttttttcttccatgtgttccctgtgaaggcaatcttaggccctaggtggtgggacttttttccttctgttttgtaggttatttcctttttctgtctttagaactgtagatttttaccctttgcagatatttagtatttttaaatattggcatgattaggtttttgtaggttttacatgatgaagatagtctaggagatttagaagcaaagaactaagctgagctatgaagtacatgagacaggctggtctgggcctctccaggaggcttctgtcttttgctctgggagttccaaaaatatctcagaccatgctaccatgcccagctgaaggcagtaggtttaaccttgtcttaaatatcatcagcaaacaaacacttggcagttgataattatatcccaaagatgatgtccatgcttcccagttttctcctctgttagacttcatccaccatgtttaccctttgaaggacaagtcactcgaagggaagtataacaggcctgaatggagaggggacagtggagaattacttctgaaaaacagtaacataggcctagacatccaggatcctgggcctttgtctctagatattggttatggtatttattttcaggcttgaaggtgagagaagggtaatcaaggatggcctttgtggccatatgtggtgtccttctgccatcatgtatgcagagctacagtgcagagccattacagcttcattcccatgaatcctagtagtggggacacaatgccaggtaggatactttgggttccacactgggacccagtgcctttcctctagagcaggagaagtgtgggccccagtaatgtcttgcagctgaaaaggaagactaaagtccaacagcagagctgtagggacaagctgacacaggaagttgtgggccaggcctttggttcttcctatctggggtatgataagacgacaccacagggaaaaaaatgcaggctctttgtagagaattcggtctcctgctccttgtagcatgtgtaggcaggattttaagccatgccttctttctaagacacagagactccctaattagtccaagctgttcaagcacacataatgtagcccaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgagaatcagtgacagatcttttggaaatcagtcattggagagacctatgtttcttcaagtaggcatgttcatagcattcagtgttgacaggtatcagcatgctctttacagagccactaagtgagcctgccacaggacacacagtgtcttatgtctggggctcttgtgtggatctcacacagagcatgatacccagggaagtgtaagtgtgatctgagtaacaagtacatgacctgaagcctaggtttgcttctcttgatacactgaggtgacagtgtgttctttatctccctagaaccggcccctgagatttgctgctcagaacctgagttcactgagacatagggagcaagcactggagatccggtgctgctggacccaggtgggcgccatgcaggacttgaccatggcctgcacacacttcttcccaggagaaggggagtgaggaaggtgggggcctcaaggctttctttccatctatttgtgttgctatgttcttatattccattttttctgtttaattatttatttagtataaaatcaggtccagcctccttaggtatagcactgatataaagtataaaatggaagctaaattctaggagtacagcactgcatgcttctgacacagacaaggaaggctagagcagcacagttagaggacactgcctccgtattgacatttttttcagtcagtgaaggcagggaaagagagctgcagtcaggtcatcttctctgctgtgggacaatactgccaccatgcgggaaatgtttcttgtagaccagtgcaggcacacatacctcctccatcctactgctcctcagccattttgaagcagggaaggtcagggggattcataaatggtgaaatttatccttcttactatatttcactccttctgtaggcagactacaatcacagaacctttcagagtattaacacagaccgcggtgactgaggtcaattatcaagtgcacagctgtgcttcggtacagggacaggaggcagaagggcaggtttcaccattgctcagctggccatggtaatctactagctggtgtcctagggcagcaaggcgcctccctctccaggttctgaagagaaagcactgcagtcccagtgtttgttggggtctgaggagaaggcaaggcagcccagctaggcacccacagctgctcctgctgtctgtaatctgccaccatcttctgccattgctaggaatcatgggaaggaggagaatggcactgtgagttttgaaaccgtgtcctcatggtggcagtagagctccacacaagagcttgtgagtgcctctcccccgcccttcctgtctgaaaaaacgccaaagatggttgtccaaacttttacccaactttgagtactttaaaagttgttttatttttttggtcatgtgttccatgtgaagccaatctgagacatacttataccctaggtggtgggactcttttcctttagttatgtagggtttgtcccttttctcactttatagctatggatttttaccctaatccgatatttaatggtgttaaaattttgtctgattgactttttgtaagttttaaatgatgaagatatgatgggagatttagaagcaaaggactatgctgagccgtggtcctagtgaactacatgaggcaggctggcctggccctttccaggaggcttctggtccatgttaccatgctcagcggacacgagtaggtttaaccttgtcttaagtaacatcagcaaacaaacactggacagttgataattatatcccaacggcgatgtccatgctgcccagttttctcctctgtctgccttcatccaccatgtctaccctttgaggacaagtcactccaagggaagtataccaggtctgaatggagaggggacagtgtagaattactgctgaaaaacagtaacaaagtcctagacatcttcgatcctgggcctttgtctctagatattggttatggtatttatttttttaagattgagggtgggagaggggtagtgcaggatggcctttgtgaccatatgtggtgtccttctgccatcctgcaggcagagctacagtgctgagccattaaaatctcattcccatgagtcctagcagtggggaaacaatgccaggttagatagtttgggttccatactgggacccggtgcctttcctctagagcagaagtgtgggcaccagtaatggcttcgagctgaaaagaaagacaaaggcaaacagcagagctgtagggacaagctgacacaggaagttgttggccaggcctttggttcttcctatctggggcatgacaagaagacaccacagggaaaaaatgcaggctctttgaggagaattcggtctcctgctccttgtagcatgtgtaggcaggattttaagccatgccttctttctaagacacagagactccctaattagtccaagctgttcaagcacacattatgtagcccaggctcctctcagaggtgtatgtcttagtggccaagggaaagtagaagactgaaagtataaagaaaagaacgtgtatatagttaagccatgggaaactgtaattggcctataatgtaggaatatcttatgtcgtgctccagtgtgaactattgaaaaccccattgagaatcagtaacagatcttttggaaatcagtcattggagagacctatgtttcttcaagtaggcatgttcatagcattcagtgttgacaggtatcagcatgctctttacagagcaactaagtgagcctgccacaggacacacagtgtcttatgtctggggctcttgtgtggatctcacacagagcatgatacccagggaagtataagtgtgatctgggtaacaagggcatgacctgacacctaggtttgcttctgttgaggcactgaggtggcagtgtgttctttatctccctagaaccggcccctgggatttgctgctcagaacctgagttcactgagacatcaggagcaagcactggaggtcgggtgctgctggacccaggtgggcgccatgcaggacttgaccatggcctgcacacacttcttcccaggagaatgggagtgaggaaggtgggggcctcaaggcttcctttccatctatttgtgttgctatgttcttatattcctttttttctgtttaaaaaatttagtacaaaatcaggtccagccttcttaggtttggcattgatataaaatgcaaaacagaagctaaattctaggagtacagcactgcatgcttctgacacagacaaggaaggctagaactgcacagttagaggacactgcctctgtattgacattttttttagtcagtgaaggcggggaaagagagctgcagtcaggacatcttctctgctgtgggacaatactgccaccatgcgggaaatggttcttgtagaccagtgcaggcacacatacctcctccatcctactgctcctcagccattttgaagcagggaagatcagggggattcatcaatggtgaaatttgtccttcttactgtatttcactccttctgtaggcagactagcatcacagaacctttcagagtattaacgctgaccatggtgactgaggtccattatcaagtgcgcagctgtgctgaggtacagggacaggaggcagaagggcgggtttcaccattgctcagctggccatggtaatctactagctggtgtcctagggcagcgaggcgcctctctctccaggatctgaagagaaagcactgcagtcccagtttctgttggggtctgaggagaaggcaaggcagcccagctaggtacccacagctgctcttgctgtctgtaatcggccgccatcttctgccattgctaggaatcatgggaaggaggagaatggcactgtgagttttgaaaccgtgtcctcatggtggcagtagagctccacacaagagcttgtgagttcctcttccccgccctttctttctgaaaaaacgccaaagatggttgtccaaacttttacccaactttgagtactttaaaagttgttttatttttttggtcatgtgttccatgtgaagccaatctgacacatacttctacccgaggtggtgggactcttttcctttagttatgtagggtttttcccttttctcgctctatagctatggatatttaccctaatccgatatttaatggtgttaaaattttgtctgattaacttttgtaagttttaaatgataaagatatgatgggagatttagaagcaaaggactatgctgagccgtggtcctagtgaactacaagaggcaggctggcctggccctttccaggaggcttctggtccatgttaccatgctcagcggacacgagtaggtttaaccttgtcttaagtaacatcagcaaacaaacactgggcagttgataattatatcccaacggcgatgtccatgctgcccagttttctcctctgtctgccttcatccaccatgtctaccctttgaggacaagtcagtccaagggaagtataacaggcctgaatgaagaggggacagtggagaattacttctgaaaaacagtaacaaagtcctagacatccaggatcctgggcctttgtctctggatattggttatggtatttattttttaagattgagggtgggagaggggtagtccaggatgtcctttgtgaccatatgtggtgtccttctgccatcctgcaggcagacctacaatgctgagccattaaaatctcattcccatgagtcctagcagtggggaaacaatgccaggttagatactttgggtttcatactgggacccagtgccttttctctagagcagaagtgtgggcaccagtaatggcttcgagctgaaaaggaagagtaaagggcaaacagtagagcttcctgatacaggaagttgtgggccaggtctttgggtcttcctatctggggcatgacaagaagacaccacagggaaaaaaatgcaggctctttgtggagaattcggtctcctgctccttgtagcatgtgtaggcaggattttaagccatgccttctttctaagacacagagactccctaattagtccacgctgttcaagcacacattatgtagcccaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgagaatcagtgacagatcttttggaaatcagtcattggagagacctatgtttctacaagttggcatgttcatagcatttagtactgacaggtgtctgcatgctctttacagagccactaaagtgagcctgccacaggacacacaaggccttttgtatggggctcttgtgtggatctcacacagagcatgatacccagggaagtctaggtgtgatgtgggtaacaagggcatgacctgaccccttggttagtttatgttgatgcactgaggtgacagtgtgttctttttctccctagaaccggcccctgggatttgctgctcagaacctgagttcactgagacatcaggagcaagcactggaggccaggtgctgctggacccagatgggagccatgcaggacttgaccatggcctgcacacacttcttcccaggagaaggggaatgaggaaggtgggggtctcaaggcttcctttccatcagtgtgttgctatgttcttatattcctttttttctgtttaattatttatttagtacaaaatcaggtccagcctccttaggtatggcactgatataaagtataaaatggaagctaaattctaggagtacagcactgcatgcttctgacacagacaaggaaggctagaactgcacagttagaggacactgcttctgtattgacatttttttcagtcagtgaaggcggggaaagagacctgcagccaggacatcttctctgctgtgggacaatactgccatcatgcggcaaatgtttcttttagatcagcgcaggcacacatacctcctccatcctactgctcctcagccattttgaagcaaggaagatcagggggattcatcaatggtgaaatttgtccttcttactgtatttcactccttctgtaggcagactagtatcacaggacctttcagagtattaacgcagactgcggtgattgaggtctagtaccaagtgcacagcggtgctgaggtgcagggacaggaagcagaagggcaggttccagcccgctcagctggccatggtaatctactagctagtgtcctagggcagcaaggtgtctctctcttggttttgaagagaaagaactacagtcccagtttctgttggggcttgaaaagtcaaggaagccctgctgggcacccacagctgctcctgctgtctgtaattggtcgccatcttctgtcattgctaggaatcatgggaaagaggacagtgttgctgtgagttttgaaaccgcgtcctaatggtggcagtagagctctacacaagagcttatgagtgcttctaccctgcccttcatgtctaaaaaaaaaactgctaaagatggctatcctaactttaacccaactttgagtagtttaaaaggtattttaattttatgtcatccattccttgttaggccaatctgaggccctaggtggtgggactcttttccttcagttatgaaggttatttcctttttctgtctttataagtggatttttaccctttccagatagttaatggtcttcaagtttggtatgattaattttgtgtaggttttacaagataattttatgctaggagattcagaagcaaaggacaatgctgagccctggctctagttaagtacatgaggcaggctggcctgggcctttccaggaggcttctggtccatgttatcatgcccagctgacatgagtaggtttaaccttgtcttaagtaacatcagcaaacaaacacctggcatatattatcaaattatatcccaaaggcgatgtctatgcttcccagttgtctcctctatctgcctacatccaccatgtttaccctttgaaggacaagtcactcaaaggaaagtatacaaggtctgcatggagaggttgcagtagagaattactcctgaaaaacagtaacaaactcctagacatcctccatcctgggcctttctctctagatattggttatgataattttttttttaggctcgagggtgagagaggagtatccaggatggcctttgtggacacatgtggtgtccttctgctattctgcaggcaaagctacagtactgagccattacacttaattcccatgagtcctagcagtggggaaacaatgccaggcaggatactttgggttccacatttggacccagtgcctttcctctagagcaggaggagtgtgggccccagtaatgtcttacagctgaaaaggaaaaataagggacaacagcagaaccttagggacaagctgacacaggaagttgtgggccaggcctttggttcttcctatctgggacatgacaagaagaaaccccagggaagaaaatgtaggctgttgctggagacttctgtcttttcctctttgtagcatgttacacatgctacacatttcaagctttgtcttcttgctaagaccagagactcccaatttactcccaagttgccctggtacacattaagtagtcaaagctcctctcctagatgcataccttagttgccaagggaaagtacaagactgaaagtataataaagtataaagacaataacacgtgcatgtagtgaagccacgggaaccggaaatcagactgtaatgtaggaaattcttgtgtccttgctcctgggtaaactaatgaaagccccattggagagacctgtgtttctccaagtaggcacgtatttagcattcagtgttgacaggtatctgcatcctctttacagagcaactaagtgagcctgccacaggacacacagtgtcttatgtctggggctcttgtgtggatctcacacagagcatgatacccagggaagtctaggtgtgatgtgggtaacaaggacatgacctgacgcctaggtttgcttctgttgaggcactgagatggcagtgtgttctttttctccctaggactggcccctgggatttgctgctcaggacctgagttcactgagacatcaggagcaagcactggaggctgggtgctgctggacccagatgggagccatgcaggacttgaccatggcctgcacacacttcttcccaggagaaggggaatgaggaaggtgggggcctccaagcttcctttcctttctgtttgacttcctatgtctttatatttctttttttctgatcagttatttatttagtacaaaatcaggtccagccttcttaggtatggcattgatataaaatgcaaaatagaagctaaattctaggagtacagcattgcatgcttctgacagagacaaggacggctagaactgcacagttagaggacactgcctctgtattgacatttttttcagactgtgaaggcgggcacagagagctgcactcaggacaccttccctgctctggggcaacactgccattatgtggaaaatgtttcctgtagagcagagcaggcacacagacctcttcctccatcctgcttctcctcagccattttgaagcagggaggatcaggaggattcatgaatggcgaaatgtgcctgttttaatgtctattttctccttaagtacccagactagaatcacctgacccttcagagtattaactcagaccctggtgacttgaggtcctgtaccaagtgcacagctgtgctgaggtccagggacaggaagcagatgggcgggttcctgcccgctcaactggccactataatctattagctggtgtcttgaataggaaggcacctcactctccaggttctgaggagaaaacactgcagtcccagtttctgttggggtctgagaagtcaagacagcccaactaggcacccacagctgctcctgctgtctgtaatcggtcgccatcttccgccattgctaggaattatgggaaggaggagagtggcgctgtgagttttgaaaccgtggcctgagggtggcagtagagctccacacaagtgctcctgagtgcctctcccccgcccttcctgtctgaaaaatcacaaaaaatggctgtcctaacatttacccagctttgagttgtttaaagggtgttgtttttttttcatgtgttccctttgaagccaatctgacttcataggtagtgggacattttttcttctgttatttaggttatttcctttttctgtctttataactgttgatatttaccctgtacagatatttaatgttcctaaaatttggtatgattcctttgtgtaggttctacatgatgacaatatgctaggagatttagaagtaaagaactaagcttagcaatgattcttgttaagtacaggagacaggctggtctgggcctctccaggaggcttctgtcttttgctctgggagttccaaaatatctcagaccatgctaccatgcccatctgaaggcagtaggtttaaccttgtcttaaatatcatcagcaaacaaacacttggcagttgataattatatcccaaagatgatgtccatgcttcccagttttctcctctgttagacttcatccaccatgtttaccctttgaaggacaagtcactcgaagggaagtataacaggcctgaatggagaggggacagtggagaattacttctgaaaaacagtaacataggcctagacatccaggatcctgggcctttgtctctagatattggttatggtatttattttcaggcttgaaggtgagagaagggtaatcaaggatggcctttgtggccatatgtggtgtccttctgccatcatgtatgcagagctacagtgcagagccattacagcttcattcccatgaatcctagtagtggggacacaatgccaggtaggatactttgggttccacactgggacccagtgcctttcctctagagcaggagaagtgtgggccccagtaatgtcttgcagctgaaaaggaagactaaagtccaacagcagagctgtagggacaagctgacacaggaagttgtgggccaggcctttgggtcttcctatctggggcatgacaagaagaaaccccagacaagaaaatgcaggcccttgctatagacttctgtctccacctttttgtagcatgttacacatggtacacatttcaagctatgtctttttgctaagaccagagactcctaatttactcccaagttgccctggcatacattatgcagtccaagctcctctctgagagatgcatgtcttagttgccaagggaaagtataagactgtaagtaaagtataaagacaacgtgtatgtagtgaagccacgggaactggaaatcagactgtaatgtagcaaattcttgtgtccctgctcctgtgtgaactaatgaaagccccattgagcatcagtggcagatccatttggaaatcacagtcattggaaagaactgtgtttctccaagtaggcatgtatatagcattcagtgttgactgctatctgcatgctttttacagagccactaaagtgagcctgccacaggacacacaaggccttttgtcctggcctcttgtgtggatctcacacagagcatgatacccagggaagtgtaagtgtgatctgagtaaccagggcatgacctgaggcctaggtttgcttctgttgaggcactgagatggcagtgtgttctttttctccctagaactggcccctgggatttgctgctcagaacctgagttcactgagacatcaggagcaagcactggaggccgggtgctgctggacccagatgggagccatgcaggacttgaccatggcctgcacacacttcttcccaggagaaggggaatgaggaaggtgggggcctcaaagcttcctttcctttctgtttggcttcctatggttttatatttttttatctctttatttatttagtacaaattcatgtccagcctccttagaaatggcattgatataaagtgtaaaatggaagctaaattctaggagtacagcactgcatgcttctgacacagacaaggaaggctagaactgcacagttagaggacactgcctctgtatcgacatttttttcagaccatgaaggaggggacagagagctgcagtcagggcaccttccctgctctggggcagcactgccatcatgcggaaaatgtttcctgtagaccagcacaggcacacacccctcctttatcctgctttttctcagccattttgaagcagggaggatgagggggattcatgaatggcgaagcttgctcgttttactgtatttctctcctgtaggcagactgtcatcacaggacccttcagagtattaactcagaccctggtgacagaggtctagtaccaagtgcacagcggtgctgaggtgctgggacaggaagcagaagggcaggttccagcccgatcagctggccatggtaatctactagctggtgtcctagggcaggcaaggcgcctccctctccaggttctgaagagaatgtactgcagtcccagtttctgttggggcctgaggagaagtcaaggcaacccaactaggcacccacagctgctcctgctgtcggtaattggcagccatcttctgccattgctaagaatcatgggaaggaagctcagttgagtgtctttttataaaacacaacagtggtttgtaactgcatccccatgacagtattagagctccaggaaagaagcgttaagaacttttcatttcttgtgccctccttctccaaaaccaaaaataaaacaccattcaagtataaatgttaccatggaatatgattatcttgattttccctgactttgaatagtttctttagtattttaatttttgtctctcctgtctgaaaatttgcctactgaaagtcaaagcagatatgaggatgtttggctgagtactttgaaaggtgtttttttttgcgtgtgggaatctacttttccatatccatttatcagttgtgtcaggggcacacacatgcagtcgcacaaacatagcattcaaagaagttgaaatgctccaggaccttcctcttctctagatgggacgtaacacagtgacccaaaactggacaatgtgtcaggagtgaggagagactttggaacacttgggtcctcatgagatctcttcactatgtccctcccctctgtatccagggagctgtgcagaagaggaaacagtaagattggaagcccagagggaatgcttgagaccataaaagcagtatcttccagacacaacaagactgatacattataacccactgagaccgggcaccaacatgcttagggcctatataggcggtagctagatgtcactgtgatattgacagtgcaaagtggacacaaatccacccctaaccaagatgcttgcttcagttgacacccactggcaagggaagcttttgttttcttcagttgtttgtcgtcatgtaaacacacttaaggataggcctcatacctttcaggtaatgcccatctcaaagcaaacgcagtgcttatattttgttgattttttttttttttttggtctcatattgtttgctctgggcatattcttaaactgtcagctgttttgctagtatcttacactttatgagtttgtcttgttaggacctctctctctctttctctctctctctctctgtgtgtcttatatatttttgcttctggtttgtttgtccttaggatccatgaggaaataactaggaaagcaagaacacattatagtgtatgaaaaattgttttcaattagaaaagaaaaaatacttcatacaaagatatgtgttttcttccgatttttaactgagacctgaagaatagaaatgtgccttagtggaaactcataccatctgcggggagcacaggttatagtggtgaccaatgcaagctgtccctgctttttcttaggtgtgtaggcaaaggcctgtcaacaattcaacagagagtaggatctatgcaggtgagctacagggtagcatgtggggacttcgggtttgtagttagtgggtacctccatctgtttccttatggcccaaacttcactcttcattcacacaggggtcacctaagcagttagggcagataatttgatgagatgtgaaatccttggtgatagataggaaacacacccacttactatatgcagggaacagtttgacctatgccaaaaagtttccagattttggtttcacagggaacaaacacctgaccaagagcacagcagtgtaagcttgtcctctcagactgggccaagtacaaggctgccatttttcttgcaggtggtgtgtttttttgttttgttttgtttcgtttttgttttaaaaaaacaagaggggagggagaaaaaggataaaaaaatggcgcttttaaaagtatgtagaaccatactgtcccccatgaggaattagcttcgatgtagacagcaccattgcagcttcctgcattcttcttagagtgggggttggtctgtagaggcctggagaagcgggcctgccttgactttcaatatggccctaggagaactcttggtgttataatgaacggaatggttatgtttactgttggaatatttttatgctgttttcaataagaaggttctaattgttcctgagtgcatcaaaataaatagtagtagatgctttgagattgctcatttaatgatcccttaatttatgtattttctctttaaaaaataacttccttatcttttgaatccatgcagaaaaatatttaaaatgatgagctcaacagttaatggagacataatcttgaaatcatgcagcaaatatgattgctagggcacgtgctctcagctactgctccagcagcgtgcctgcctgcttctgtgctcctgccacgctggacactgatttcctactggaaactgttaagcggcctccagttagatgcttcctagtggctcttcacaggaatagaagagtaataagatattgttacctatccaattggaatttataggcagtgcaatctatttgtcccccttggattatgagcattcagaattagtacttatcttctccttatatgatggtagtcaaccgcccactgcacacacaaagcctgttattgtctgtcaggatatggtgcatggtgcccaaggaatgtggctgagaaccagggttctggtgcctagatttgctctaatgcagacactgaggttccatatagcattttccttcttctttctagaactagatcctaagagcagaagacaatcatatgtcctgagaacccattggaggttgaacagcgctgggtggatggagaaaggcagaaatgcagaatttcgtcattgcctggatgctgactttatccaaagagaagatgcatgaggagtgtacatgcctcaggtctcacttggctttctctttccttcttgctttgttctggttttggtcttttgtcctttggagttccaagtcaggaggagttgtagttggtctggcatacatgtaaaatgaaagcagaagggggcctgcaggaaaggcttcctcaactcacttggaaggaggaaggcaaggctgccaccaccattactggactccaattgtagttgcttttttttttttaatcggaaaggcgggagcaggctgctgtgagctggtttttgtttcttctgtagagcaacactgccatcgtgcggaacatattgcatacatacctgaatgcaggtctctttctctatggtggactaacaaataggaaggaaggctatggtctgagaggtattagatttactcatttattttatgtatgtcatcacactgtagctgtcttcagacacaatcagaacacacccgatccccattacagatggttgtgagccaccatggaattgaattcaggacctggaagaacagtcaagtgctcttagccactgaaccactgagcttggtctgagaggtattagttatccatgtttggactctttccccttcttcttttccctggtgcacagagcactatcttaatgcttctagacattatgaagaaggtggagtgtccagaggattcctaaatgaccaagctcgtcctatcccaacccctctttttataggcagtttggaggtatgggctattgcagagtctaagtgttagtcctattgactgagagacaagtgcccattaggtgtcctgtggtccaggaacaggaagcaggggggcgggatttcatgctgctcagtttgcagtattaatctattagccgctgtcctatggcagtaaggcactttctaggttccgatgagaaagaagtacagtttctgttggggtctgaggaaaagtcaaggaaacccaactaggcactcacagctgctcctgctgtctgtaatcggctgccatcttccgccattgctaggaatcatgggaaggaggactgtggcgctgtgaattttgaaaccgcatcctcatggtggcagtagagctccacaaaagagcttatgcacagttgcctcctgcccttcctgcctgcaaaaaaatgccattgagacagaaagttaccaaggaagaggagtgtgatgagttttgctcagttctgggtactttgaaaagttttttatttgtgtcttgtttttcaggtgaagcccaactaaagcccaaatttagaaggggtcataggatgcttttccttctgttatgtagggtgtttcccttttcctttgtttctactttgtccaggtgcctagttttatttaaaaatttggtacccttctttcttttaatgtttatgcaataaagatgcactatgagatttagaggtgaacacatgtaatacatgaggggaacaatttttgggttatgggtcctagctcctagttttgatcctcactactagaggtgaggaactaattcatttccaaattgtgtgccttggaatttctcacttcctagtagtgtgagaactatctgtggcattaaatctgatttataatatgactgggatggaaatgaagaaaataattgaatttaataataagaacccattattctgatgaaaccactttattagtatattttgttttattttctttgtttctttttctttttcctttcttttcttttttttttttttttttttaaacaaaacagggtttttctgtagccttgactgttcttgaactcactttagatcaggccggtctgaaactaacagagatccacctgcatttttctctgtttccagagtgctgggattcaaggcatgagccacccactacggcctgtcttataagtcatttttacagactactttttccatgtctgtctctagtctgtaagctgggaaaattcatccaattataaatattttcagtaatgtctaaggggaaaaattggccagcctgaagcccacatttattaatttctattagtaactccatattgcattcaagtattcccttactgactgtatatatttctatatgtccagttagtgcacacagacacagaaacacacacaaaaacatatgtaccataagaaaggcaaagggtttgaaaagtgttttgtcagctttgtcttgcagtagttgggaagtaacacagagacccacaactgcacagtgtggagagagtgagagtcttgtggaacacttgctgaggaatggccctctcctcagggcccagggagcgaaagcagatgagtagcccttaagattgtgagagccagagggcacgggtaaccccaaggcagctgtcttctagacacaacaggactgacacacatcggagctctcaggctccttcctagcatttgctgggcctgcctacacagcttaaagctagataggaccccagccctgatagtggcaaatggacacagactcccacttctaactgagatgatctttaattgacacccacttgcaaaggaaattctttctctaatggagtttcattaggtattaaaccacacttatgggtaaacctttctttcgggtatttttattttataggtcttttgtatgtttatgttatagtttctggttttatagttctatggattttgtgtttggacgtgaatctgtgtgtaatacttgtgcttcatgaaaggtaacttttattcacgtgatataattgtagtctcagagccttcagtctgcaaacctaggcctagtcctggaagctttaggcctctctatagtcttatctaggtctagagtgtttcctgcctctgcgacttgctgctgactaagctcacccttccctatctctttctgagctctgactggttgcttaaccctgcttttctggcccacactcctctcccagctgactgattcaatccggcttttctctaggtttctgactgagtttctgtgcttgcctcgtactaacactgatgatctgttcgaatccctgggctccttctgtcttcatctctgtctagtttgttctcactctgtaagctgtgtgctagggctgagtcctaccacgacagggttttgccaggtcacagtcttggggttcacaatgcgattaagtatcctgcaacagtgcttttgcttcttttaaaaaaatttctgcccgggcagtggtggcgcacacatttaatcccagcacttgggaggtagaggcaggcggatctctgagttccaggccagcctggtctacagagtgagttccaggacagccagggctatacagagaaaccctgtctcgaaagactgaaaagaaaaaaataaattctgctttgtttgtattttacaccaccacccccatttaaaaataaataaataaataaataagatgggatctctgtagtcctggctgacctagaactcaaaggtctgccttctctatctcctaaatattaggattaaatgagtgggccaccatatatgctcctgtttgttttttatgttttttggtttttgttttttgttttttctagccctggctgtcctggaactcactctgtagaccaggctggcctcaaactcagaaatctgcctgcctctgcctcccaagtgctgggattaaaggcgtgtgccaccacttgccaggcttcttgtttgttttttaaagggaagtaagaaaggaaaccttgagttggggggcagggtgcagggtggtttagaggacatgagtggggaaggggaaaccatgatcagaacatactgtgtgaaaagttatttcaattagaaagaaaggaaaaatacttcatagcaaaggaatgaattttcattccactttaagcagagaactgaaggatcagcaaggtgtctatgtccaagtggcaattcatgctgcatgcagggaacacagtttagaaagtggagtctgctgtgaactgtctctgcctcttaggtctttaagcaaagagctgccaactgttcaccagagtatgaaaaatggaggtgaactatagtgtcggatctgagtacaacatttcagacaagatctgccagaagaatagatcagagaatttaatgtgaaggtgatttaactcatgagaaaatatgaacaatgtggtggttggtgagactaaagtttggttttatggagaacactagacaaagagcacgatagtttgatcttctcccttccaattggacaatggacaaggcagccatatttcttgtgggtgttttttgttatatttttttttccaacaagaagggtgggagaggacattacaaagtggtgcttgtataagtgtgtaatccaatcctgccaccatgagggaacagtttcaaaacagcgccactccagcttcctggcctctccttagagcagtgattctcaacctgtggtttgcagaccagatgtcctgcatatcaaatatttatttttatttatttttattttttggttttccgagacagggtttctctgtatagccctggctttcctggaactcactttgcagaccaggctggccttgaactcagaaatccgcctgcttctgcctcccaagtgctgggattaaaggcgtgcaccaccacagcccagcatcagatatttttattatgattcataacaatatcaaaattacagttatgatgttgcaatgacagtaatgttatggttgggggtcagcatagcatgcggaactgtagtcatgaggaactgttgtaagggtcacattaggaaggtggagaagcactgactgggattaaggttggtctgtagaggtgtggagaagctagtgctagaagctggccttccatagcttcctctgaggccgtaagagagcctctatgctcttaacagttatcgagaagttctgcttactgtctggaatagtctatgctgttttccatcagaatctttgagttgctcctgagtacagaaagataagtagtagtagctgccttaagagtgaatgcttgactgcttattcactgtggcccctcaatctccacagtttccctttttttaaaagtactttcttttcaatccatgcacaaaaatatatgaaatgatcatttgagcaactaatgagaggataatcttgagggtgtgctgtgaaagtatccctgggcttgtaccatgcatgaggccttttgtttgcaccaatctgaacattttatcaacaatagaggcagctgcagccctggaagtagaaggtggaggcagggcaatgagaactttaaagtcataatgggctaccatgggtcttttagaccctatctcatgagacaaaggaaaacctcacctgctaaagaagcagtagaatgcagttaaaagctgttgaagtgggttttattgctctttttgtcaatatgtgtatcttggttataaggggtgtatataaaaatccattagtctccgaggattattgagtgaatagaagaatcttctgtagaggctctgagctgagatctgctattagagatgccttcctctaagcaccaatattaaattccaaaccagtcttctccctttttattggaacgttccttatgtttgatatgagatctgatacagtggaatagtataggacatagaatgctgggcaaataaaggcccggatgcgtgagcaacactgcctagaggatgcaggggcacatttgatttctaagaaattcattcttttgctgaaactttggttcaggtagaaaatcaaaacaaaaattagacccttcagaagatcctttcaaaagtcaaagtcaaaacccttgtgttccgtggcacctttttctctgggtgatgtttctcaggtaggaagggcactaagatggtgtttggaccacagccagtacatgagtaacaccacagggatgtagagttgccaggaaagcccgatctcccatgaagctttgcagtggtggggagcatgcgggctggagaaggctagggtcttgagcttgctatgttgacccagctagtcagaaccctcgatccttctgcctgaacatctctagggtgggaatcacacataaaccccagcatgcacaggtccaaagataaaattgtaaagttagaatttaggacagaaacaggaagaagcctggctccagaggtggctcatcagttaagagcacttcctgctctccgagagggtctgggctggcttcctagcacctaagtaaatgggctcacaatttcctgttaactgtagttctaggggaaccaacaccccttttggcctttgtggctacttgcacacacagaacatacattcatacacatgaacatatacatatacacacacatataaaataaatcttcaaagaaatcatgaggttatcaacttgtattccgactttaaatgtttgtattatatatgaatataaaattaccaatgcattaaataatacattggttttttttttttttttttggtttggtgtttttcttcttagtttccaggctaacatatcttcactagactatgctaacctcaaactatgctataacggttccttagccttggccacattatatataataacctccaacctttaaaaagaaagacatgaaaatcattgtgcagcataattaatttcaatgctcagttaatcagtgcttcattatctataatgagctatgagtctagttagtcattgggtgagttggagtcaatgtggagaattcatcactgttactacgaagtctaatggaagcgttttctggatcctgcctatggtgaatatcttacatctcaatgaggaaagataacacacgatgctcaactgaaaaagaatgatggagaataagatccccagtgaaaccaggggaacctgctggactgttgaatgtgctcgaacactgaaaatgctcgggctcttgcagcattaatcttcagcagtcacagatcccgtgttacagaccacggcctgctgtccatacatgcctattacatccatcactatttggagtatgaaagctagggaacaaggaatctggctgacatcctggcttcctggcccactttgctctaatccaggtactggcttagctgtatttttttgtttcctacctagaactggatgctgagacatgcccccgcgatcccaagaccaccaggtaccgtgagcaatcactggagctggaacactgctgcctgaggaagagaagaagtgcaggcttgtcattgtctatgctgttacttgtggttcccgggtcttcagagaggatgcacaagaacgggaggtgggtgcttcagacacattttcagtcccccctgtctctctgtcttttgctgcttgacttctgatacaggaccttatccgacagatgtggtgtccatgtaaaattaaaatggaagctgagtgtccagatcagttttcctcacacaaaagaaaaacagccatcagagctgccatttattccagtttgcacaggcagggccagagagctgtagtcagaacacctttaattctctggggcaacactgcccgcatgaagaaaatgtttcctacagaaccacacacacacacacacacacacacacacacatacacacacacagacttcagcctcagtcttgcgtttcctcagccattttgaaacaggatgaggaggattcatgaatggcgaagcttgcccattttactgtatttctctcctgtaggcagactggcatcacaggaccctttagagtattaactcagaccctggtgactgaggtccagtaccaagtgcacagctgtgctgaggtgcagggacaggaagcagaagggcgggttccaccatcgctcagctggccatgctaatctactagctggtgtcctagggtagcaaggcgcctccctctccaggttctgaagagaaaacactgcagtcccagtttctgttggggcctgaggagaagtcaagaagcccagctaggcacccacagcttctcctgctgtctgtaatcggccgccatcttctgccattgctaataatcatggacaggaggagagtggcgctgtaagttttgaaaccgtgtccacatggtggcaggagagctccacacaagagctcatgagtgcctctcccccaccctttgtgtctgaaaaaacgccaaagatggctgtccttatttttattattttaattttaatttttaattttttatttttcgagacagggttttgctgtatagccctggctgtcctggaactcactttgtagaccagactggcttcaaactcagaaatccgcctgcctctgcctccccagtgctgggattaaagacatgctccaccaggcctggctgtctgtcctaacttttaaccaactttaagtagtttcaactgtattttatttttttgtcacatgttccatgtgaagccaatctgaggcccaaggtggtgggactcttttcgttctgttatatagggtttttcccttttctatctttataactgttgatttttttcttttccagatacttaatggttttcataaaattttgatatgtttaattttgtgtcagttttacatgataaagatatggtagcagatttagaagccaaggactatgctgagccctggtcctagtgaactacaagaggcaggatggcctgggcctttccagtaggcttctgtcttttcctctggtagttccagaataagtccatgctaccatgcccagaggacaggagtaggtttaactttgtcttaagtaaaatatcaataaacaaacacttgccagttgataattatatctcaaagaggatgtccgtgcttcccagttgtattgtcagggttctctagagtcacagaatttatggatagtctctatatagtaaaggaatttattgatgacttacagtctgcagcccaattcccaacaatggttcagtagtggctgaaatggaagtccaagggtctaggagttactcagtcttacacagcaagtaggcgaaggagcaagggcaagactcccttcttccaatgtccttatattgtctccatcagaagagttctaccacacctttaatcccggatggccttgaacttggagatttaatcttctgtaatccatagccactatgttttagatctccataccaagatccagatcagaaacttctaccgacaaggctccagataagggttactggtgagccttccaatgctggattgtagttcattccaaatatagtcaggttgacaaccaggaatagccactacaccagttttctcctctttctgccttcatccaccatgtttaccctttgaggacaagttagtccaagggaagtataacaggcctgaatggagaggggacagtggagaattacttctgaaaaatagtaacataggcccagacatccacaatcctgggcctttgtctctagatattggttatggtatttattttcaggcttgagggtgggagaggggtactcaaggatggcgtttgtggccgtatgtggtgtcctcctgcaatcctgcaacagacctacagtgcacattcattaagcctcattcccatgagtcctggcagtgggaaacaatgccaggcaggatactttgggttccacactgggacccactccctttcctctagagcaggagaagcgtgggccccagtaatgtcttgcagctgaaaaggaagactaaagggcgaacagcagagctgtggggacaagctgacacaggaagttgtgggccaggcctttgggtcttcctatctggggcatgacaagaagacaccacagggaagaaaatgcaggctcttgatggagacttctgtctctacctctttgtattatgtgtaacatgctacacattttaagctatgtcttcatgctaagatagagactctcaatgtagccaagctgccctgccacacattatatagcccaggctcctctcagagattcttgttttgtttgccaagggacagtttaagactgaaagtatataaagtgtaaagacaagaacatgtgtatatagttaaactatggaaaacggtaattggcctttaaggtaggacattcttgtgtctctgctccagtgtgaactaatgaaacccccattgaaaatcagtgacagatccatttggaaatcatagcctttggagagacctgtgtttctccaaataggcacgtatttagcattcagtgttgacagctatctgcatgctctttacagagccactaaagtgagccttctagaggtcacacaaggccttttgtctgggcctcttgtgtggatctcacacagagcatgatacccagggaagtgtaagtgtgatctgggtaacaaggacatgacctgacgcctaggtttgcttctcttgaggcactgtggtgacagtgtgttctttttctccctagaaccggcccctgggatttgctgctcaggacccgagttcactgagacatcaggagcaagcactggaggccggtgctgctggatccagatgggagccatgcaggacttgaccatggcctgcacacacttcttcccaggagaaggggaatgaggaaggtgggggcctcaaagcttcctttccttttccttttgcttgctaagtttttatattcctctttatccatttgattattttgtacaaaaatcaggtccagcctccttacatatggcattgatataaaatgcaaaacagaaggtaaattctaggagtacagcattgcaagcttctgacacagacaaggaaggctagaactgcacagttagtggacactacgtctgcattgatttttctttcagactgtgaaggcggggacagagagctgcagtcaagacaccttccctgctctggggcaacactgccatcatgggaaaatgttttctgtagaccagcacaggcacacacctcctcctccatcctgcatctcctcagccattttgaagcagggaggatgagggggattcatgaatggcgaagcttgctcattttactgcatttctctccttctgtaggcagactggcatcacaggacccttcagagtattaatgcagaccttcgtgacagaggtccagtaccaagtgctcagcggtgctaaggtccagggacaggaggcagaagggcgggttccagcccgctcagctggccatggtaaaatactagctggtgtcctagggcagcaaggcgcctccctctccaggttatgaaaacattgcagtctgagtttctgttgggacctgagaagaagtcaaggaagccctgcaaggcactcacagctgctcctgctgtctgtaatcggccgccatcttccttcattctctggtgactgaggtccaggaacaggaagcagaggggcaggttccaccccgctcagctggccatggtaatctatctactagctggtgtcctactctccagcttctgaagagaaaacactgcagttgcagtttctgttggggcctgagaagaagtcaaggaagccctgcaaggcactcacagctgctcctgctgtctaattggtcactatcttccgccattgctaggaatcatgagcaggaggagagtggcgctgtgagttttgaaaccgtgtcctcatggtggcagtagagctccaaacaagagcttgtgagtgcctctcccccgcccttcctgtctgaaaaaacgccaaagatggttgtcctaactttttatttttaatttttctttatttttcgagacagggttttgctgtatagccctggctgtcctagaactcactttgtagatcaggttggcagcgaactcagaaatccacctgcctctgcctccggagtgctgggattaatggtgtgcaccactatgccctgctgtctgtcctaacttttacccagctttgagtagtttcaactgtattttatttttttgtcacatgttccatgtgaagccaatctgaggcccaaggtggtgggactcttttcgttctgttatgtagtgtttttcccttttctatctttataactgttgattttttcttttccagatacttaatggttttcataaaattttgatatgtttaattttgtgtcagttttacatgataaagatatggtagcagatttagaagccaaggactatgctgagccctggtcctagtgaactacaagaggcaggatggcctgggcctttccagtaggtttctgtcttttcctctggtagttccagaataagtccatgctaccatgcccagaggacaggagtaggtttaactttgtcttaagtaaaatatcaataaacaaacacttgccagttgataattatatctcaaagaggatgtccgtgcttcccagttgtattgtcagggttctctagagtcacagaatttatggatagtctctatatagtaaagtaatttattgatgacttacagtctgcagcccaattcccaacaatgtttcagtagtagctgcgaatggaagtccaaggatctaggagttactcattctcacacagcaagtaggcgaaggagcaagagctagactcccttcttccaatgtccttatattgtctccaggagaaggtgtaccctagattaaatgtgttctaccaaacctttcatcccagaagacgttgaactccgaaattttatcttcagtaatccatagtcactgtgccccaagatctccataccaagatctagatcagaaatttctctttctaagcctgtagataagggtcactggtgagccttccaatgctggattgtagttcatttcaaatatagtcaggttgacaaccaggaatagccactacaccagttttctcctctttctgccttcatccaccatgtttaccctttgagggcaagttagtccaagggaagtataacaggcctgaatggaagggacagtggagaattccttctgagaaacagtaatataggcccagacacccacgatcctgtgcctttgtctctagatattggttatggtatttattttcaggcttgagggtgggagaggggtactcaaggatggcctttgtggccatatgtgatatcctcctaccatcctgcaacagagctacagcgcatgttctttaagcctcattcccatgagtcctggcagtggggaaacaatgccaggcaggatactttcggttccacactgggacccagtgcctttcctctagagcaggagaagcgtgggccccagtaatgtcttgcagctgaaaaggaagactaaagggcgaacagcagagctgtagggacaagctgacacaggaagttgtgggccaggcctttgcgtcttcctatctggtgcatgacaagaagacaccacagggaagaaaatgcaggctcttgttggaaacttctgtatctacctctttgtagcatgtgcaacatgctacacattttaagctatgtcttcatgctaagatagagactctcgacatatccaagctgccctgccacacattatatagcccaggctcctctcagagattcttgttttgtttgccaagggacagtttaagactgaaagtatataaagtgtaaagacaagaacatgtgtatatagttaaattatggaaaacggtaattggcctttaaggtaggacattcttgtgtctctgctccagtgtgaactaatgaaacccaatttgaaaatcagtgacagatccatttggaaatcatagcctttggagagacctgtgtttctccaaataggcacgtatttagcattcagtgttgacagctatctgcatgctctttaccgagccactaaagtgagccttctagaggtcacacaaggccttttgtctgggcctcttgtgtggatctcacacagaacatgatacccagggaagtgtaagtgtgatctgggtaacaaggacatgacctgacgcctaggtttgcttctcttgaggcactgaggtgacagtgtgttctttttctccctagaaccggcccctgggatttgctgctcaggacccgagttcagtgagacatcaggagcaagcactggaggccggtgctgctggacccagatgggagccatgcaggacttgaccatggcctgcacacacttcttcccaggagaaggggaatgaggaaggtgggggcctcaaggctttctttcctctactttttgccttgctaagtttttatattcctctttatccatttgattattttttacaaaaatcaggtccagcctccttagatatggcattgatataaagtgtagaatggaagctaaattctaggagtacagcattgcaagcttctgacacagacaaggaaggctagaactgcacagttagtggatactgcctctgtattgacctttctttcagactgtgaaggcggggacagagagctgcagtcaggatactttccctgctctggggcaacactgccatcatggcaaaatgtttcctgtagaccagcacagacacacacccctactccatcctgcatctcctcagccattttgaagcagggaggatgagggggattcatgaatggcgaagcttgcccattttactgtatttctctccttctgtgggcagactggcatcacaggaccttcagagtattaatgcagacctttgtgacagaggtccaataccaaggacacagctgtgctgaagtccagggacaggaagcagatgggcgggttccaacccgctcagctggccatggtaatctactagctgatgtcctagggcagcagggtgcctccctctccaggttctgaagagaaaacactgcagtcccagtttctgttggggcgtgagaagaggtcaaggaagcccaactaggcaccctaagctgctcctgctgtctgtaatcggccagcatattccgccattactaggaattatgggaaggatgacagtggcccttttgagttttggaaccacgtcctaatgggggcagtagagctccacacaagaccttgtgagtgcttctcccccgcccttccagtctcaaaaaacgccaaagatggctgtcctaacttttatacaggtttgagcggtttcagctgtattttatttatttttttgccatatgtttcatgtgaagccaatctgaggccctaggtggtgggagtcttttccttctgttacataggatatttcctctccataaagatgctattcatagacaaatgcacccaagaagattgttgctccggttttgtggatcttggaataattttgtcagtattttagttttgtttcccttcttatttgaaaatatgctacatgtatataaaggcatctcggaagattttttgcctatgtctgagtgtgtgaaaaagttttgtgtgtgtactgattcccacatttcagccaatctgaagcctggattagcagaagtcctagggtcctcattgtgttgtagagtgtattcccagtttcgctcattttcacttgtgtgagagactggcctcatttaaactgtttttgctatttatttcttgtagtttctatgcaatacaagtttgctatgagtttaggaggaggtaaatctgaagtggacacatcatatagcagaggggtagaatgttaaggttattatatgccccaggtccttggtttgatccctaataacttgtgtgtgcagctaattcatgggtagatatataactgtcaagtttccaatttcaaaagctttgagaaatatctgtgacagtaaatcttatttgtaatattattggggtggatttgtaggtaagaattagtgagattaatatgagagctaattatttagttgtgatattttcttagtcatttttagcgaatgttttctagttgggtgaatctattttgcaggctaaggacattcactgagaattaacgtattttcagtgatttcatgtttcccttcagcaccagatttcacagtatctcagattaaatggacccttcaatattccacgtcttatgtaaaacaaactcatgtattacattaccatatcatatgttaataagccatatatgcttctgcaagttttgatagctttataatatgtatgcgtaattaggaaattgttttcaagtggtatttattcaaagactttcctgtagtacgggtctgtaattttgttttttaatatttcattaattcctgatgtatctcatgcaggaccttattttaatatttttttcaagtagaatacaaaatactaggttccagtaaggcactttttgaatccacgtttttcttggtttttctccctctgagcctgtctctctcaccccctgcttacattccttttacccctctccctgtctctgctcctttctctttcatgtcatggtattccattgctcactgtccagcctcccctctctctacagcttttcagctgctctcatgatcccctttttaattccacgatccagttacacctccttacacatagacaaatgtgtgtacatgctcacgtaaatgcaactttaattctgcatatgatggagaacaatttgtatctgtcttgctgaatctgacattttctttacattgtggtttcttgttctgtacatgttccatgtgtttctattactaagtttcactttccatatgtattttcattttctatatgtctattctcatccgtactgcagcattaagcatgcaaacatctttgtagtagaacctagaaaccttggaagatacaagatatggttccattttacttttgtcccttaggtctggcattgattttcatctaatggtattattattatacccagatatatagtgtaaaaagcaggaaatacttgacagatatcaaaaggtagaagaatatatttttaaaatcagtcttccgtgcctgaagagatctcttattggctaaatgaacatttttctctttcagtgcattcatattctagtcccagcactcacatggtgactcacacccatgtgtaactccaattccagggataaaattcgtattaacttcctggtggaatggcacccagtggtgtaccttcattcttggtggagaacgatgttacacataaaatgtgaaactaagttagcattcattgatgctgtttttgtagctcagggtgctttcctggcatacaggaagaactagattttatacaaatgtataagaaaatcattgtaaagaaccaaaatccagcccctaataatatgtcagaatatccaggacaaccattgagaatgcctaagtagcgtatgaggtatttgagctataatagatgaaagaaaattgaaacatgggtgggtgtacagatcaatggaaagtccaagtaagacatccttctctcttctctcctctcctctccctctccctctccctccccctctccctctcctctcctcttttcctttcctagacagggtttctctgtgtagccctggatgtcctagaagtcactctgtagaccatactggctcagaaatctgcctgtctctgcctcccaagttcttggattaaaggcacacgccaccactacctggccaagcaagacatcttagtggggaaattattaaaacagtctcaattttacccactgcattcactgtgtactgaattgcctgaaatatagccttcatactcaaatatatctacatgcatatggtcttgtttcaatgttaatcatggtataatattttgtattgtacaatcactgccatatatttgtgtatttatttaaaggaaaacactgaatccggtgagaggataaaggtccttgcttcccagcatatgaattcatgaatttcatacccataaatctaattgtagcagtaagcaggttcttgcaggttgtcttctgacatacacacatgcattcaaacaaataaaagacacacacacacacacacacatacatatacacatatatatcagttttataaaggcaagtagatattaatgagatttacagattaaagtattgactgtttaaatatattcagtacgaaatgttgggaccatgtgcacttggtattatttaaactacagcatatatgtatacattgtatgctgcaggatacttttagagaccctaaatataaaaatatatatgtacactaaaagatccaaaagttatcagttgtctaacaagctgtatggaatgctgatattaaattaaaactttgttttcagaacacacacaaacagtcaaagaaattgaaaggactcccagttcaagttgtctgtccttccttccttccttctataattcccctccctctcgcctcaatcgtcttcttcctcttccttcaaaataaagggatgaggaattattcataatagattacagtttaaacacagatttattgaatgttcacttttgtttaaaggtcaaacatactccatgatctatgtgattgggagttatagtgatttccatagctttgtcaccccaaatgctatagagcattaactcctgagacctacctagatcatcattacaggcaggtagtcagattggctggacatccccccaaggccagttgtgtaagaaaggatggggtaaggtgaccagggagtctgtgaagggaatcaggcagagacccatgttgccgggttcctaggtttgatcttctccagaccctgacttggcaacattttctttcctacctagaactggaccagaagatttaacttccataccacaagcactggggtagaagactgctgctgggtgaagaagagactagacttgatcattgagcagccactcactgatatcttcagtgctgcatgaggaaggtgggtgcctcaaagctcctccatccttctctttccttcctgcttagatcataaattccaggcaatttccttcttacagcagagtttattcttctggatttggtggtggattctggtgaagatacagatggatgctctggctgagtcgctaccttgaaatgaaaatgggaggtaaactctcccatagatgaatcttcttcattttgaaggtaaagggtaaggaaagctgccatagttgttggactctgtccattattggagtttttttcagactgtgaaggcggggacagagagctgtagtcaggacaccttccctgctctggggcagcactgccatcatgcggaaaatgtttcctgtagagcagagcaggcacacgcacctccgccatcctgcttctcctcagccattttgaagcagggaagatctggtggattcaaggatggcgaaatgtgcccgatttactgtctattttctccttaagtacccagactagaatcaccggacccttcagagtattaactcacaccctggtgactgaggtccaataccaagtacacagctgtgctgaggtccagggacaggaagcagatgggcgggttccaacccgctcagctggcaatgataatctagtacctggtgtcctagggcaacaaggtgcctccatctccaggttctgaagagaaaacactgcagtcccagtttctgttggggccgtagaagaagtcaaggaagctcaactaggtacccacagctgctcctgctgtctgtaatctggctccaacttctgccatttctgggaatcatgggaaggcggacagtggtgctatgagttttgaaatggtgtcctcatggtggcagtagagctgcacacaagagcttgtgagtgcttccccaccgccctttgtgtctgaaaaaaccgccaaagatggctgtcctaacttttatccaactttgagtattttattttttttttgtcatgtgttccctgtgaagccaatctgaggccctaggtggtgggattcttttccttcagttatgtagggtttttgccatttctgtcttcataactgttgattttttacccttttcagatacttaatggtcttcacatttggtatgattaattttgtgtaggttttacaggattaaattatcctagatttagaagcaaaggaatgtgctgagccctggttctagttaagtacatgaggcaggctggcctgggcctttccaggaggctctgttttttcccctgggacttccagaatatctaggtccatgttaccatgcccagcagacaggagcaggttttaccttgtcttaaataatgtcagccaacaaaccctgctcagttgataattatatcccaatgatgaagtccatggttctcagttttctcctctttttgcctacatccactatgtttacccattgaaggacaagtcagtccaagggaagtataccaggcctgaatggagaggggacagtggagaattacttctgaaaaacagtaacataggcccagacatccacgatcctaggcctttgtctctagatattggttatgatattcattttttttctttttttctttttttttccattttttagtaggtatttagctcatttacatttccaatgctataccaaaagtcccccatacccacccacacccactccccctttttggcactgtcgttcccctgtactggggcatataaagtttgcgtgtccaatgggcctctctttccagtgatggccgactaagccatcttttgatacatatgcagctagagtccagagctccggggtactggttagttcataatgttgttccacctatagggttgcagatccctttagctccttgggtactttctctagctcctccattgggagccctgtgatccattcaatagctgactgtgagcatccacttctgtgtttgctaggttatggtatttattttcaggcttgagggtgggagagctttggtcaaggctggcctttgtggccatatgtggtgtcttccaaccatcctgcaggcagagctacagtgcagagccgttacagcttcattcccatgagtcctagcagtggggaaacaatgccagttgggatactttgggttccacactgggacccagtgcctttcctatagagcagaagtgtgggccccagtaatgtctttgagctgaaaaggaagactaaagtccaacagcagagctgtggggacaagctgacacaggaagttgtgggccaggcctttggttcttcctatctggggcatgacaagaagaaaccccagggaagaaaatgcaggctcttgctggaaacttctgtctccacctttttgtagcatgttacacatgctacacattttaagctatgtcttcttgctaagaccagagactcctaatttactccaagttgccctggcacacattaagtagtccaagctcctctcagtgatgcatgtcttagttgccaagggaaagtacaagactggaattataataaagtatatggacaataacatgtatatgtagtgaagccacgggaaccggaaatcagactgtaatgtaggacattcttgtgtctctgttccagtgtgaactaatgaaagccccattgaaaatcagtgacagatccatttggaaatcatagcctttggagagacctgtgtttctccaagtaggcatgttcatagcattcagtgttgacaggtatcagcatgcactttacagagccactaagtgagcctgccacaggacacacagtgtcttatgtctggggctcttgtgtggatctcacacagagcatgatacccagggaagtgtaagtgtgatctgggtaacaaggacatgacctgacgcctaggtttgcttctgttgatgcactgtggtgacagtgtgttctttttctccctaggactggcccctgggattttctgctcaggacccgagttcactgagacatcaggagcaagcactggaggccggtgctgctggacccagatgggcgccatgcaggacttgaccatggcctgcacacacttcttcccaggagaaggggaatgaggaaagtggggggcctcaaagcttcctttcctttctgtttgtcttgctatgtttttatattcctttttatccatttaattatttagtacaaaatcaggtccagtctccttagatatggcattgatataaagtgtaaaatggaagctaaattctaggagtacagcattgcatgcttctgacagagacaaggaaggctagaatcacacagttagtggacactgcaactatattgacatttttttttttttagactgtgaaggtggggacagattgctgcactcagaacaccttccctgctctggggaaacaaacactgtcatcatggggaaaatgtttcctgtagacccacacaagcacacacccctcctcctacatccagcttctcctcagccattttgaagcagggaagatcagggggattcatgaatggcgaaatttggccttttttagtgtatttctctccttctgtaggcagactggcatcacctgacccttcagagtattaactcagaccctggtgactgaggtccagtaccaagtgctcagctgggctgcggtgcagggacaggaagcagaagggcagattcaacccccctcagctggccatgctaatctactagctggtgtcctagggcagcaaggcgcctccctctccaggatctgatgagaaaacactgcagttccagtttctttcggggcttgaagagaagtcaaggaagccctgcaaggcactcacagctgatcatgctttctgtaatcgccctccatcttccttcattgctaggaatcattggaaggacaacagcggagctgtgagttttgaaaccgcgtcctcatgggggcagtagaggtccacacaagagcttgtgagtgcttctcccctgcccttcccttctgaaaaaacgccaaagatggctgtcctaacttttatgcagctttgagtattttaaatggtattttttttttgtcatctactccatgtgaagccattctgaggccctagatggttggaccctttttcttcagttatgtaggttatctcctttttctgtctttataattgtgaatttttaccctttccagatagttgtcttcaaatttggtatgcttaattttgtgtaggtttttctcaataatgttatgctaagagatttataagcaaaggacaatgctgagccctgggtatagttaagtacatcaggcaggctggccctggccttttcaggaggctactggtccatggtagcaaacaaacacttcacatttgataattatatcacaaagaggatgtccttatttcccagttttctctctcggcctccatcctccctgtttacccattgaaggacaagtcagtccaagggaagtataccaggcctgaatggagaggggacagtgaagaattacttctgaaaaacagtaacaaagtcctagacatcctcgatcctgggcctttgtctcttgatcttggttctggcattttttttcaggcttgagcttgggagaatgttagttaaggctggcactattggccacgtgtggtgtccttttgccatcctgcaggcagagctacagtgcagagccattacagcttcattcccctgagtcctagcattggtgaaacaatgccaggtaggatactttgggtttcacactgggacccagtgcttttcctttagagcaggcgaagtgttggcaccagtaatggctttgagctgaaaaggaagactaaagtccaacagcagagctgtagggacaagctgacacaggaagttgttggccaggcctttggttcttctaatctggggtttgacaggaaaaaaccccagggaagaaaatgcaggctcttgctggaaacttctgtctccacctctttgtagcatgtgtaacgtctacatattttaagatatgccttcttattaagacctagagattcccaatgtaaccaagcagtcctgccacacattatatagcccatgctcctctcaagggtccttgtcttggtttccaagggatagtataataagactgaaagtatataaagtataaagacaataacgtgtgtataattaagctatgggaaactgtaatcggcctgtaatgtagaaaattcttacgttgttgttccagtatgtactaaagaaaccctgattgaaaatcagtgagagatccttttggaaattagtcattggagagacctgtgtgtcttcaagtaggcatgtatatagcattcagtgttgacaggtatcagcatgctctttacagagccactaagtgagcctgccacaggacacacagtgtcttatgtctggggctcttgtgtggatctcacacagagcatgatacccagggaagtgtaagtgtgatctgggtaacaaggccatgacctgactcctaggtttgcttctgttgatgcactgaggtgacagtgtgttctttttctccctagaactggcccctgggatttgctgctcagaacctgagttcactgagacatcaggagcaagtactggaggccggtgctgctggacccagatgggagccatgcgggacttgaccatggcctgcacacacttcttcccaggagaaggggagtgaggaaggtgggggtctcaaagcttcctttcctttctgtttggcttgatatgttttatatttttttatccatttaattattaattgtgctggagagatggctcagtggttaagagcactgactgcttttccgaaggtcctgagttcaaatcccagcaaccacatggtggctcacaactatatgtaatgagatctgatgccctcttcaggagtgtcagaagacagctacagtggacttatatataataattaaataaatccttaattatttatttagtacaaaatcaggtccagcctccttacatatggcattgatataaagtataaaatagaagctaaattctaggagtacagcactgcatgcttctgacacagacaaggaaggctagaactgcacagttagtggacactacctgtgtatcgacatttctttcagaccatgaaggaggggacagagagctgcagttaggacaccttccctgctctggggccatactgcgattatgtggaaaatgtttcctgtagaccaacacaggcacacacccctcctccttcatcctgcttctcctcagccattttgaagcagggaagataagggggattcatgaatggcgaagcttgcccattttactgtatttctctcctactgtgggcagactggcatcacccgacccttcagagtattaatgcagaccttggtgactgaggtccagtaccaagtgcacagctgtgctgaggtccaggaacaggaagcagaggggcgggttccaccccgctcagctggccatggtaatctactagctggtgtcctactctccagcttctgaagagaaaacactgcagtctcagtttctgttgggtctgaggacaagtcaaggaagccctgcaaggcactcacagctgctcctgctgtctgtatggccgccatcttccgccattgctaggaatcctgggatggaggacagtggtgctgtgagttctgaaaccgtgtcctcatggtggcagtagagctccacacaatagcttgtgagtgcttctcccccgccctttgtgtctgaaaaaacgccaaagatggctgtcctaacttttacccaactttgagtagtttaaaaggtattttatttgtcatccattccttgttaggccaatctgaggccctaggtggtggaactcttttacttcagttatgaaggttatttcctttttctgtctttataagtggatttttaccctttccagatagttaatggtcttcaagtttagcatgattaattttgtataggttttacatggtaaaattatgctaggtgatttcgaagcacaggactatgctcagctcacctcctcgtgaactacatgaggcaggctggcctgggcctttcctggaggcttctgtttttcccctcagagttccagaatatctaggtccattttaccatgcccagcagacaggagcaggttttaccttgtcttaaataatgtcagcaaaaaaaccctggtcagttgacaattatatcccaaaggcgatgcccatgcttctcagttttctcctctgtctgccttcatccaccatgtttgccctttgaaggacaagtcagtccaagggaagtataccaggcctgaatggagaggggacagtggagaattactgctgaaaaacagtaacataggcctagatatccaggatcctgggcctttgtctctggatgttggttatggtatttattttcaggattgagcttgggagagcagtagttaaggctggcatttgtggccatcctgcaggcagagctacagtgcagagccattacagcctcattcccatgagtcctagcattggtgaaacaatgccacataggatagtttgggtttcacactgggacccagtgtttttcctttagagcagaagtgtgggcaccagtaatggcttggagctgaaaaggaagaccaaagtccaacagtagatcttctaaggacaagctgacacatcttgcacgcgctcaactggccaggaagaacggtgctgcaacgggacccttctgcacacgtttattgggagagcattgattgcataggcaaaagaagaagaacaacaaacccgaacgaggaaaatgatgctgcttatatacccctccatgtgacgtgtcagctcctgattagctgctcactcatcaccccactactacgccccaggatgggcagtgacttggcacgaatttactcttgcacctgtgcatattacttgtttaccagttaggcacatcggaggctcatgatggcaattgctcacggctccccacagacacaggaagttgtgggccaggcctttggttctttctatctggggcatgacaagtagaaaccccagggaagaaaatggtaggctctggatggagacttctgtctccacctctttgtagcatgtgcaacatgctacacattttaagatatgtcttcttactaagacctagagaatcccaatgtagccaagctgtgatctgggtaacaaggccatgacctgacgcctaggtttgcttctgttgaggcactgtggtgacagtgtgttctttttctccctagaaccggcccctgggatttgctgctcaggacccgagttcactgagacatcaggagcaagcactggaggccgggtgctgctggacccagatgggagccatgcaggacttgaccatggcctgcacacacttcttcccaggagaaggggaatgaggaaggtgggggcctcaaggcttcctttcctctctttttggcttgttatgcttttatatttctttttatccatatgattatttagtacaaaagcaggtccagcctccttacatatggcattgatataaaatgcaaaacagaagctaaattctaggaatacagcattgcaagcttctgacacagacaaggaaggctagaactgcacagttagtggacactacctctgtattgacatttttttcagtctgtgaaggcggggacagagagctgcagccaggacaccttccctgctctggggcaacactgccatcatgggaaaatgttttctgtagaccagctgaggcacacacccctcctccatcctgcttctcctcagccattttgaagcagggaggatgagggggattcatgaatggcgaagcttgcccattttactgtatttctctcctactgtgggcagactggcatcacccgacccttcagagtattaatgcagaccttcgtgacagaggtccagtaccaagtgcgcagctgtgctgaggtccagggacagaaagcagatgggcagattcaacccccctcagctggccatgctaatctactagctggtgtcctagggcagcagggtgcctccctctccaggttctgatgagaaaacactgcagtcccagtttctttcggggcttgaagagaagtcaaggaagccctgcaaggcactcacagctgatcatgctgtctgtaattggctgccatcttctgccattgctaggaatcatgggaaggaggacatgtggtgctgtgacttctgaaactattttcctcatgatggcagttgtgctccacaaaagatcttttgattgtttcccccccctccccgcttcctgtgtgaaaaattatcaaggagaatataggtaccaaggaagattggttcggtgaactttgcctgtcctcgaatcggttcagggatggtttgttttgttttttgtttttgtttttttgttttcttgttttccttctgaagtcattctgagtcctcattctaccctaggttgtaggccatttccttttctacagctgttcatactcaccctttttagctacttaattttgctcttgattgtctagtcttattcattggttacaattttcacacaggaaaggtagtctaggagcttcgaaaggaaagcttttttcatgcagggtgattggtattgctgagggctaacaacccttgcctaccgtatcctagagcctgggtttgctccccaggactgaaatgggcactgtttgtcatacataattatgcagcagggaaattctcagtggtaatattgtaaaaccaaccaaacaaaaaaacccccaaaaccagtcatggcagtaagctgtgatcaggatggaattgtagaaaagcattcatgggcttctctccttccttttagtgttgccccctcctctctgtcactaaaccccactccatgttcctagtgtccctcttttctcctctccttctatgtacacccaaaggcagaaatacagttctacattggctagcctatatgtcctttaaaagtgttctctctcatgaacaatctctgctttatttcatttccaattaaatgcacacatataccaagctgttaatggtgcttgctttgggtaatgatatttacaataaagttttcatttgttcatccttgatgtgaagattggaaaggtaattgaagaagctgagctttgtggttttcgtgatccatccctgtaaccccagcactcagtgtaggatcacggtagccccgaggcctcgaacaacctggccagcctacacattggcctctgatggttttttattttattcattcgcagaaaggctcatggcgtctatgtcgtaaatgagctgtggatttgctatgccccttctcttcagcaacccttatttttcttgcctgtacatctctactgtgggaatcacagggaagctgctgcagcacaacttgaaatagaaagctggatggtatgaatttaggacaagaacatgagaagaagggctccagagaggattcattaagagcattttctgctcttccagaagcatccgagtttggtgtgggcacccaagtcattaggctcagagctgcttggtaagtttagcaccaggggttcagacacccccttttgtcctctgtgggtaacattagaagaaacaccaggacaaccaaacacccaattttccactttaatagtatcagaatatacagtctacattttgtctgtaatacagctgcttccttttctttggccaacaggtcccaatgtaatattccaggcttgaactcttggctatcctgtgccccttatttttgcctcttgatcaaaggagtagcagtgagatgccacgtttggcctagatgataaaaaacactgaagaagttataagaatttgttaagattagactcatgttaatgatattttagtccagatttttccttcctttctttttttcaccagatagtctttttggtgcccaggcagtgttgaatttgaggtgaagcccaggtcagtctcagaagagcttagataagatgtcctgttcctccagactcggctttacagtacagacctttggcctggattgtgacttttttacctctgttaccataaacacttcattacattaccaccttcttggagcatataagttggggtaacgtagatatacagtcctaagtgaatgtcactcatgtttggcttcagtatctctaatccctttggaggcaggggttgtagttttgtgtgaacagtgagtcttgagatggtaatacagaaacaaaatggctgccttacaagctggctctgagtttaaatggctcttagttgctggcatttttagtcatggaaaatgatttctttcagatgaggtgggtgggagaggaggggtacacaatggctcctctactgcactgctgtccccatgaggacatagtttcaacagacttggtacctccagtttccttcccatcagggccctggccattaggcttctggaaaaggattgggcattacttttgttctacaacctgaggagagaactgaaccctacctggacatcggtgcagaactagagggtgacatggaccagcagcaatgaggctattgaataccataggctattgaatacctgtaggtgcttgtgtatcccggcagtgtgcctgccaaggtccaaggacaatctagaggtggtgtttatgtccttcaaagagggtgctggagatggagcagaggtacccaggcgtacatgtaatcccagtaccacaaagggtggttgtcaaccagaggacactgcataaattcatacgtaaagaaatgagtaaaaagcacttggatttgtgattcacgggcttgctttctacttttctcttcacctactgggcaaatatcactgagaacatcaagcctgagcacacaggcttcagagggaatttatctagacaaaagagaggcatcctgatggtgaaggatagtggtttgaggtctttgctttgaattgcgaatataaaagtaaaatggcctcctagtaaaactaattgcctgagtctgcagaggagagaaggcaggcatttttcttgtctttttttttttttttccagaccaaatgggcaggggaataggttgtaagaaggcagtgtagagcttgtctagagctctactgcccccaagaggaattagtttccacaggacaccagcagtttctttcccataggcccttgctaggaggagggctggactttgacctgaagctcattgtcttcccaggcaccaggagatgtcaggaagctggtataaatcctcatgggacttgaagggcgagtggcctgaagtgggtcacaagtgatcagggattctcaaactgctgttcccagcttgcatttaaaaatgggaaataactcaaaagacaattgcaaactctctgcagtcaagatggctcctgcttgtaatctcagtgttcagaaggtaggaaaggactactgtgagcaccaggtcagcctggactagagagaagactttgtgtcaaagaacgaagttttataaagggcagtcttgtggggtagaggcatggcagtatacgaagcacgtgtgcgtgtttctgtgtgtttcttgctcttgtccatgctagaagcagaacttcattgtaccgtcactgctcccacagtactatacctgctggatccagaactgcggcagggtaagaccagccaggacaagccagtgccaggtggcacaggtgtttggaaaaggcctgacgtgtacccaactgtgtgaaggaatgggggacccaaaacacagggcaaagaattatgcttccatccacgagagcaaaggtgtgggggggggggctgggggggatagattccatatgaacattttgaagatgtgtaattggaacaaaattgaatttcatataagacatagtagcaagctccatacagtttactttatcgtatcttaatgtcttctcaagtaaaatacagaagtccataaattcaaaatatatactaatatgaatatatgccacagtttaaggtgatgacaaagactttgtgtaaagctatgtctgttaatgttgacgactgttagaatgttttttatgggcaacatgcatatctattttataatttaataactaaaggggtgttcatgaaaatcttgagtgtatgagaatgctgtagctatgtaccgaaagctctcagtgagcactgctgggtgagactatatttgagaagccaggtttaaacatcttttgttgaggttttctttttcctaatggattttgaagatgtggtttgctttttctatttagaatagtcatacttataaagtccacctaggctggcctataactggcaattctctctcagtctggtattatagatatgcaaagttaagcattaaacaacaaaaattatgtagagatcttctctcaaaaacactaagaaaatcataacttctgagtagttatgattttgagattcctccctatacatttttatatgtgattcctcatattaattttatatgtattatacacaaaatacattcaagtacttttatctatagatgaataaatataaataaaaaccttaataatttgccataaataaactacaagacgacttttattgggtcctgaagagatataggagttaagagcactggctgctctcacagagaaccctcgttcaatttccagtgcccatatggtgattgaccaccatctatcatgccagtttccaaggatccagggccctcttctaaccattgtaagcaccaagcatgggagtgctatacatacatacatacatacatacatacatacatacagggaaaatacaaaggtaaaaatgaataaatctaataaaaagagacttctgtgtatgaacaaaaaaaaattcctaagaagcagctgtatgtgactgtgagtaaaaacctggaagtggtggcgcatgcctttaatcccagtgcttgggaggcagaggcaggaggatttctgagttcagggccggcctaatctccagagtgagttccaggatagccagggctagctacacagagaaactctctttcgaaaaacaaaacaaaggcaatgaacaaaaggaagatgaaagaaggaatcctggaaggattctctgtcttcagaggctgatgaaatcatagtcctgtggagagattgggattttgtggattcagaagaaaattcctgtatcttgggctagttttaggacagccattcattctttgtcccactcactctgtatgtgaactaatgcctcatgataatacataaaatccccttaaaagctattaacttagcagaccactagcttccacctactcaagagctaagaatgtcaccaggtagcatcttggagctacagaatagagtagctttccccatcaagttgcacccacctctcccatgtgtccaccaatgtcttttaaaattgccctgatttatgattttgtttgatgtataaaagtataaaaatcctgtgaaactgcttgcacgttggaacatggaatttggggtaatctaaacctgtgttcccaggacatggtgactcaaaatggatccagaataaacaatccttattgcctttaagttgagaactgtggtcgttatatcaacatatgaatgttttattttctacattctagaccttgctagtttttaaaagtgtcaagaaatgtccagaaagtagggcttgttagaagtaaaatacaatgtaattaagtttatttaaaaagttaagtcagcttgatccctaggcacaaaaggcctaggtcagaatgtggagaatgttagaagtcagtgtgaatgagaaccactattggcgcttctcaaatcttgatgtttctgcatttccttttctttcctaggtctggatcccctagggttgccaccaggatcaccagaaagtttgttaaatagagaagcacttgatagaaggcacctggataaggatggacagaaatcagaggccttggctatctggattctgacttcttcaaaaagatgagatgatagatgagagtgggtgccttagatctcacttccttttctttaacatatttttgttgctgggatgagattctagccattcctaatataaatactattgaaagcaaagggaaaccgaaaatttagttcttgtatctgctcactcttaagacggaataacaaaaagctgaagcctgggtctattgcagatgttttgttgtttcctcaggttggaatggtaggagcagagcaagatccttgatgatgggccaatactgttctcttatggcacaagttccagtatatagataatttctgccacacaaggccctagaagcccctaaaactgagtctatgggtgctcaagtggttgcagactctgctaaacattacattatttctgtgggtaccctgcagccattcattagtatagtcttgatacataacctagtaaacaggacccgaaccaagtgtatagttgtcctgaggtacatgaagaataagtggaggggcagaacttcacagtttgctttttaaaagatttttaaaaattacttattggggttggagaaatggcttttcgttaagagcactgactgctcttccagaggtcctgagttcagttcccagcaaccacatggtggcttacaaccatctgtaatgggatctagtgtgcctgaagacagctacagtatactcatatacataaaatgaatctttttttaaaaaaacagttacttattttgtacttgttattgtttttatcattttctaatcatatgtatatatctgtgcaagcttaagtacctaccaacccctcttggatgataggaaccatctctggcctcaagagcagtgcataaagcttactcattcctccaaccccaagcacggtctcataacaattattccctctgtagtctcttagcaagctcatccatgaccactgaatttccattggaaatgactgatttactatgactgaagaagctatgaggaactccaaactcccaaagcatagtaattccatcggaaagcttacaaatgtcttccaggggactaagtagtagacaaaggctccccaagagcacgaatttatctccaggaggagctctgtggccttttcatacttgaggatttcaggttgtggtcctaagtagtattatctttgacagaggctaatttaggctacttcttcagggtctagaaggttctaaaccttttaagctcttgtaaccctttaattcagttcatcatgtggtaagccccaaccattaaattcttttccttgctccttcataagggcaattttgctattataaatcataacctaaatattttttggtgttttgctgtctgttacctttctctatatggtacctatactcatacaaaaccaaaggcataggtatgttacatcattctctggaccatatggaatatatataaaaaaatcctttgtgtttcctatgagatttgcctgggagtttacaaggcctcattgttagcaatatacatacagtaatcttaatttattatattatgctattcatatagctcagattcaactatttaataagatgttagttactatgatagtaaggcaggaaataaaggaacttataagtagagggaactcataaatattaaaaggatatagaaaccatcctatgttaagatcattggatgtttcaaaaatgggagaaaagatactaaagagaaaagagtcaaagggtgcttccaagccccaacggctcctgaggacaaaaactcaactggccttgacagtaaaagaaaaattttaaaaaaagaaagaaaaaaaagaaattttggccagctgcatgtacttaagccagcaaaaagtatactcaaaggttaaaatagatgtaacttaactattgtaaatatataaatttttacctttgattctataaacataaattgtgtatgtatatacatatatgtgtgtatatatatatatatatatatatatatatatatatatatatatatatatatcttacttgccagacattaggcttaagtctatgtgagatgtgttttaaaaagccattcttcttcttcttattattattattgataaggagaatgctgggtagatacagtgttccaaaccttagttcattcaagacttcagcacttgcatgggaacctacagacacagtcccactcttctaacataaaaaccacgtgctagttaattatcttctcttcctgtagacaccccctgaggggggcctcacattagtatttgagcccctccaacatctctcaaagtaccctttactgagatagtgtgcttttccttcctagaaagcccgtccgtggtgttagagactttggccccacacccatgccgtgcagctctgccagggcctacctgcttgactcaaccctttttgttccctcaccctctctgggtaactgagagatttataccttggctatcctgggaatgtctttctaaactaataaaattgttcttgagtttccttctga

SEQ ID NO: 430 - DNA, 308 bp, mus musculus
attgcaagcttctgacacagacaaggaaggctagaactgcacagttagtggatactgcctctgtattgacctttctttcagactgtgaaggcggggacagagagctgcagtcaggatactttccctgctctggggcaacactgccatcatggcaaaatgtttcctgtagaccagcacagacacacacccctactccatcctgcatctcctcagccattttgaagcagggaggatgagggggattcatgaatggcgaagcttgcccattttactgtatttctctccttctgtgggcagactggcatcac

SEQ ID NO: 431 - DNA, 39893 bp, mus musculus
ggacagtgggcgggactaagggggccacctgcagacacaccctggcttcgggaccgtcttccttctcttccccctcggggcctagaggaggccacgcgcggggtctccgagctctagggtccggagctctagggtccttttatgtagcaaagtcaggcctgggaacagaacttcatgtgcttgtaaaaagtctcaggtgcgtcctcgttgttttagagacttggagaggaatgggggcggggggaacaaaatccgaggacagtcgagccaagaaaagtcggggcttctaggatgccaaccacgccaaacagatcaaaaccaggactggaggactgaagatgaagccggcaaaaagtcaccagccacggctcttgtaaggtaggtggtaaaccggagaagacatggttgtttctagaagattggaaaacgagcagaatttttaaagcagtattctaaacatttactatattttaaaagtgttaaagctacatatgaggaaaactaatgatttcatgcccaaagtacaagggaatttgccccttaaaataaaaacctatatattacacatgcaaagtgaagttacgagaatgtgtggcaagggcggttttggtttggtttgtcttgcttctcagattagtttgtttttactttgtaatttctcaaaattggaatactttgccagaagtgggaaaactttgacaatttcttgggatagaaagggcttctggatgcagacataataatgatgccaagcacttagaaatctgcagtgattgccaggggagcaaatggtctgtgccgagcactttctgcgctgccgtaccctgcgtgcatcgggttatatttcagaagacgcaagcttgagtgcgtgcttatacgatcctttccttgtagacattgctaaaggtttagactttgaatcctggtcagtgttaaagccggcttgactgtactattcaacgtgaacatctcagccaaggctgtgtattcatagctatgttgtatttatatttttatacaaccatcactgcagtacaaagggtgtgactgcacctgctggccccttttctttgaatatccatctgtgtgactgaattttggaaatatctattccttttttaaaaactgccttagagatcaaaacttgagcaagtacagcgactacttatagcttttttttcttcctttattgaaatatgcttaaaaaagaaatatgcttaacacatgaaaaatcgggtgtatttggtgcatacaacacatttatttttcctcaaacgataagcacaatcaagtatcacaagttacatgtttgaaatttactgtgctgacaatattcaagagaaatgctaatggcaaacttcattaaattctgtatgttgtacaggttattttttaaagatttatttgcttgttttacgtaagtatactgtggctgtcttcagacacaccagaagagggcccggattccattacagatggttgtgagtcaccatgtggttgttgggaattgaactcgggacctctggaagagcagtccatgctcttaaccactgagccatctctctctctcctgcccgtcttacagtttttaaagacatttttcgagatggaaatttgtagcaaattctgcaaagtgtacagctagaattcctaaggccacacacaccccttaagacagggtttctctgtgtatccctctagctgtcctggaactagctctgtagatcaggctggcctcaagctcagagattcccttgcctctaggatcaaaggcgtgcacccccaccacctggctgagttcctaagtttcttaagctttattgtgtggacctgtttcgttattatgtggcaatttaggtaaggaaggacttgataataaattccttaaatgataatattatagatactttatattgctgtatagagttttaaatattaagggagaagctagtgttctttaatgaacagggtcaatatagaaactctttggaaatttcttatttatctaaaatccagtcctttgaaatatttcaggatattttaatctacccagaaatcagaagtacaggtttggaatttaaaatggtgtgtgtgtgtgtgtgtgtaaatctgactttattattgatttgttgcaatttactggccataagtacgaaactatatgtgtgtactcaaaagaaaattggaataaatttgcaaagaattatcagtgcttgatccaagactttatgacattgcttttgtttctgatcaagatagggcggctttctaaatcctttgcaagcactgtattttagggaagaacactgtaagacttactataataaaaacataggaagcactcgttaatgattcatgtgtgaagaaaatgtggttgtgctctgtcaaatgaacctatgagacatattcaagtcccatttgactggaatttttagtcactccaggagagacttaataatacggagttgggatgtggcctttcctgggtcctccatttagagtcccagccacgttgcctcctactgaacacagaaggccaaatacctcggtgagaaaatggaggattccctaggaatctgatcctgagacctaagtcacctgataaggagcctaaatttgcatttccctgggagctaaattccagagtctttgttttcttcagagggactgctctccgaagcacacgattagggtaagagtagggaaatcttggctgaatgaagggcaggtttgttgcgccttgctagagtacagatggaattcttgaagaccattcatagctaaataaactgggtgctacatgcctgtatgatgtcccccaccagaacaaacggggtggcacctttctttctgcaatctcttctcacaagtttttttttttctttcaaccaaagagtaggaagtagaaggggctgattaatcacgtttcccagaataatactatcacccagagggaggtgttttccagtaccctgtggtgagagtgtgtctaacagttaagaaaggttggctctttggttaagtgggtctaggccctgaaacagaccaccttcaacttcaaagaaggagcttgagacaaagatgggatccaagggaagaaactaaagaggaattgacagggtggttttgtgactgaggacagctgcctgataggccagttattgcaggtcctgtagctcagagtcagtgaaatcaggcaaaaaccaaagcactcgaggagctttgtggggaggtgctgggcatttgttttctggctctgcttcttgaccaaggtgcaggagctgaacaaacctgcccttcattcagccaagagtccctactcttaccctagtcatttgcttctgtgagccatctccgcctaagaaaacaaagaggactctggaatttagctccggggaaatgccaatttaggcaccatatcaggtgacttaggtctcaggatcagattcccagggaatcctccattttctcaccagggtatttggagtctcaaaagacactcagaattgatgctccattgccaagatggaggagagcctaaagagaagaggtaaccttttccaggcctaagagataacagctacagtggcagtgaaggttttccccacggtctagtggaaggcctgctctagactagtgtagctctcaaccttcctaatgctgtgaccctttaatatagttctcatgctgtgctggcccccaacatagtaacatcttcattgctacttcataactgtaatcctactactgttatgagctgtaatgtaactatctgctttctggtggtcttaggtgacccctgtgaaaggattatttgacccccctcccccaaggggtcacgacatactggctgagaaccactgctctagaaggacatgctcttacctcagttttcatgaggtgagactttgcctattaaaactggaagtcagtctagtaataaaagtgaaacttatgctacttgagacctaacccttgattcatgttagttagcaggtgttattcaactgcctgcttcttagcagctttcaaatggagattccctataggccttctaggatatcctcttaagagagttttaagcacaccaggaaccctaggactcttggtgtcagcatagtaagaaatattgattatttcatagtcactgtacatgaacatttcccccttgtaatggtggtgttggtagctgagcactcacaagagaggaaggaacgctagtctgctgtactgccgtaaggaacgctagtctgctgtattgttgtaaggaacgctagtctgctgtattgtcgtaatgcttgctcactacttgaactcctttacccaggtatgcttcacctctcctgctaagtcttcatccctgtctatgaggacaaagaagttacgggttaaattggcgatgggccaggcgctccttgaggatgctctaaaggtaagccatggaatgaatggagacatttgaaacagcttgtttccaaggtcttgagtagtatgtgacagtaacccatgccttcttcggctgactgtaggtaagcaggtggtgagaaatgctacacgagctaggttaagctgtgcacactgaaggcatagtttccccttgtgctagactaagggggttacatgtgtgaagatagtgcattgttcttcaagttagaattgtgggccacagataaggtagcacaatgccctaaacatcttaaggtacaagaattttgtagtcacatacattaagagattacatctagccagaaggtgagtggaaacctaaagcagtagtaccttcctgggtcccaggaattcaaaaatgacagattgcagctacggctaacagatagtcttcaaactatttgtgtcagttcaaatggtatctcagaatgaaagggtcagaggaacgaaacaattcagtgaaggcataatggacccctgacttttcctgtgctgaagttaagctacagccccctaagtactgccataatgcccccatgctttaagtgagcaagaacatgaaagcaaagtcattgctacaactcagtttgtgtgcagatttacagaactgtacaaactctagccagaaaagcaatgctgttcattgattcgccgcttccaatgtcaatggttacgacagttaacctttctcatagacatctctttgtccaaagactgcctcgtgaaattggtcacacagtcacgctctacaggaaaggtaggcacaaagaggaagggtgaattccttttgtaagagtaccagtggggtagggaaaggggggcatttcctctatgcaaaatagtcgtcttcaacttttagaacattgaaagccatttccaagtcctctttaggggagagatagctgcctttgttttaggaatgaaaaaacagatttttgtttctttcagatgaagctattttggttagagaataggtcaggagccatctaggacaggttagaaggtggccttcctggaggtgacccacagttttgcatggacgaagatgagtgagctctatgaggcaaggtcccaaagagacttcatctcaggactgcttcttgcagctgatatgcctttcctatcattattaatattatataatacttggacattagcttatcctattgcagatttcttgcagatcaacataaagatgaactttcatgaattcatgctatttagatgaattagtaattttatagagtacctaatttgattcaaataatcttaggaagaaagttttaagagacagttctagttgtttgctaggaagatgtaataaagttaaaatcaagaatagaatgtgcctaatcttcagaatagtaagtaaaagttacataataagaaatacagtgagctttcatgattactccaaaaagagatacaggcttgacaagtttgtgttcaaggtaaaacattcaggtcccaggatgaagccacaggtgtgtactatgataaaacaaggccatgagaaacttgctttggacttacaatgagtatagagaatggaacactgctttgaacttaatatcaacagccttttgtaacttccatttgtggagtcttttacctatgaggtaattttccaagaacttttgtctattaaaaggccagagaaaagaaataaaggtggtgtggtgtgctgtgctgtgctgtgctgtgctgtgctgtgctgtgctgtggtatggtggcttggggagctctgcctcatccatgcatccatccatgcatccatccaaaagtgtatgtctgtttgtttatatgtatgtatgtaggtatatgtgagtgtatgtaagcatgcacaaattcctgtggagttaattgagagaggtgctcaggcctgaccagagtgtgggtgtatggatgaaaatgtgtcggtgcgacgtttcctgtgtaaaggattcttaattctcttcctttccgtcctctctggttcgcaaaaacttaactagccaagctagtgaaggacttctgcgtgccaggccagaaaaaaagagtattagcattaatcctttagctaacctcccctacccctaggtgttaagcaaaaggtgattaaattcacctgaagccattggcttctggccctagtataactaagaatcaaagagagtgaatattattaacactaagcaacctttacagtcgtgaaaccacattttgtcccctgctgacttactgcccaatcagccgcagaggacacaagctgggaaagctcctggcaggaatataagactttctctacttatttattatacacatgtttaaatatgttcttcacagaaacatggtgagcaaaatagtgactaggtccaaaggactaattgtgcaactgccagttgtttattgccttcaagttgttaaaaatctgttattagcattattattctcactaattttctgtgtatgggcatttggtcggcatacgtgtctgtgtgccccacacatgaatggtgcccacagaggccagaggagggcatcggatcctctggaactggaggcaagagttgttgccagccaccgtgagggtgtttgttggtaaaagaattcaggtctcctggaaggacaagtgctcttaaccactgagctctctactcagcctcagccttgaagctttgatttattcttatgtttagaattaaaatgttgaaaatagaaaacacatatttgaatttttttaaaaaagaaaaaaaaacaagaaaaaacccggtaccatttaaaaacataactgaaaaatagccacgtctttttctctaaaaaaaaaaaaatcatatttctatgcaaaatttaaagatcactttttattggcatgtattaactgcaaaaaggcaagtttcacaattgtatttcttttcttttgtggggaggggaccagcgtttgagactcatggtgtagcccatattgtcctcaagctgatggccatccttttgtcagcacgcatgagccgtcacacctgctagttagggcattttcatatagctgtttatgatattttgataacaaacatcttttctgttaccttgtaccttcttacatactgtctttccctcttccatatccccatattcccagtagcccccaaaagcctccctcttaaaagacctcactcttaatttttatgcacgtggaatgctatcattaatttctacgtgtaataacaagggttatgatatgaggcctgagaatacaggtgatagaagtaactgaagaggcaaggatatattccttatatattatacaagtcagagtcaataccaacaaattccatcagcctgtatataaacatgtgctatatgttgtcaatgtaaaacagcagaatgcaattgatcacagataagctagctatacagcatctaagagtatttgtttcagttgctgtttttgtttgtttgcttgcatgcttgtttgttgtttgccaatatgcttgctagtctttgtatttgttcagctacaaggtaatactaggagggggctggagagatgatggctcagcagttaatagtacttactggctgttcttgcagaggacctgggttcgattcctagcactgacattgtgactcacagcctcctgtaatttcagttccagggaatctgatgccttcttctaaccatcacgaagacaaggtacacatgtggggaacatgcaagcaaaacatattataattaaagtaaataaaaatgtttttaaaagaaaatgctatgttatttacacccctccatacacacacataccaaaaagtcatgtttcctgtgaatagtttattcctgtttgttgagtgatggactaatggcatcaaaccatgtatagtgtaataagaaaagaaaaaaatgaaaatgtatggtatatattttttttaggattatgcaagcataccacaatttcagcatatcaggagttcagggccagcattaagctacatagcaggtttgaagacagtctaggctgagaccctttctctcacacaaaagaatgcaggttgtttaataatgagactaaatcgatttaattaagtaacaccagtccttttaaagagttgtccatcgcttttacaatatgccggagctaggggtacatctcagtggtagacgccttacatatatgtacaggagcctgtgatgaacctaaacatgcagacctcttagtagtctttcagggaaattgagtttggagtgaattgagtccacttgtattagagaagttgtatagtctagagattctctaagaattgagaataaactcagaataaatatgtgtcgaaaaaaatcactcaagaaatgtgatctgttgaccacttgtgatttaatatatttgtttttccagttggtgatagaaaatgggagaactgaagacaaccactttataaaacccttgcctgcttgaatttgtggtgatggtaagttctgtattttttgtccctgactagtctgcaattttaagaaatgttacttccaaaaccacagaagttaaagaggaaacattaaaactattacatattctagggctaggtgtggttgctttgaatttaattccagctctcaggagtcagaggcaggtagatggatctctgagttcaaggcaaccctgggctacatagtgagaccttgtctaaagggggaaaagtacatattccaaagaataggacctcatgcttgtaggacctcagactatactaagaaaatggggaaaatgagagaatgtatcatgaccttctaattttgattaaagtgcctaccatttttttggctttatagatctcaaaatgcaaacaaattgccagcaaccatgcacatgcatacacacacacacacatacacacacacacatgcatgtataagtaagctagaagaggatctacttttaagaataaatataaaatgttttccatttagggaaaataaattaatatgtaagtattctgagtgtacagttggtacagaaggctatagagaaagctgtactcagtatgaatcaaatcaccattaaggtggcaggactatgtgcttatagacatatgtccataacatgtagcagtatacgtaagtatatcaaacaaaataagcatcatttatagtgattcacttactaaaaatgagaacttgaaaaatgaatatgtaattttgtcagactgctcgggaatgaggagtgaaatctatctgttgtttggtttctttatttttcctcctttttaaggtcacaaattagcttagctttgcctggtaacacttgtggccttggctggcctcaagcttgtgctattcgtcttgcttcagcctcccgagcagtaggatgaccaagctgactcaccacacctggctcaaagcctggacatttctgtgcgaaccataatgtaaaaacatgtcattttaatacaaatttctcgttatatatgaaagtagactttactgttgaaagggcctaaaggaaatactctgaaagtttatcagtgatctgaaagactgtgggagaagttggtctactgcatggttgctttcggaatctttgacttgtactgtgtggtagagcctagtaagaaaatagtttttatacttttctctacaatacagaagattgccccaaaatactgaacgatgtcagattatagaaagcagttgaaggctatttaatgacatggcaaagtgtccatgcagaaacacaggtctcacttcaaagaagataagagatgatggtcatttctgaccatgacccaggaacacaaatactcttatgttccatagttgaagtacttacctgatattttattattaaacaaagtcataaatcaaaatatttcccaaatgtattgggagaggtcacaggtatgtgagttataaccaagggaagaattctgatgtaggtttcaaaatagatatcctttagattggtgaaagctagtggtctgctaagaatatattttaaggtgttgatagtcacaaagatgtcacagacaccagatggcagtggatggctttgagagggattgaaaatagcacaaggtagttcagccttggtttacaatacctgtataaccttaaagttcagtctagtgagcctaaagttgactctgtgagcgtggtggctcatgcatttaatcccatcacttgggagacagaaacagaaagatttctgtgagttaaaggccagcctggtctacaaattgagtccaggacagccagggctggttacagtgagaaaccttgtctcaagaaaacaaaaataatagccgggcatggtggcgcacgcctttgcttttaatcccagcacttgggaggcagaggcaggtggatttctgagttcgaggccagcctggtctacaaagtgagttccaggatagccagagctatacagagaaaccctgtctcgaaaaaccaaaaaaaaaaaaaaaaaaaaaaaaaagagagaaagaaaaaagaaaaaagaaaaaaaaaagaaaagaaaaagaaaacaaaaataaataaaacaaagttcagtctcttggatttagcacagggtcagcttctgttcttccttctggtagctttatttgttcataaaagcctaagaaaacacttgagtaatctgactggcatataacacacacacacatataggaatcctaccatgtattgcctaaaatgatgagagctcttttggcatcttaaggtcttggccaaatggctgccaacaattcagcctataaagtctttttcagaatatggtgagttacttgggtgatgagaagatgaaccaaaaaaggactttacctagagaggtattcctgagctcaagttaccatatcttcccttcctcccctcccctctcctcccttcctctccccctccttcctgtcccttttctttcctttcctcttctgttttcttttcttcccttttcctccctccctccctccctccctccctccctccctttcctcctcctttttcagttttaatttttcttaggcttagatcctttatttgtcttggagctaacaacttgatgacttgggagcctacgaggggtgtgtggagctcagtgaacgagagagcagagctcggagggcaagggcctttgttgtattgttttgcttgtttcttccatagaaaatcttaggttaaggctggtctcctgcatcagctgagactgttagggactctcaacagagctctgcctggactgggactcactctgtagaccaggctggcctggaactcacaaagacctgccttcctctgcctcctgcgatcaaaggagtacccaatctaaaatttagaatattttaatatttttttaaaaatcttttcaaatctttttttttttttttttttttttttcttaatgcttgatgggcacaatgattttctgcctctggttttaggtttagaaaaacagacaagaagttttgttttttaaatgatcctgttagttgtgcttgctggtacctttttctttcttttttgcgagtgcgatgggcgggagaagaaaggcgcgcagcctgaactgtctgtctagatggagcactactgccatcgtgaggatgtaagttcaaatcccagcgcgcagttattagcgaattctcgagagcacttctggtttttccaactccattccgtaaagaagactacccggccctaacatcaaaatggcccaccgtttcccttctaagttagtctaggcgttctgagctgaagtttgatgctgacaggaaaacatttcatccagtgttgaaggcaggagctgcccgccactttccggaagctgggaggcgggactttggctgcggaagccttgagcctagagtcagctagctgcctatcacccgctgactggttcaccttttactgaagcaacattacagcttaagaaactaactgaagggctggtgagatggctcagtgggtaagagcacccgactgctcttccgaaggtccagagttcaaatcccagcaaccacatggtggctcacaaccatctgtaacaagatctgacgccctcttctggagtgtctgaagacagctatagtgtacttacatataataaataaaaataaatctttaaaaaaaaaaaaaagaaactaactgaaagtcttacccgccaccaccaactccctgttgaattaattgttttgagacagtccttcaccgagtcaaggcttccaaggaaactattaggtatcttctttatataatgaatgcaaaagaatgcaaatccctataagaaaaaaaaaaatctccggtcacactaaagtacaagagaaaaaaaaaacttaaatttttttccaaattaacttcagtgaaggaacattccttttctgtagtaaacccccatctacctttgtagctccttgtatcccctttagattacgtatgagagagaataagcgatacttttctctctcaatattatatcttgttttcagtagtggcagatggagactaagttttagagccaaccagaaacaccaccaaaaatctgaaatagatcttgatttttttcctaatgcagatatgacgagccagttaaagaccgtttttcacttcagtatgtatgacttgtgttaagagatgagtcaatgacacaaagtctgagcagctgctgtttgtgatgtatgtatgtttgagaaatttactgctcaaaatgagatactgacatggctccaaagaaagatagctgagcacgtcttctaggaatccaaagcaaataggtaccttccatttcatttactctagcccagtaaatagagaaggactatctatagcctccaatggtagcagtctccttggctagactttatcttaaaagaaataagcttttgtgggtttctccttctctccccaccccccagtttattcatttattcaatcatgtataccccagtgcgtctgaaccattaattagtaattaattaatttaaataattgagactcatctttggacagtagagctagtcaggtggctataagaagcctgttgatactgccccattgggaagacatttcccatacactcattttccccacttcttaactccttggctgtaagtccctgttagcctttgctgtcttcaggactgagcctgccttatttctcccttgttgagagatttatttatttatttatttatttatttttgagacagggtttctctgtatagccctggctgtcctggaactcgctttgtagaccaggctgggctcgaactcagaaatccttctgcctctgcctcctgagtgctggaattaaaggcgtgtgccaccacaccctgcccgagttttttatttcgagtcttccttgttttaacaatatctaattttatcaacaatagtaataagtcaagtgaggttgcttagaaatgcctacctctgtcattgatttttctgaatttctttatttcccttaggccaggcttctgaagatttgcttacaaagcagcaaacaataatttgggttgccaaagatatgaaacaaagagcagtagtatagtactaagaaatcaagggtcgtgctgagaatggtggtgattaccatagtccccagtttggcttcagacagaaataacaagtttactgtgtggcttgtccaagcagggcaaatataaagcagctgccatgtttcctgatgctcttgcttttggttagcattttcgttttcgttttcgttttttttttttttttttatagcttggaaaggcggggaaggagtagggcatttgtatgcatacctggaacgttactgccatcttgcggaagtagcttcattttgaaaaagacaaggcgattgtttcagtggtgctaatagctgtagtaatctaggcccttgagaagctgaagctggcatattttggtgagttctagactggtcaggtctgcatagtgagtcttcatctgaagaaagaagaatagggtcatgaagacgtcattcccatgttctagcagctaatcctgcttctggggagatctcagaggcttgcactcagacttggcttgcttttttttttttatgcaaatggctctggaccctgatgtattctattctctctgtggaccaagagctgtcagaagacaccggcacaggaagtgaaggggcaggatcgccactcctcccagtttgctctgaactgtgagccccactgaaagggtcagctttctttggtgctctggctcagacagcactgtcacggtgagcactccctccacctttggctggctggccaagacattcattcacagatcaaatacataactcatgcttgtaagctgccctttactgtcctgtccaccatactctgaaagaaactaagagaactccaaagcctagtattactgcaggaaagctaattcttggtccacaggacgagactcagaggaaaatatcccacaaaaacctggatttatctccaaagtcctgcaagtcttagaagagaggtattacttcatcacttcctgagtctgtgtgccctggaagctgcaggtccctgtccacaaggcctctccagctccaggatctgcacaacggaagttttaggcttcagatcataacccgggccctagtaataatgcttatgcctaaggaagtctagctaagagcagaggccagggctttccaacccctcgggcctcatctttgcatgctgctaagaatcatgggaaggaagctgctaggacgtgtgttgctttcttcaaaactctggccgcgtggtggcagtagggctccagataccacaggccgccatctttgcatcctctactcccgcccttctgtgtttgaaaaaaaaccaaactgttctctgacaggaaaaagtgctgaggaagactgccctccgttttgtgaaaatcagtggagctagttaacagcagccattttgcttttgttttcttttgcaaagcagcttaagggctaaaaccacctgctccgttcagacttttgtggtttccctaggtaaattgtcactggatttttgttcactaaagtgtgatttctttcccagagtggttcatgtccaatacattagccgttgcctttttaatgctgtaaatgatgtggacaaaggcagaaaagggaagacatttcgtaagtcagtgcacaagttaagttcccctttagttctttgtgttgaacccagatccatgagtatattaggcaggctcatttgctataactttagatcatgtgtgtatatgtgcatatatgtatatattacgtatatatttgtagttatataattttatgtagataatatataacacacactatatatacatatacaactatatgattatataattactgcatttatataaccatatgattttacatacatatttgaactgcagattgaacttggggcctcaggccttggggccttccctgaggtggggaagtgagtcctctaccacagagccatacatgaagggcattttccttttgaagcaaggcctcccagtgttgcttcgcttgcccaggaatttactctgttgatccggctgctctgaaaagtaagatccagagcctctggagtaagtggaattacaaatctttcccttgttggacaccctgctttccttttttccccctcaggcaaggtcttactttgtgagaccaactcccaagtctcccgctcctggcctatctaggctctgtctgagattagaagtttgttctatcatgcctcgcccaaatagcctatgcactgcttactctcctaggcaggaggaagtgctttgtggtttcgcattggcctgaggcatcagagaaggaggattgcagcaggcattcccacacctcagtcacttatactgctctactgagcacttaacagtgtctatccgaagtcactctgggttctgtcattttctcccatgagaattcagtacattccaatgtcatgagttatgttccatcacttactgtgatgtttattgggggaatggtgcataggagacattgtttcctaatctttggtagatagagtaccttgttgttgagaaggagtttctctgtggagccctggctgtcctagaactcactctgtagaccaggctggtctcgaattcagaaatcctcctgcctctgcctcccaagtgctgggattaaaggtgtgcaaaaccagtacctggctggtgctgtatcttgtatgatgtctcattactaagttaagaatgacactttcacagcactccgaaagacagcatgctggctgtaaagtagtgccaacatttgtttcaaagcaagtgataatcttgttgagtatgtatgtgcacatcatttcacatatacatgcatgcatatatattttatactaaaattggatgggataggtacattatagtttggatcagatcagtttatatttcacaaagacttgaggaaaatgagattacaggaatgttgtcaattttgcttatcaccatgatgttataaaagcaatgttttaaaaacgctctaaaattactttagaactatagatcgagtgaggtgcttttgtctgagctaggatctctagtactagctggcctgggaatttgcagtgatcttccttcttgggataattatcgatgtgggcaaccagagcaggcctgtgagatattttgtttatttaaccaacctgtggcttaattgctggtattgcataattcctttgtaggaaagactgacacaaagtacgcgttaatactgatgtgagaacaggtgttcagatccagtggactctgactacatgaacgggttaatcactgttggaactatatacgatgttgagagaattgaagttgacagtgaggttttgtgtgtgtgtgtgtgtgtgtgtgtgtgtgtgtgtttgtgtgtgtgtgtgaaaggctatctatgaagccctagttgcattgaactacatgaaccaggctgctcaggacccgagttcaatcagacatcaggagaaagcactggaggctgggtgctgctggatccagatgggagcaggtccagcctcctttgatatgtcattgataaaaaattcaaaatggaaggtaaattctaggagtacagcattgcaagcttctgacacagacaagggaggctagaactgcacagttagtggatactgcctcagtttgacattttttttcagtctgtgaaggcggggacagagagctgcagtcaagacaccttccctgctctggggcaacactgccatcatgggaaaatgtttcctgtagactagcacaggcacacacctcctcctccatcctgcttctcctcagccattttgaagcagggaggatgagggggattcatgaatggcgaagcttgcccgttttactatatttctctcctgtaggcagactgtcatcacaggacccttcagagtattaatgcagaccctggtgacagaggtccagtaccaagtgctcagctgtgctgaggtgcagggacaggaagcagatgggcggtttccagcccgctcagctggccatggtaatctactagctggtgtcctagggcagcaaggcgccttcctctccaggttctgaagagaaagcactgcagtcccagtttctgttggggtctgaggagaaggcaaggcagcccagctaggcacccacagctgctcctgctgtctgtaatcggccgccatcttctgccattgctaggaatcatgggaaaaaggagagtggctctgtgagttttgaaaccgtgtcctcatggtggcagtagagctccacacaagagcttgtgagtgcctctcccccgcccttcctgtctgaaaaaacgccaaggatgcatgtccaaacttttacccaactttgagtaatttaaaagttattttatttttttggtcatgtgttccatgtgaagccaatctgagacgtacttataccctaggcggtgggacttttccttcagttatgtagggtttttcccttttctcgctctatagctatggatttttaccctaatccgatatttaatggtgttaaaattttgtctgattaacttttgtaagttttaaatgataaagatatgatgggagatttagaagcaaaggactatgctgagccgtggtcctagtgaactacaagaggcaggctggcctgggcctttccaggaggcttctggtccatgttaccatgctcagcggacacgagtaggtttaaccttgtcttaagtaacatcagcaaacaaacactgggcagttgataattatatcccagcggcgatgtccatgctgcccagttttctcctctgtctgccttcatccaccatgtctaccctttgaggacaagtcactcgaagggaagtataacaggtctgaatggagaggggacagtggagaattactggtgaaaaacagtaacaaagtcctagacatcctcgatcctgggcctttgtctctagatattggttatggtatttatttttttaagattgagggtgggagagaggtagtccaggatggcctttgtgaccatatgtggtgtccttctgccatcctgcaggcagagctacagtgctgagccattaaaatctcattcccatgagtcctagcagtggggaaacaatgccaggttagatagtttgggttccacactgggacccggtgcctttcctctagagcagaagtgtgggcaccagtaatggcttcgagctgaaaagaaagacaaaggcgaacagcagagctgtagggacaagctgacacaggaagttgttggccaggcctttggttcttcctatctggggcatgacaagaagacaccacagggaaaaaatgcaggctctttgtggagaattcggtctcctgctccttgtagcatgtgtaggcaggattttaagccatgccttctttctaagacacagagactccctaattagtccacgctgttcaagcacacattatgtagctcaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgaaaatcagtgacagatcttttggaaatcagtcattggagagacctatgtttcttcaagtaggcatgttcatagcattcagtgttgacaggtatcagcatcctctttacagagccactaagtgagcctgccacaggacacacaaggccttttgtctggggctcttgtgtggatctcacacagagcatgatacccagggaagtgtaagtgtgatctgggtaacaaggacatgacctgacgcctaggtttgcttctgttgatgcactgaggtgacagtgtgttctttttctccctagaaccggcccctgggatttgctgctcagaacctgagttcactgagacatcaggagcaagcactggaggccgggtgctgctggatcctgatgggagccatgcaggacttgaccatggcctgcacacacttcttcccaggagaaggggaatgaggaaggtgggggcctcaaggctttctttccatctatttgtgttgctatgttcttatattcctttttttctgtttaattatttatttagtacaaaatcaggtccagcctccttaggtatggcattgatataaaatgtaaaatggaagctaaattctaggagtacagcactgcatgcttctgacacagacaagggaggctagagcagcacagttagaggacactgcctctgtattgacatttttttcagtcagtgaaggcggggacagagggctgcagtcaggacatcttctctgctgtgggacaatactgccaccatgcgggaaatgtttcttgtagaccagcgcaggaacacatacctcctccatcctagttctcctcagccattttgaagcagggaaggtcagggggattcataaatggtgaaatttgtccttcttactgtatttcactccttctgtaggcagactagaatcacagaacctttcagagtattaacgcagaccgcagtgactaaggtccattatcaagtgcgcagctgtgcttcggtacagggacaggaggcagaagggcaggtttcaccattgctcagctggccatggtaatctactagctggtgtcctagggcagcaaggcgcctccctctccaggatctgaagagaaagccctgcagtcccagtttctgttggggtctgaggagaaggcaaggaagcccagctaggcacccacagctgctcctgctgtctgtaatcggccgccatcttctgccattgctaggaatcatgggaaggaggagaatggcactgagagttttgaaaccgtgtcctcatggtggcagtagagctctacacaagagcttgtgagtgcctctcccccgccctttctttctgaaaaaacgccaaagatggttgtccaaacttttacccaactttgagtactttaaaagttgttttatttttttggtcatgtgttccatgtgaagccaatctgacacatacttctacccgaggtggtgggactcttttcctttagttatgaaggttacttcctttttctggttttataagtgaatttttaccctttccagatcgtaaatggtcttcaagtttggtatgattaattttgtgtaggttttacaagataattttatgctaggagattcagaagcaaaggacaatgctgagccctggctctagttaagtacatgaggcaggctggcctgggcctttccaggaggcttctggtccatgttatcatgcccagctgacatgagtaggtttaaccttgtcttaagtaacatcagcaaacaaacacctggcatatattatcaaattatatcccaaaggcgatgtccatgcttcccagttgtctcctctatctgcctacatccaccatgtttaccctttgaaggacaagtcactcaaaagaaagtatacaaggtctgcatggaaaggttgcagtagagaattactcctgaaaaacagtaacaaactcctagacatcctccatcctgggcctttctctctagatattggttatgataatttttttttaggctcgagggtgagagaggagtatccaggatggcctttgtggacacatgtggtgtccttctgccattcttcaggcaaagctacagtgcagagccattacagcttcattcccatgaatcctagcagtggggaaacaatgccaggtaggatactttgggttccacatttggacccagtgcctttcctctagagcaggaggagtgtgggcaccagtaatatcttggagctgaaaaggaaagataagggccaacagcagagctgtagggacaagctgacacaggaagttgtgggccaggcctttgggtcttcctatctggggcatgacaagaagaaaccccagggaagaaaatgtaggctgttgctggagacttctgtcttttcctcgttgttccatgttacacatgctacacattttaagctatgtcttcttgctaagaccagagactcccaatttactcccaagttgccctggcatacattatgcagtccaagctcctctctgagatgcataccttagttgctaagggaaagtacaagactgaaagtataataaagtataaagacaataacaggtgcatgtagtgaagccacgggaaccggaaatcaggctgtaatgtaggaaatcattgtgtccctgctcctgtgtgaactaatgaaaatcccattgagcatcagtggcagatccatttggaaatcatagccattggagagacctgtgtttctccaagtaggcatgttcatagcattcagtgttgacagctatctgcatgctctttacagagccactaaagtgagccttctagaggccacacaagacctttggtctggggctcttgtgtggatctcacacagagcatgatacccagggaagtgtaagtgtgatctgggtaacaaggacatgacctgactcctaggtttgtttctgttgaggcactgaggtgacagtgtgttctttttctccctaggactggcccctgggatttgctgctcagttcactgagacatcaggagcaagcactggaggccggtgctgctggacccagatgggagccatgcaggacttgaccatggcctgcatacacttcttcccaggagaaggggaatgaggaaggtgggggcctcaaagcctcctttcctttctgtttggcttcctatgtctttattctattttttgtatctgtttaattatttacttagtacaaaattcaggtccagcctccttaggtttggcattgataaaaaatgcaaaatggaaggtaaattctaggagtacagcattgcaagcttctgacacagacaaggaaggctagaactgcacagttagaggacactgcctctgtattgacatttttttcagtcagtgaaggcgggggtagagagctgcagtcaggacatcttctctgctctgggacaatactgccatcatgcggaaaatgtttcctgtagaccaacacaggcacacacacctcctcctccatcctgtttctcctcagccattttgaagcagggaggatcaggaggattcaaggatggggaagctttcctgttctactatatattttctccttctgtaggcagactggcatcacaggacattttagagcattactgtacaccctggtgactgaggtccattatcaagtgtgcagcggtgctgaggtccagggacaggaagcagaagggcgggttccagcccgctcagctggccatggtaagatactagctggtgtcctagggcagcaaggcgcctccctccccaggttctgatgagaaagcactacagtcctagtttctcttgggcctgagaattcaaggcagcccaactagggacccacagctgctcctgctggctgtaatcagccgccatcttcttccattgttagcaatcatgggaaggaggacagtggagttgtgagttttgaaaccgcatcctcatggaggcagtagagctccatacaagactttgtgagtgcttttcccccccgccctttgtgtctgaaaaaaagtctaagatggctgtcctaccttttatgcagctttgagtggctttaagagtattttaattttttgtcttctgttccacatgaggccaatctcaggcctaattcttccctaggtcattgtactccatgccttctgttatgcaggatatttcctatttcttactttataaccatttatttttccacggtatatcaaagtttgatatacttattttttgtaggttttacgcaaccttagtggaaggtctccagtgtgaaatactagccaggtctttcggttgtcatcttatggtctctcaggtcacacaaaatcagatattggttggttactctcacaagctttgtgccactggtgtttctgcagattgtaaggtttgcttctttctccttccatgagtcctagtccttatagagtaggtgctagtaaccttctctgtgctccatgcgtcttcagcagtttggccttgctgtcagtttatgaagggccacaaatagccttcataatagcctggattggcccaatctccatttgaagtaattcacccccagtactgaaggcttcatttagtgacaagaggagtctagttggagatgtttctacccttttgattcctccccatattacctccctcctgtccctttcccctccctctccttacttgatcctccattccattcccccactctgtgttccataactatcagttcttatgttccccttggaaggattatcaaaccgtcccccataggtcctttatacataacctcttgttatatgaactgtactttgcttctctgtgatttaaccgctaacattcacatgtgagtgagcacataaaatgtttcccttttgaccgggcagtggtggcacatgcactcaggagacagaggcaggcggatttctgagttcgaggccagcctggtctacagagtgagttccaggacagccagggctacgcagaaaccctgtgtagcaaaactaaaaaaaaaaaaattcccacttttggggtctgagttacctcaggatgattttgtttctctttctacccttttactcatgaatttcatgatttttactttgcaaagtggttgactaatattccattgtgtaaatgtaccacattttcttcattcattcatgtgcagacatcaagatttccagtttctggctgttccaaatagagcagcaatgaacatggttgagtatctttgtagtaggatgaaacagtctttagtatatatccaagactggctaggtgaatcttgaggtattgccatctttctgaggagccatcacactggtttgaatagtggctgtaaagcttgcacgcccagcaatggaggagtgtccccttaccatgcatcctaccaccatgagctatcctttgttttgttgatctcagccttcctgattggtgtaaaatgaaatctcaaagtagttttgatttgcatttccctgaaagctaaggatgttgaacattttaaagtatttcttcaccatctgagattcttcttttgagaattctccatctaaaattgtagcccgtttttaattggattattaatgttttttttttttagaaaacttttattcttctttaatgtattacttctgtaccattttcaacctcctgtcacttaaaccgtatccccatgtcctgtctctgccagatcaactactgctctatacccgtcaaaataagagaaggacaaaaaggaggagaaaagaaaagggaagagggagggagggagggaaagagggagagagagtgcaagagagagagagagcagcagcaaggactcctcccacagggtatgaaaagggttccaagcacagggaaagattcagagacacatgacctcccgttcccacaattaggagtcccataagaacacccagctgcacaaccacaaggtacctagctcagacccatacagggtccatgtttgttgtttcagtctctgtgaggcctgatgagccctatttagtagattttgtaccctgtgttttcaaggttcccaaacaatctgactcctacaatcctccctttaatgggtttcctggctctacttagtttttggctgtgggtctctgcatctgctcacatcagttgctggataacaccactctgatgactcttgggtggcgtggatctgtgagtatagcagaatatcattaggaatcacttccttgacttttttggatactttttgccaatcatgattggttctatcctgggtctcaggctgtccttcctctgatcctggccatccaggcagtgtcagccatgggacccctctcctggcagtgtgggccaaaagttagaccagtcatgggttggctacttttacaagttcttggccaccattgttctagcaagtcttgcagataggacatgataagtcaaatgttttgtggctgggtaggtgtcccagtccaaaggctaggaggcttgcctggttataaatgatggttggtttaggctctgtatcctccattaccaggagattttactagggttactctcatagattccaaggagtttgtaatgtattagatttctacaagtatcacccccaaaaggacccccaattccagttgtctctcttaccccccccacattctagttccttcaaaataaaggtatgagaaattatacatgatagattataatataaacacaaatttagtgaatgttcactttcgtttacaggtcaaacatactccatgatctatgtgattaggagttatagtgatttccatagctttgtcaccccaaatgctatggagcattaaattttgagacctacctagatcatcattacaggcaggtagtcagattggctggacgcccacccaaggccagttgtgtaagaaaggatggggtatggtgaccagggaatctgtgaagggaatcaggcagagacccaggtttcctggttcctaggtttgatcttctccagaccctgacttggcaacattttctttcctacctagaactggacgatgaattttaacctccacaccacaagcactggggtagaagactgctgctgggtgaagaagagactagacttgatcattgagcagccactcactgatatcttcagtgctgcatgaggaaggtgggtgcctcaaagctcctccatccttctctttccttcctgcttagatcataaattccaggcaatttccttcttacagcagagtttattcttctggatttggtggtggattctggtgaagatacagatggatgctctggctgagtcgctaccttgaaatgaaaatgggaggtaaactctcccatagatgaatcttcctcattttgaaggtaaagggtaaggaaagctgccatagttgttggactctgtccattattggagtttttttcagactgtgaaggcggggacagagagctgcactcgggacaccttccctgctctggggcaacactgtcatcatgcggaaaatgtttcctgtagagcagagcaggcacacacacctccgccatcctgcttctcctcagccattttgaagcagggaggatcaggaggattcatggatggtgaaatgtgcccgttttactgtctattttctccttaagtacccagactagaatcacctgacccttcagagtattaactcagaccctggtgactgaggtccagtaccaagtacacagctgtgctgaggtccagggacaggaagcagatgggcgggttccaacccgctcagctggcaatgataatctagtagctggtgtcttagagcaacaaggtgcctccatctccaggttctgaagagaaaacactgcagtcccagtttatgttggggccgtagaagaagtcaaggaagcccaactaggcacccacagctgcttctgctgtctgtaatcggtcgccatcttctgccattactaggaatcatgggaaggaggacagtggcactgtgagttttgaaaccacgtcctcgtggtggtagtagagcgccacacaagagcttgtgagtgcctctcccccgcccttcctgtctgaaaaaacacaaaagatggatgtcctaaggtttacccagctttgagtagtttaaaaggtatttttttcttccatgtgttccctgtgaaggcaatcttaggccctaggtggtgggacttttttccttctgttttgtaggttatttcctttttctgtctttagaactgtagatttttaccctttgcagatatttagtatttttaaatattggcatgattaggtttttgtaggttttacatgatgaagatagtctaggagatttagaagcaaagaactaagctgagctatgaagtacatgagacaggctggtctgggcctctccaggaggcttctgtcttttgctctgggagttccaaaaatatctcagaccatgctaccatgcccagctgaaggcagtaggtttaaccttgtcttaaatatcatcagcaaacaaacacttggcagttgataattatatcccaaagatgatgtccatgcttcccagttttctcctctgttagacttcatccaccatgtttaccctttgaaggacaagtcactcgaagggaagtataacaggcctgaatggagaggggacagtggagaattacttctgaaaaacagtaacataggcctagacatccaggatcctgggcctttgtctctagatattggttatggtatttattttcaggcttgaaggtgagagaagggtaatcaaggatggcctttgtggccatatgtggtgtccttctgccatcatgtatgcagagctacagtgcagagccattacagcttcattcccatgaatcctagtagtggggacacaatgccaggtaggatactttgggttccacactgggacccagtgcctttcctctagagcaggagaagtgtgggccccagtaatgtcttgcagctgaaaaggaagactaaagtccaacagcagagctgtagggacaagctgacacaggaagttgtgggccaggcctttggttcttcctatctggggtatgataagacgacaccacagggaaaaaaatgcaggctctttgtagagaattcggtctcctgctccttgtagcatgtgtaggcaggattttaagccatgccttctttctaagacacagagactccctaattagtccaagctgttcaagcacacataatgtagcccaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgagaatcagtgacagatcttttggaaatcagtcattggagagacctatgtttcttcaagtaggcatgttcatagcattcagtgttgacaggtatcagcatgctctttacagagccactaagtgagcctgccacaggacacacagtgtcttatgtctggggctcttgtgtggatctcacacagagcatgatacccagggaagtgtaagtgtgatctgagtaacaagtacatgacctgaagcctaggtttgcttctcttgatacactgaggtgacagtgtgttctttatctccctagaaccggcccctgagatttgctgctcagaacctgagttcactgagacatagggagcaagcactggagatccggtgctgctggacccaggtgggcgccatgcaggacttgaccatggcctgcacacacttcttcccaggagaaggggagtgaggaaggtgggggcctcaaggctttctttccatctatttgtgttgctatgttcttatattccattttttctgtttaattatttatttagtataaaatcaggtccagcctccttaggtatagcactgatataaagtataaaatggaagctaaattctaggagtacagcactgcatgcttctgacacagacaaggaaggctagagcagcacagttagaggacactgcctccgtattgacatttttttcagtcagtgaaggcagggaaagagagctgcagtcaggtcatcttctctgctgtgggacaatactgccaccatgcgggaaatgtttcttgtagaccagtgcaggcacacatacctcctccatcctactgctcctcagccattttgaagcagggaaggtcagggggattcataaatggtgaaatttatccttcttactatatttcactccttctgtaggcagactacaatcacagaacctttcagagtattaacacagaccgcggtgactgaggtcaattatcaagtgcacagctgtgcttcggtacagggacaggaggcagaagggcaggtttcaccattgctcagctggccatggtaatctactagctggtgtcctagggcagcaaggcgcctccctctccaggttctgaagagaaagcactgcagtcccagtgtttgttggggtctgaggagaaggcaaggcagcccagctaggcacccacagctgctcctgctgtctgtaatctgccaccatcttctgccattgctaggaatcatgggaaggaggagaatggcactgtgagttttgaaaccgtgtcctcatggtggcagtagagctccacacaagagcttgtgagtgcctctcccccgcccttcctgtctgaaaaaacgccaaagatggttgtccaaacttttacccaactttgagtactttaaaagttgttttatttttttggtcatgtgttccatgtgaagccaatctgagacatacttataccctaggtggtgggactcttttcctttagttatgtagggtttgtcccttttctcactttatagctatggatttttaccctaatccgatatttaatggtgttaaaattttgtctgattgactttttgtaagttttaaatgatgaagatatgatgggagatttagaagcaaaggactatgctgagccgtggtcctagtgaactacatgaggcaggctggcctggccctttccaggaggcttctggtccatgttaccatgctcagcggacacgagtaggtttaaccttgtcttaagtaacatcagcaaacaaacactggacagttgataattatatcccaacggcgatgtccatgctgcccagttttctcctctgtctgccttcatccaccatgtctaccctttgaggacaagtcactccaagggaagtataccaggtctgaatggagaggggacagtgtagaattactgctgaaaaacagtaacaaagtcctagacatcttcgatcctgggcctttgtctctagatattggttatggtatttatttttttaagattgagggtgggagaggggtagtgcaggatggcctttgtgaccatatgtggtgtccttctgccatcctgcaggcagagctacagtgctgagccattaaaatctcattcccatgagtcctagcagtggggaaacaatgccaggttagatagtttgggttccatactgggacccggtgcctttcctctagagcagaagtgtgggcaccagtaatggcttcgagctgaaaagaaagacaaaggcaaacagcagagctgtagggacaagctgacacaggaagttgttggccaggcctttggttcttcctatctggggcatgacaagaagacaccacagggaaaaaatgcaggctctttgaggagaattcggtctcctgctccttgtagcatgtgtaggcaggattttaagccatgccttctttctaagacacagagactccctaattagtccaagctgttcaagcacacattatgtagcccaggctcctctcagaggtgtatgtcttagtggccaagggaaagtagaagactgaaagtataaagaaaagaacgtgtatatagttaagccatgggaaactgtaattggcctataatgtaggaatatcttatgtcgtgctccagtgtgaactattgaaaaccccattgagaatcagtaacagatcttttggaaatcagtcattggagagacctatgtttcttcaagtaggcatgttcatagcattcagtgttgacaggtatcagcatgctctttacagagcaactaagtgagcctgccacaggacacacagtgtcttatgtctggggctcttgtgtggatctcacacagagcatgatacccagggaagtataagtgtgatctgggtaacaagggcatgacctgacacctaggtttgcttctgttgaggcactgaggtggcagtgtgttctttatctccctagaaccggcccctgggatttgctgctcagaacctgagttcactgagacatcaggagcaagcactggaggtcgggtgctgctggacccaggtgggcgccatgcaggacttgaccatggcctgcacacacttcttcccaggagaatgggagtgaggaaggtgggggcctcaaggcttcctttccatctatttgtgttgctatgttcttatattcctttttttctgtttaaaaaatttagtacaaaatcaggtccagccttcttaggtttggcattgatataaaatgcaaaacagaagctaaattctaggagtacagcactgcatgcttctgacacagacaaggaaggctagaactgcacagttagaggacactgcctctgtattgacattttttttagtcagtgaaggcggggaaagagagctgcagtcaggacatcttctctgctgtgggacaatactgccaccatgcgggaaatggttcttgtagaccagtgcaggcacacatacctcctccatcctactgctcctcagccattttgaagcagggaagatcagggggattcatcaatggtgaaatttgtccttcttactgtatttcactccttctgtaggcagactagcatcacagaacctttcagagtattaacgctgaccatggtgactgaggtccattatcaagtgcgcagctgtgctgaggtacagggacaggaggcagaagggcgggtttcaccattgctcagctggccatggtaatctactagctggtgtcctagggcagcgaggcgcctctctctccaggatctgaagagaaagcactgcagtcccagtttctgttggggtctgaggagaaggcaaggcagcccagctaggtacccacagctgctcttgctgtctgtaatcggccgccatcttctgccattgctaggaatcatgggaaggaggagaatggcactgtgagttttgaaaccgtgtcctcatggtggcagtagagctccacacaagagcttgtgagttcctcttccccgccctttctttctgaaaaaacgccaaagatggttgtccaaacttttacccaactttgagtactttaaaagttgttttatttttttggtcatgtgttccatgtgaagccaatctgacacatacttctacccgaggtggtgggactcttttcctttagttatgtagggtttttcccttttctcgctctatagctatggatatttaccctaatccgatatttaatggtgttaaaattttgtctgattaacttttgtaagttttaaatgataaagatatgatgggagatttagaagcaaaggactatgctgagccgtggtcctagtgaactacaagaggcaggctggcctggccctttccaggaggcttctggtccatgttaccatgctcagcggacacgagtaggtttaaccttgtcttaagtaacatcagcaaacaaacactgggcagttgataattatatcccaacggcgatgtccatgctgcccagttttctcctctgtctgccttcatccaccatgtctaccctttgaggacaagtcagtccaagggaagtataacaggcctgaatgaagaggggacagtggagaattacttctgaaaaacagtaacaaagtcctagacatccaggatcctgggcctttgtctctggatattggttatggtatttattttttaagattgagggtgggagaggggtagtccaggatgtcctttgtgaccatatgtggtgtccttctgccatcctgcaggcagacctacaatgctgagccattaaaatctcattcccatgagtcctagcagtggggaaacaatgccaggttagatactttgggtttcatactgggacccagtgccttttctctagagcagaagtgtgggcaccagtaatggcttcgagctgaaaaggaagagtaaagggcaaacagtagagcttcctgatacaggaagttgtgggccaggtctttgggtcttcctatctggggcatgacaagaagacaccacagggaaaaaaatgcaggctctttgtggagaattcggtctcctgctccttgtagcatgtgtaggcaggattttaagccatgccttctttctaagacacagagactccctaattagtccacgctgttcaagcacacattatgtagcccaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgagaatcagtgacagatcttttggaaatcagtcattggagagacctatgtttctacaagttggcatgttcatagcatttagtactgacaggtgtctgcatgctctttacagagccactaaagtgagcctgccacaggacacacaaggccttttgtatggggctcttgtgtggatctcacacagagcatgatacccagggaagtctaggtgtgatgtgggtaacaagggcatgacctgaccccttggttagtttatgttgatgcactgaggtgacagtgtgttctttttctccctagaaccggcccctgggatttgctgctcagaacctgagttcactgagacatcaggagcaagcactggaggccaggtgctgctggacccagatgggagccatgcaggacttgaccatggcctgcacacacttcttcccaggagaaggggaatgaggaaggtgggggtctcaaggcttcctttccatcagtgtgttgctatgttcttatattcctttttttctgtttaattatttatttagtacaaaatcaggtccagcctccttaggtatggcactgatataaagtataaaatggaagctaaattctaggagtacagcactgcatgcttctgacacagacaaggaaggctagaactgcacagttagaggacactgcttctgtattgacatttttttcagtcagtgaaggcggggaaagagacctgcagccaggacatcttctctgctgtgggacaatactgccatcatgcggcaaatgtttcttttagatcagcgcaggcacacatacctcctccatcctactgctcctcagccattttgaagcaaggaagatcagggggattcatcaatggtgaaatttgtccttcttactgtatttcactccttctgtaggcagactagtatcacaggacctttcagagtattaacgcagactgcggtgattgaggtctagtaccaagtgcacagcggtgctgaggtgcagggacaggaagcagaagggcaggttccagcccgctcagctggccatggtaatctactagctagtgtcctagggcagcaaggtgtctctctcttggttttgaagagaaagaactacagtcccagtttctgttggggcttgaaaagtcaaggaagccctgctgggcacccacagctgctcctgctgtctgtaattggtcgccatcttctgtcattgctaggaatcatgggaaagaggacagtgttgctgtgagttttgaaaccgcgtcctaatggtggcagtagagctctacacaagagcttatgagtgcttctaccctgcccttcatgtctaaaaaaaaaactgctaaagatggctatcctaactttaacccaactttgagtagtttaaaaggtattttaattttatgtcatccattccttgttaggccaatctgaggccctaggtggtgggactcttttccttcagttatgaaggttatttcctttttctgtctttataagtggatttttaccctttccagatagttaatggtcttcaagtttggtatgattaattttgtgtaggttttacaagataattttatgctaggagattcagaagcaaaggacaatgctgagccctggctctagttaagtacatgaggcaggctggcctgggcctttccaggaggcttctggtccatgttatcatgcccagctgacatgagtaggtttaaccttgtcttaagtaacatcagcaaacaaacacctggcatatattatcaaattatatcccaaaggcgatgtctatgcttcccagttgtctcctctatctgcctacatccaccatgtttaccctttgaaggacaagtcactcaaaggaaagtatacaaggtctgcatggagaggttgcagtagagaattactcctgaaaaacagtaacaaactcctagacatcctccatcctgggcctttctctctagatattggttatgataattttttttttaggctcgagggtgagagaggagtatccaggatggcctttgtggacacatgtggtgtccttctgctattctgcaggcaaagctacagtactgagccattacacttaattcccatgagtcctagcagtggggaaacaatgccaggcaggatactttgggttccacatttggacccagtgcctttcctctagagcaggaggagtgtgggccccagtaatgtcttacagctgaaaaggaaaaataagggacaacagcagaaccttagggacaagctgacacaggaagttgtgggccaggcctttggttcttcctatctgggacatgacaagaagaaaccccagggaagaaaatgtaggctgttgctggagacttctgtcttttcctctttgtagcatgttacacatgctacacatttcaagctttgtcttcttgctaagaccagagactcccaatttactcccaagttgccctggtacacattaagtagtcaaagctcctctcctagatgcataccttagttgccaagggaaagtacaagactgaaagtataataaagtataaagacaataacacgtgcatgtagtgaagccacgggaaccggaaatcagactgtaatgtaggaaattcttgtgtccttgctcctgggtaaactaatgaaagccccattggagagacctgtgtttctccaagtaggcacgtatttagcattcagtgttgacaggtatctgcatcctctttacagagcaactaagtgagcctgccacaggacacacagtgtcttatgtctggggctcttgtgtggatctcacacagagcatgatacccagggaagtctaggtgtgatgtgggtaacaaggacatgacctgacgcctaggtttgcttctgttgaggcactgagatggcagtgtgttctttttctccctaggactggcccctgggatttgctgctcaggacctgagttcactgagacatcaggagcaagcactggaggctgggtgctgctggacccagatgggagccatgcaggacttgaccatggcctgcacacacttcttcccaggagaaggggaatgaggaaggtgggggcctccaagcttcctttcctttctgtttgacttcctatgtctttatatttctttttttctgatcagttatttatttagtacaaaatcaggtccagccttcttaggtatggcattgatataaaatgcaaaatagaagctaaattctaggagtacagcattgcatgcttctgacagagacaaggacggctagaactgcacagttagaggacactgcctctgtattgacatttttttcagactgtgaaggcgggcacagagagctgcactcaggacaccttccctgctctggggcaacactgccattatgtggaaaatgtttcctgtagagcagagcaggcacacagacctcttcctccatcctgcttctcctcagccattttgaagcagggaggatcaggaggattcatgaatggcgaaatgtgcctgttttaatgtctattttctccttaagtacccagactagaatcacctgacccttcagagtattaactcagaccctggtgacttgaggtcctgtaccaagtgcacagctgtgctgaggtccagggacaggaagcagatgggcgggttcctgcccgctcaactggccactataatctattagctggtgtcttgaataggaaggcacctcactctccaggttctgaggagaaaacactgcagtcccagtttctgttggggtctgagaagtcaagacagcccaactaggcacccacagctgctcctgctgtctgtaatcggtcgccatcttccgccattgctaggaattatgggaaggaggagagtggcgctgtgagttttgaaaccgtggcctgagggtggcagtagagctccacacaagtgctcctgagtgcctctcccccgcccttcctgtctgaaaaatcacaaaaaatggctgtcctaacatttacccagctttgagttgtttaaagggtgttgtttttttttcatgtgttccctttgaagccaatctgacttcataggtagtgggacattttttcttctgttatttaggttatttcctttttctgtctttataactgttgatatttaccctgtacagatatttaatgttcctaaaatttggtatgattcctttgtgtaggttctacatgatgacaatatgctaggagatttagaagtaaagaactaagcttagcaatgattcttgttaagtacaggagacaggctggtctgggcctctccaggaggcttctgtcttttgctctgggagttccaaaatatctcagaccatgctaccatgcccatctgaaggcagtaggtttaaccttgtcttaaatatcatcagcaaacaaacacttggcagttgataattatatcccaaagatgatgtccatgcttcccagttttctcctctgttagacttcatccaccatgtttaccctttgaaggacaagtcactcgaagggaagtataacaggcctgaatggagaggggacagtggagaattacttctgaaaaacagtaacataggcctagacatccaggatcctgggcctttgtctctagatattggttatggtatttattttcaggcttgaaggtgagagaagggtaatcaaggatggcctttgtggccatatgtggtgtccttctgccatcatgtatgcagagctacagtgcagagccattacagcttcattcccatgaatcctagtagtggggacacaatgccaggtaggatactttgggttccacactgggacccagtgcctttcctctagagcaggagaagtgtgggccccagtaatgtcttgcagctgaaaaggaagactaaagtccaacagcagagctgtagggacaagctgacacaggaagttgtgggccaggcctttgggtcttcctatctggggcatgacaagaagaaaccccagacaagaaaatgcaggcccttgctatagacttctgtctccacctttttgtagcatgttacacatggtacacatttcaagctatgtctttttgctaagaccagagactcctaatttactcccaagttgccctggcatacattatgcagtccaagctcctctctgagagatgcatgtcttagttgccaagggaaagtataagactgtaagtaaagtataaagacaacgtgtatgtagtgaagccacgggaactggaaatcagactgtaatgtagcaaattcttgtgtccctgctcctgtgtgaactaatgaaagccccattgagcatcagtggcagatccatttggaaatcacagtcattggaaagaactgtgtttctccaagtaggcatgtatatagcattcagtgttgactgctatctgcatgctttttacagagccactaaagtgagcctgccacaggacacacaaggccttttgtcctggcctcttgtgtggatctcacacagagcatgatacccagggaagtgtaagtgtgatctgagtaaccagggcatgacctgaggcctaggtttgcttctgttgaggcactgagatggcagtgtgttctttttctccctagaactggcccctgggatttgctgctcagaacctgagttcactgagacatcaggagcaagcactggaggccgggtgctgctggacccagatgggagccatgcaggacttgaccatggcctgcacacacttcttcccaggagaaggggaatgaggaaggtgggggcctcaaagcttcctttcctttctg

SEQ ID NO: 432 - DNA, 19927 bp, mus musculus
gacagtgggcgggactaagggggccacctgcagacacaccctggcttcgggaccgtcttccttctcttccccctcggggcctagaggaggccacgcgcggggtctccgagctctagggtccggagctctagggtccttttatgtagcaaagtcaggcctgggaacagaacttcatgtgcttgtaaaaagtctcaggtgcgtcctcgttgttttagagacttggagaggaatgggggcggggggaacaaaatccgaggacagtcgagccaagaaaagtcggggcttctaggatgccaaccacgccaaacagatcaaaaccaggactggaggactgaagatgaagccggcaaaaagtcaccagccacggctcttgtaaggtaggtggtaaaccggagaagacatggttgtttctagaagattggaaaacgagcagaatttttaaagcagtattctaaacatttactatattttaaaagtgttaaagctacatatgaggaaaactaatgatttcatgcccaaagtacaagggaatttgccccttaaaataaaaacctatatattacacatgcaaagtgaagttacgagaatgtgtggcaagggcggttttggtttggtttgtcttgcttctcagattagtttgtttttactttgtaatttctcaaaattggaatactttgccagaagtgggaaaactttgacaatttcttgggatagaaagggcttctggatgcagacataataatgatgccaagcacttagaaatctgcagtgattgccaggggagcaaatggtctgtgccgagcactttctgcgctgccgtaccctgcgtgcatcgggttatatttcagaagacgcaagcttgagtgcgtgcttatacgatcctttccttgtagacattgctaaaggtttagactttgaatcctggtcagtgttaaagccggcttgactgtactattcaacgtgaacatctcagccaaggctgtgtattcatagctatgttgtatttatatttttatacaaccatcactgcagtacaaagggtgtgactgcacctgctggccccttttctttgaatatccatctgtgtgactgaattttggaaatatctattccttttttaaaaactgccttagagatcaaaacttgagcaagtacagcgactacttatagcttttttttcttcctttattgaaatatgcttaaaaaagaaatatgcttaacacatgaaaaatcgggtgtatttggtgcatacaacacatttatttttcctcaaacgataagcacaatcaagtatcacaagttacatgtttgaaatttactgtgctgacaatattcaagagaaatgctaatggcaaacttcattaaattctgtatgttgtacaggttattttttaaagatttatttgcttgttttacgtaagtatactgtggctgtcttcagacacaccagaagagggcccggattccattacagatggttgtgagtcaccatgtggttgttgggaattgaactcgggacctctggaagagcagtccatgctcttaaccactgagccatctctctctctcctgcccgtcttacagtttttaaagacatttttcgagatggaaatttgtagcaaattctgcaaagtgtacagctagaattcctaaggccacacacaccccttaagacagggtttctctgtgtatccctctagctgtcctggaactagctctgtagatcaggctggcctcaagctcagagattcccttgcctctaggatcaaaggcgtgcacccccaccacctggctgagttcctaagtttcttaagctttattgtgtggacctgtttcgttattatgtggcaatttaggtaaggaaggacttgataataaattccttaaatgataatattatagatactttatattgctgtatagagttttaaatattaagggagaagctagtgttctttaatgaacagggtcaatatagaaactctttggaaatttcttatttatctaaaatccagtcctttgaaatatttcaggatattttaatctacccagaaatcagaagtacaggtttggaatttaaaatggtgtgtgtgtgtgtgtgtgtaaatctgactttattattgatttgttgcaatttactggccataagtacgaaactatatgtgtgtactcaaaagaaaattggaataaatttgcaaagaattatcagtgcttgatccaagactttatgacattgcttttgtttctgatcaagatagggcggctttctaaatcctttgcaagcactgtattttagggaagaacactgtaagacttactataataaaaacataggaagcactcgttaatgattcatgtgtgaagaaaatgtggttgtgctctgtcaaatgaacctatgagacatattcaagtcccatttgactggaatttttagtcactccaggagagacttaataatacggagttgggatgtggcctttcctgggtcctccatttagagtcccagccacgttgcctcctactgaacacagaaggccaaatacctcggtgagaaaatggaggattccctaggaatctgatcctgagacctaagtcacctgataaggagcctaaatttgcatttccctgggagctaaattccagagtctttgttttcttcagagggactgctctccgaagcacacgattagggtaagagtagggaaatcttggctgaatgaagggcaggtttgttgcgccttgctagagtacagatggaattcttgaagaccattcatagctaaataaactgggtgctacatgcctgtatgatgtcccccaccagaacaaacggggtggcacctttctttctgcaatctcttctcacaagtttttttttttctttcaaccaaagagtaggaagtagaaggggctgattaatcacgtttcccagaataatactatcacccagagggaggtgttttccagtaccctgtggtgagagtgtgtctaacagttaagaaaggttggctctttggttaagtgggtctaggccctgaaacagaccaccttcaacttcaaagaaggagcttgagacaaagatgggatccaagggaagaaactaaagaggaattgacagggtggttttgtgactgaggacagctgcctgataggccagttattgcaggtcctgtagctcagagtcagtgaaatcaggcaaaaaccaaagcactcgaggagctttgtggggaggtgctgggcatttgttttctggctctgcttcttgaccaaggtgcaggagctgaacaaacctgcccttcattcagccaagagtccctactcttaccctagtcatttgcttctgtgagccatctccgcctaagaaaacaaagaggactctggaatttagctccggggaaatgccaatttaggcaccatatcaggtgacttaggtctcaggatcagattcccagggaatcctccattttctcaccagggtatttggagtctcaaaagacactcagaattgatgctccattgccaagatggaggagagcctaaagagaagaggtaaccttttccaggcctaagagataacagctacagtggcagtgaaggttttccccacggtctagtggaaggcctgctctagactagtgtagctctcaaccttcctaatgctgtgaccctttaatatagttctcatgctgtgctggcccccaacatagtaacatcttcattgctacttcataactgtaatcctactactgttatgagctgtaatgtaactatctgctttctggtggtcttaggtgacccctgtgaaaggattatttgacccccctcccccaaggggtcacgacatactggctgagaaccactgctctagaaggacatgctcttacctcagttttcatgaggtgagactttgcctattaaaactggaagtcagtctagtaataaaagtgaaacttatgctacttgagacctaacccttgattcatgttagttagcaggtgttattcaactgcctgcttcttagcagctttcaaatggagattccctataggccttctaggatatcctcttaagagagttttaagcacaccaggaaccctaggactcttggtgtcagcatagtaagaaatattgattatttcatagtcactgtacatgaacatttcccccttgtaatggtggtgttggtagctgagcactcacaagagaggaaggaacgctagtctgctgtactgccgtaaggaacgctagtctgctgtattgttgtaaggaacgctagtctgctgtattgtcgtaatgcttgctcactacttgaactcctttacccaggtatgcttcacctctcctgctaagtcttcatccctgtctatgaggacaaagaagttacgggttaaattggcgatgggccaggcgctccttgaggatgctctaaaggtaagccatggaatgaatggagacatttgaaacagcttgtttccaaggtcttgagtagtatgtgacagtaacccatgccttcttcggctgactgtaggtaagcaggtggtgagaaatgctacacgagctaggttaagctgtgcacactgaaggcatagtttccccttgtgctagactaagggggttacatgtgtgaagatagtgcattgttcttcaagttagaattgtgggccacagataaggtagcacaatgccctaaacatcttaaggtacaagaattttgtagtcacatacattaagagattacatctagccagaaggtgagtggaaacctaaagcagtagtaccttcctgggtcccaggaattcaaaaatgacagattgcagctacggctaacagatagtcttcaaactatttgtgtcagttcaaatggtatctcagaatgaaagggtcagaggaacgaaacaattcagtgaaggcataatggacccctgacttttcctgtgctgaagttaagctacagccccctaagtactgccataatgcccccatgctttaagtgagcaagaacatgaaagcaaagtcattgctacaactcagtttgtgtgcagatttacagaactgtacaaactctagccagaaaagcaatgctgttcattgattcgccgcttccaatgtcaatggttacgacagttaacctttctcatagacatctctttgtccaaagactgcctcgtgaaattggtcacacagtcacgctctacaggaaaggtaggcacaaagaggaagggtgaattccttttgtaagagtaccagtggggtagggaaaggggggcatttcctctatgcaaaatagtcgtcttcaacttttagaacattgaaagccatttccaagtcctctttaggggagagatagctgcctttgttttaggaatgaaaaaacagatttttgtttctttcagatgaagctattttggttagagaataggtcaggagccatctaggacaggttagaaggtggccttcctggaggtgacccacagttttgcatggacgaagatgagtgagctctatgaggcaaggtcccaaagagacttcatctcaggactgcttcttgcagctgatatgcctttcctatcattattaatattatataatacttggacattagcttatcctattgcagatttcttgcagatcaacataaagatgaactttcatgaattcatgctatttagatgaattagtaattttatagagtacctaatttgattcaaataatcttaggaagaaagttttaagagacagttctagttgtttgctaggaagatgtaataaagttaaaatcaagaatagaatgtgcctaatcttcagaatagtaagtaaaagttacataataagaaatacagtgagctttcatgattactccaaaaagagatacaggcttgacaagtttgtgttcaaggtaaaacattcaggtcccaggatgaagccacaggtgtgtactatgataaaacaaggccatgagaaacttgctttggacttacaatgagtatagagaatggaacactgctttgaacttaatatcaacagccttttgtaacttccatttgtggagtcttttacctatgaggtaattttccaagaacttttgtctattaaaaggccagagaaaagaaataaaggtggtgtggtgtgctgtgctgtgctgtgctgtgctgtgctgtgctgtgctgtggtatggtggcttggggagctctgcctcatccatgcatccatccatgcatccatccaaaagtgtatgtctgtttgtttatatgtatgtatgtaggtatatgtgagtgtatgtaagcatgcacaaattcctgtggagttaattgagagaggtgctcaggcctgaccagagtgtgggtgtatggatgaaaatgtgtcggtgcgacgtttcctgtgtaaaggattcttaattctcttcctttccgtcctctctggttcgcaaaaacttaactagccaagctagtgaaggacttctgcgtgccaggccagaaaaaaagagtattagcattaatcctttagctaacctcccctacccctaggtgttaagcaaaaggtgattaaattcacctgaagccattggcttctggccctagtataactaagaatcaaagagagtgaatattattaacactaagcaacctttacagtcgtgaaaccacattttgtcccctgctgacttactgcccaatcagccgcagaggacacaagctgggaaagctcctggcaggaatataagactttctctacttatttattatacacatgtttaaatatgttcttcacagaaacatggtgagcaaaatagtgactaggtccaaaggactaattgtgcaactgccagttgtttattgccttcaagttgttaaaaatctgttattagcattattattctcactaattttctgtgtatgggcatttggtcggcatacgtgtctgtgtgccccacacatgaatggtgcccacagaggccagaggagggcatcggatcctctggaactggaggcaagagttgttgccagccaccgtgagggtgtttgttggtaaaagaattcaggtctcctggaaggacaagtgctcttaaccactgagctctctactcagcctcagccttgaagctttgatttattcttatgtttagaattaaaatgttgaaaatagaaaacacatatttgaatttttttaaaaaagaaaaaaaaacaagaaaaaacccggtaccatttaaaaacataactgaaaaatagccacgtctttttctctaaaaaaaaaaaaatcatatttctatgcaaaatttaaagatcactttttattggcatgtattaactgcaaaaaggcaagtttcacaattgtatttcttttcttttgtggggaggggaccagcgtttgagactcatggtgtagcccatattgtcctcaagctgatggccatccttttgtcagcacgcatgagccgtcacacctgctagttagggcattttcatatagctgtttatgatattttgataacaaacatcttttctgttaccttgtaccttcttacatactgtctttccctcttccatatccccatattcccagtagcccccaaaagcctccctcttaaaagacctcactcttaatttttatgcacgtggaatgctatcattaatttctacgtgtaataacaagggttatgatatgaggcctgagaatacaggtgatagaagtaactgaagaggcaaggatatattccttatatattatacaagtcagagtcaataccaacaaattccatcagcctgtatataaacatgtgctatatgttgtcaatgtaaaacagcagaatgcaattgatcacagataagctagctatacagcatctaagagtatttgtttcagttgctgtttttgtttgtttgcttgcatgcttgtttgttgtttgccaatatgcttgctagtctttgtatttgttcagctacaaggtaatactaggagggggctggagagatgatggctcagcagttaatagtacttactggctgttcttgcagaggacctgggttcgattcctagcactgacattgtgactcacagcctcctgtaatttcagttccagggaatctgatgccttcttctaaccatcacgaagacaaggtacacatgtggggaacatgcaagcaaaacatattataattaaagtaaataaaaatgtttttaaaagaaaatgctatgttatttacacccctccatacacacacataccaaaaagtcatgtttcctgtgaatagtttattcctgtttgttgagtgatggactaatggcatcaaaccatgtatagtgtaataagaaaagaaaaaaatgaaaatgtatggtatatattttttttaggattatgcaagcataccacaatttcagcatatcaggagttcagggccagcattaagctacatagcaggtttgaagacagtctaggctgagaccctttctctcacacaaaagaatgcaggttgtttaataatgagactaaatcgatttaattaagtaacaccagtccttttaaagagttgtccatcgcttttacaatatgccggagctaggggtacatctcagtggtagacgccttacatatatgtacaggagcctgtgatgaacctaaacatgcagacctcttagtagtctttcagggaaattgagtttggagtgaattgagtccacttgtattagagaagttgtatagtctagagattctctaagaattgagaataaactcagaataaatatgtgtcgaaaaaaatcactcaagaaatgtgatctgttgaccacttgtgatttaatatatttgtttttccagttggtgatagaaaatgggagaactgaagacaaccactttataaaacccttgcctgcttgaatttgtggtgatggtaagttctgtattttttgtccctgactagtctgcaattttaagaaatgttacttccaaaaccacagaagttaaagaggaaacattaaaactattacatattctagggctaggtgtggttgctttgaatttaattccagctctcaggagtcagaggcaggtagatggatctctgagttcaaggcaaccctgggctacatagtgagaccttgtctaaagggggaaaagtacatattccaaagaataggacctcatgcttgtaggacctcagactatactaagaaaatggggaaaatgagagaatgtatcatgaccttctaattttgattaaagtgcctaccatttttttggctttatagatctcaaaatgcaaacaaattgccagcaaccatgcacatgcatacacacacacacacatacacacacacacatgcatgtataagtaagctagaagaggatctacttttaagaataaatataaaatgttttccatttagggaaaataaattaatatgtaagtattctgagtgtacagttggtacagaaggctatagagaaagctgtactcagtatgaatcaaatcaccattaaggtggcaggactatgtgcttatagacatatgtccataacatgtagcagtatacgtaagtatatcaaacaaaataagcatcatttatagtgattcacttactaaaaatgagaacttgaaaaatgaatatgtaattttgtcagactgctcgggaatgaggagtgaaatctatctgttgtttggtttctttatttttcctcctttttaaggtcacaaattagcttagctttgcctggtaacacttgtggccttggctggcctcaagcttgtgctattcgtcttgcttcagcctcccgagcagtaggatgaccaagctgactcaccacacctggctcaaagcctggacatttctgtgcgaaccataatgtaaaaacatgtcattttaatacaaatttctcgttatatatgaaagtagactttactgttgaaagggcctaaaggaaatactctgaaagtttatcagtgatctgaaagactgtgggagaagttggtctactgcatggttgctttcggaatctttgacttgtactgtgtggtagagcctagtaagaaaatagtttttatacttttctctacaatacagaagattgccccaaaatactgaacgatgtcagattatagaaagcagttgaaggctatttaatgacatggcaaagtgtccatgcagaaacacaggtctcacttcaaagaagataagagatgatggtcatttctgaccatgacccaggaacacaaatactcttatgttccatagttgaagtacttacctgatattttattattaaacaaagtcataaatcaaaatatttcccaaatgtattgggagaggtcacaggtatgtgagttataaccaagggaagaattctgatgtaggtttcaaaatagatatcctttagattggtgaaagctagtggtctgctaagaatatattttaaggtgttgatagtcacaaagatgtcacagacaccagatggcagtggatggctttgagagggattgaaaatagcacaaggtagttcagccttggtttacaatacctgtataaccttaaagttcagtctagtgagcctaaagttgactctgtgagcgtggtggctcatgcatttaatcccatcacttgggagacagaaacagaaagatttctgtgagttaaaggccagcctggtctacaaattgagtccaggacagccagggctggttacagtgagaaaccttgtctcaagaaaacaaaaataatagccgggcatggtggcgcacgcctttgcttttaatcccagcacttgggaggcagaggcaggtggatttctgagttcgaggccagcctggtctacaaagtgagttccaggatagccagagctatacagagaaaccctgtctcgaaaaaccaaaaaaaaaaaaaaaaaaaaaaaaaagagagaaagaaaaaagaaaaaagaaaaaaaaaagaaaagaaaaagaaaacaaaaataaataaaacaaagttcagtctcttggatttagcacagggtcagcttctgttcttccttctggtagctttatttgttcataaaagcctaagaaaacacttgagtaatctgactggcatataacacacacacacatataggaatcctaccatgtattgcctaaaatgatgagagctcttttggcatcttaaggtcttggccaaatggctgccaacaattcagcctataaagtctttttcagaatatggtgagttacttgggtgatgagaagatgaaccaaaaaaggactttacctagagaggtattcctgagctcaagttaccatatcttcccttcctcccctcccctctcctcccttcctctccccctccttcctgtcccttttctttcctttcctcttctgttttcttttcttcccttttcctccctccctccctccctccctccctccctccctttcctcctcctttttcagttttaatttttcttaggcttagatcctttatttgtcttggagctaacaacttgatgacttgggagcctacgaggggtgtgtggagctcagtgaacgagagagcagagctcggagggcaagggcctttgttgtattgttttgcttgtttcttccatagaaaatcttaggttaaggctggtctcctgcatcagctgagactgttagggactctcaacagagctctgcctggactgggactcactctgtagaccaggctggcctggaactcacaaagacctgccttcctctgcctcctgcgatcaaaggagtacccaatctaaaatttagaatattttaatatttttttaaaaatcttttcaaatctttttttttttttttttttttttttcttaatgcttgatgggcacaatgattttctgcctctggttttaggtttagaaaaacagacaagaagttttgttttttaaatgatcctgttagttgtgcttgctggtacctttttctttcttttttgcgagtgcgatgggcgggagaagaaaggcgcgcagcctgaactgtctgtctagatggagcactactgccatcgtgaggatgtaagttcaaatcccagcgcgcagttattagcgaattctcgagagcacttctggtttttccaactccattccgtaaagaagactacccggccctaacatcaaaatggcccaccgtttcccttctaagttagtctaggcgttctgagctgaagtttgatgctgacaggaaaacatttcatccagtgttgaaggcaggagctgcccgccactttccggaagctgggaggcgggactttggctgcggaagccttgagcctagagtcagctagctgcctatcacccgctgactggttcaccttttactgaagcaacattacagcttaagaaactaactgaagggctggtgagatggctcagtgggtaagagcacccgactgctcttccgaaggtccagagttcaaatcccagcaaccacatggtggctcacaaccatctgtaacaagatctgacgccctcttctggagtgtctgaagacagctatagtgtacttacatataataaataaaaataaatctttaaaaaaaaaaaaaagaaactaactgaaagtcttacccgccaccaccaactccctgttgaattaattgttttgagacagtccttcaccgagtcaaggcttccaaggaaactattaggtatcttctttatataatgaatgcaaaagaatgcaaatccctataagaaaaaaaaaaatctccggtcacactaaagtacaagagaaaaaaaaaacttaaatttttttccaaattaacttcagtgaaggaacattccttttctgtagtaaacccccatctacctttgtagctccttgtatcccctttagattacgtatgagagagaataagcgatacttttctctctcaatattatatcttgttttcagtagtggcagatggagactaagttttagagccaaccagaaacaccaccaaaaatctgaaatagatcttgatttttttcctaatgcagatatgacgagccagttaaagaccgtttttcacttcagtatgtatgacttgtgttaagagatgagtcaatgacacaaagtctgagcagctgctgtttgtgatgtatgtatgtttgagaaatttactgctcaaaatgagatactgacatggctccaaagaaagatagctgagcacgtcttctaggaatccaaagcaaataggtaccttccatttcatttactctagcccagtaaatagagaaggactatctatagcctccaatggtagcagtctccttggctagactttatcttaaaagaaataagcttttgtgggtttctccttctctccccaccccccagtttattcatttattcaatcatgtataccccagtgcgtctgaaccattaattagtaattaattaatttaaataattgagactcatctttggacagtagagctagtcaggtggctataagaagcctgttgatactgccccattgggaagacatttcccatacactcattttccccacttcttaactccttggctgtaagtccctgttagcctttgctgtcttcaggactgagcctgccttatttctcccttgttgagagatttatttatttatttatttatttatttttgagacagggtttctctgtatagccctggctgtcctggaactcgctttgtagaccaggctgggctcgaactcagaaatccttctgcctctgcctcctgagtgctggaattaaaggcgtgtgccaccacaccctgcccgagttttttatttcgagtcttccttgttttaacaatatctaattttatcaacaatagtaataagtcaagtgaggttgcttagaaatgcctacctctgtcattgatttttctgaatttctttatttcccttaggccaggcttctgaagatttgcttacaaagcagcaaacaataatttgggttgccaaagatatgaaacaaagagcagtagtatagtactaagaaatcaagggtcgtgctgagaatggtggtgattaccatagtccccagtttggcttcagacagaaataacaagtttactgtgtggcttgtccaagcagggcaaatataaagcagctgccatgtttcctgatgctcttgcttttggttagcattttcgttttcgttttcgttttttttttttttttttatagcttggaaaggcggggaaggagtagggcatttgtatgcatacctggaacgttactgccatcttgcggaagtagcttcattttgaaaaagacaaggcgattgtttcagtggtgctaatagctgtagtaatctaggcccttgagaagctgaagctggcatattttggtgagttctagactggtcaggtctgcatagtgagtcttcatctgaagaaagaagaatagggtcatgaagacgtcattcccatgttctagcagctaatcctgcttctggggagatctcagaggcttgcactcagacttggcttgcttttttttttttatgcaaatggctctggaccctgatgtattctattctctctgtggaccaagagctgtcagaagacaccggcacaggaagtgaaggggcaggatcgccactcctcccagtttgctctgaactgtgagccccactgaaagggtcagctttctttggtgctctggctcagacagcactgtcacggtgagcactccctccacctttggctggctggccaagacattcattcacagatcaaatacataactcatgcttgtaagctgccctttactgtcctgtccaccatactctgaaagaaactaagagaactccaaagcctagtattactgcaggaaagctaattcttggtccacaggacgagactcagaggaaaatatcccacaaaaacctggatttatctccaaagtcctgcaagtcttagaagagaggtattacttcatcacttcctgagtctgtgtgccctggaagctgcaggtccctgtccacaaggcctctccagctccaggatctgcacaacggaagttttaggcttcagatcataacccgggccctagtaataatgcttatgcctaaggaagtctagctaagagcagaggccagggctttccaacccctcgggcctcatctttgcatgctgctaagaatcatgggaaggaagctgctaggacgtgtgttgctttcttcaaaactctggccgcgtggtggcagtagggctccagataccacaggccgccatctttgcatcctctactcccgcccttctgtgtttgaaaaaaaaccaaactgttctctgacaggaaaaagtgctgaggaagactgccctccgttttgtgaaaatcagtggagctagttaacagcagccattttgcttttgttttcttttgcaaagcagcttaagggctaaaaccacctgctccgttcagacttttgtggtttccctaggtaaattgtcactggatttttgttcactaaagtgtgatttctttcccagagtggttcatgtccaatacattagccgttgcctttttaatgctgtaaatgatgtggacaaaggcagaaaagggaagacatttcgtaagtcagtgcacaagttaagttcccctttagttctttgtgttgaacccagatccatgagtatattaggcaggctcatttgctataactttagatcatgtgtgtatatgtgcatatatgtatatattacgtatatatttgtagttatataattttatgtagataatatataacacacactatatatacatatacaactatatgattatataattactgcatttatataaccatatgattttacatacatatttgaactgcagattgaacttggggcctcaggccttggggccttccctgaggtggggaagtgagtcctctaccacagagccatacatgaagggcattttccttttgaagcaaggcctcccagtgttgcttcgcttgcccaggaatttactctgttgatccggctgctctgaaaagtaagatccagagcctctggagtaagtggaattacaaatctttcccttgttggacaccctgctttccttttttccccctcaggcaaggtcttactttgtgagaccaactcccaagtctcccgctcctggcctatctaggctctgtctgagattagaagtttgttctatcatgcctcgcccaaatagcctatgcactgcttactctcctaggcaggaggaagtgctttgtggtttcgcattggcctgaggcatcagagaaggaggattgcagcaggcattcccacacctcagtcacttatactgctctactgagcacttaacagtgtctatccgaagtcactctgggttctgtcattttctcccatgagaattcagtacattccaatgtcatgagttatgttccatcacttactgtgatgtttattgggggaatggtgcataggagacattgtttcctaatctttggtagatagagtaccttgttgttgagaaggagtttctctgtggagccctggctgtcctagaactcactctgtagaccaggctggtctcgaattcagaaatcctcctgcctctgcctcccaagtgctgggattaaaggtgtgcaaaaccagtacctggctggtgctgtatcttgtatgatgtctcattactaagttaagaatgacactttcacagcactccgaaagacagcatgctggctgtaaagtagtgccaacatttgtttcaaagcaagtgataatcttgttgagtatgtatgtgcacatcatttcacatatacatgcatgcatatatattttatactaaaattggatgggataggtacattatagtttggatcagatcagtttatatttcacaaagacttgaggaaaatgagattacaggaatgttgtcaattttgcttatcaccatgatgttataaaagcaatgttttaaaaacgctctaaaattactttagaactatagatcgagtgaggtgcttttgtctgagctaggatctctagtactagctggcctgggaatttgcagtgatcttccttcttgggataattatcgatgtgggcaaccagagcaggcctgtgagatattttgtttatttaaccaacctgtggcttaattgctggtattgcataattcctttgtaggaaagactgacacaaagtacgcgttaatactgatgtgagaacaggtgttcagatccagtggactctgactacatgaacgggttaatcactgttggaactatatacgatgttgagagaattgaagttgacagtgaggttttgtgtgtgtgtgtgtgtgtgtgtgtgtgtgtgtgtttgtgtgtgtgtgtgaaaggctatctatgaagccctagttgcattgaactacatgaaccaggctgctcaggacccgagttcaatcagacatcaggagaaagcactggaggctgggtgctgctggatccagatgggagcaggtccagcctcctttgatatgtcattgataaaaaattcaaaatggaaggtaaattctaggagtacagcattgcaagcttctgacacagacaagggaggctagaactgcacagttagtggatactgcctcagtttgacattttttttcagtctgtgaaggcggggacagagagctgcagtcaagacaccttccctgctctggggcaacactgccatcatgggaaaatgtttcctgtagactagcacaggcacacacctcctcctccatcctgcttctcctcagccattttgaagcagggaggatgagggggattcatgaatggcgaagcttgcccgttttactatatttctctcctgtaggcagactgtcatcacaggacccttcagagtattaatgcagaccctggtgacagaggtccagtaccaagtgctcagctgtgctgaggtgcagggacaggaagcagatgggcggtttccagcccgctcagctggccatggtaatctactagctggtgtcctagggcagcaaggcgccttcctctccaggttctgaagagaaagcactgcagtcccagtttctgttggggtctgaggagaaggcaaggcagcccagctaggcacccacagctgctcctgctgtctgtaatcggccgccatcttctgccattgctaggaatcatgggaaaaaggagagtggctctgtgagttttgaaaccgtgtcctcatggtggcagtagagctccacacaagagcttgtgagtgcctctcccccgcccttcctgtctgaaaaaacgccaaggatgcatgtccaaacttttacccaactttgagtaatttaaaagttattttatttttttggtcatgtgttccatgtgaagccaatctgagacgtacttataccctaggcggtgggacttttccttcagttatgtagggtttttcccttttctcgctctatagctatggatttttaccctaatccgatatttaatggtgttaaaattttgtctgattaacttttgtaagttttaaatgataaagatatgatgggagatttagaagcaaaggactatgctgagccgtggtcctagtgaactacaagaggcaggctggcctgggcctttccaggaggcttctggtccatgttaccatgctcagcggacacgagtaggtttaaccttgtcttaagtaacatcagcaaacaaacactgggcagttgataattatatcccagcggcgatgtccatgctgcccagttttctcctctgtctgccttcatccaccatgtctaccctttgaggacaagtcactcgaagggaagtataacaggtctgaatggagaggggacagtggagaattactggtgaaaaacagtaacaaagtcctagacatcctcgatcctgggcctttgtctctagatattggttatggtatttatttttttaagattgagggtgggagagaggtagtccaggatggcctttgtgaccatatgtggtgtccttctgccatcctgcaggcagagctacagtgctgagccattaaaatctcattcccatgagtcctagcagtggggaaacaatgccaggttagatagtttgggttccacactgggacccggtgcctttcctctagagcagaagtgtgggcaccagtaatggcttcgagctgaaaagaaagacaaaggcgaacagcagagctgtagggacaagctgacacaggaagttgttggccaggcctttggttcttcctatctggggcatgacaagaagacaccacagggaaaaaatgcaggctctttgtggagaattcggtctcctgctccttgtagcatgtgtaggcaggattttaagccatgccttctttctaagacacagagactccctaattagtccacgctgttcaagcacacattatgtagctcaggctcctctcagaggtgtatgtcttagtggccaagggaaagtagaagactgaaagtataaagaaaagaacgtgtatatagttaagccatgggaaactgtaattggcctataatgtaggaatttcttatgtcgtgctccagtgtgaactattgaaaaccccattgaaaatcagtgacagatcttttggaaatcagtcattggagagacctatgtttcttcaagtaggcatgttcatagcattcagtgttgacaggtatcagcatcctctttacagagccactaagtgagcctgccacaggacacacaaggccttttgtctggggctcttgtgtggatctcacacagagcatgatacccagggaagtgtaagtgtgatctgggtaacaaggacatgacctgacgcctaggtttgcttctgttgatgcactgaggtgacagtgtgttctttttctccctagaaccggcccctgggatttgctgctcagaacctgagttcactgagacatcaggagcaagcactggaggccgggtgctgctggatcctgatgggagccatgcaggacttgaccatggcctgca

SEQ ID NO: 433 - DNA, 4523 bp, mus musculus
ggacagtgggcgggactaagggggccacctgcagacacaccctggcttcgggaccgtcttccttctcttccccctcggggcctagaggaggccacgcgcggggtctccgagctctagggtccggagctctagggtccttttatgtagcaaagtcaggcctgggaacagaacttcatgtgcttgtaaaaagtctcaggtgcgtcctcgttgttttagagacttggagaggaatgggggcggggggaacaaaatccgaggacagtcgagccaagaaaagtcggggcttctaggatgccaaccacgccaaacagatcaaaaccaggactggaggactgaagatgaagccggcaaaaagtcaccagccacggctcttgtaaggtaggtggtaaaccggagaagacatggttgtttctagaagattggaaaacgagcagaatttttaaagcagtattctaaacatttactatattttaaaagtgttaaagctacatatgaggaaaactaatgatttcatgcccaaagtacaagggaatttgccccttaaaataaaaacctatatattacacatgcaaagtgaagttacgagaatgtgtggcaagggcggttttggtttggtttgtcttgcttctcagattagtttgtttttactttgtaatttctcaaaattggaatactttgccagaagtgggaaaactttgacaatttcttgggatagaaagggcttctggatgcagacataataatgatgccaagcacttagaaatctgcagtgattgccaggggagcaaatggtctgtgccgagcactttctgcgctgccgtaccctgcgtgcatcgggttatatttcagaagacgcaagcttgagtgcgtgcttatacgatcctttccttgtagacattgctaaaggtttagactttgaatcctggtcagtgttaaagccggcttgactgtactattcaacgtgaacatctcagccaaggctgtgtattcatagctatgttgtatttatatttttatacaaccatcactgcagtacaaagggtgtgactgcacctgctggccccttttctttgaatatccatctgtgtgactgaattttggaaatatctattccttttttaaaaactgccttagagatcaaaacttgagcaagtacagcgactacttatagcttttttttcttcctttattgaaatatgcttaaaaaagaaatatgcttaacacatgaaaaatcgggtgtatttggtgcatacaacacatttatttttcctcaaacgataagcacaatcaagtatcacaagttacatgtttgaaatttactgtgctgacaatattcaagagaaatgctaatggcaaacttcattaaattctgtatgttgtacaggttattttttaaagatttatttgcttgttttacgtaagtatactgtggctgtcttcagacacaccagaagagggcccggattccattacagatggttgtgagtcaccatgtggttgttgggaattgaactcgggacctctggaagagcagtccatgctcttaaccactgagccatctctctctctcctgcccgtcttacagtttttaaagacatttttcgagatggaaatttgtagcaaattctgcaaagtgtacagctagaattcctaaggccacacacaccccttaagacagggtttctctgtgtatccctctagctgtcctggaactagctctgtagatcaggctggcctcaagctcagagattcccttgcctctaggatcaaaggcgtgcacccccaccacctggctgagttcctaagtttcttaagctttattgtgtggacctgtttcgttattatgtggcaatttaggtaaggaaggacttgataataaattccttaaatgataatattatagatactttatattgctgtatagagttttaaatattaagggagaagctagtgttctttaatgaacagggtcaatatagaaactctttggaaatttcttatttatctaaaatccagtcctttgaaatatttcaggatattttaatctacccagaaatcagaagtacaggtttggaatttaaaatggtgtgtgtgtgtgtgtgtgtaaatctgactttattattgatttgttgcaatttactggccataagtacgaaactatatgtgtgtactcaaaagaaaattggaataaatttgcaaagaattatcagtgcttgatccaagactttatgacattgcttttgtttctgatcaagatagggcggctttctaaatcctttgcaagcactgtattttagggaagaacactgtaagacttactataataaaaacataggaagcactcgttaatgattcatgtgtgaagaaaatgtggttgtgctctgtcaaatgaacctatgagacatattcaagtcccatttgactggaatttttagtcactccaggagagacttaataatacggagttgggatgtggcctttcctgggtcctccatttagagtcccagccacgttgcctcctactgaacacagaaggccaaatacctcggtgagaaaatggaggattccctaggaatctgatcctgagacctaagtcacctgataaggagcctaaatttgcatttccctgggagctaaattccagagtctttgttttcttcagagggactgctctccgaagcacacgattagggtaagagtagggaaatcttggctgaatgaagggcaggtttgttgcgccttgctagagtacagatggaattcttgaagaccattcatagctaaataaactgggtgctacatgcctgtatgatgtcccccaccagaacaaacggggtggcacctttctttctgcaatctcttctcacaagtttttttttttctttcaaccaaagagtaggaagtagaaggggctgattaatcacgtttcccagaataatactatcacccagagggaggtgttttccagtaccctgtggtgagagtgtgtctaacagttaagaaaggttggctctttggttaagtgggtctaggccctgaaacagaccaccttcaacttcaaagaaggagcttgagacaaagatgggatccaagggaagaaactaaagaggaattgacagggtggttttgtgactgaggacagctgcctgataggccagttattgcaggtcctgtagctcagagtcagtgaaatcaggcaaaaaccaaagcactcgaggagctttgtggggaggtgctgggcatttgttttctggctctgcttcttgaccaaggtgcaggagctgaacaaacctgcccttcattcagccaagagtccctactcttaccctagtcatttgcttctgtgagccatctccgcctaagaaaacaaagaggactctggaatttagctccggggaaatgccaatttaggcaccatatcaggtgacttaggtctcaggatcagattcccagggaatcctccattttctcaccagggtatttggagtctcaaaagacactcagaattgatgctccattgccaagatggaggagagcctaaagagaagaggtaaccttttccaggcctaagagataacagctacagtggcagtgaaggttttccccacggtctagtggaaggcctgctctagactagtgtagctctcaaccttcctaatgctgtgaccctttaatatagttctcatgctgtgctggcccccaacatagtaacatcttcattgctacttcataactgtaatcctactactgttatgagctgtaatgtaactatctgctttctggtggtcttaggtgacccctgtgaaaggattatttgacccccctcccccaaggggtcacgacatactggctgagaaccactgctctagaaggacatgctcttacctcagttttcatgaggtgagactttgcctattaaaactggaagtcagtctagtaataaaagtgaaacttatgctacttgagacctaacccttgattcatgttagttagcaggtgttattcaactgcctgcttcttagcagctttcaaatggagattccctataggccttctaggatatcctcttaagagagttttaagcacaccaggaaccctaggactcttggtgtcagcatagtaagaaatattgattatttcatagtcactgtacatgaacatttcccccttgtaatggtggtgttggtagctgagcactcacaagagaggaaggaacgctagtctgctgtactgccgtaaggaacgctagtctgctgtattgttgtaaggaacgctagtctgctgtattgtcgtaatgcttgctcactacttgaactcctttacccaggtatgcttcacctctcctgctaagtcttcatccctgtctatgaggacaaagaagttacgggttaaattggcgatgggccaggcgctccttgaggatgctctaaaggtaagccatggaatgaatggagacatttgaaacagcttgtttccaaggtcttgagtagtatgtgacagtaacccatgccttcttcggctga

SEQ ID NO: 434 - DNA, 293 bp, mus musculus; identical to SEQ ID NO: 39

SEQ ID NO: 435 - DNA, 375 bp, mus musculus; identical to SEQ ID NO: 40

SEQ ID NO: 436 - DNA, 47714 bp, mus musculus
tcaccaatgaggagtaagtatctagggtagggagggtctctaattaaagagaagatgagagtaaatattatccctgtcaatcttcttagccacaaccaatctagatccgtgggggtctgcctataaaaggaggctcaccggggtgcccagcctccattttgtctcagcttttggagtgtacagtgctagacactttacactctggtaaacaggacagcaaggagacaaaaaggtaaagacggttcgggagtggtaaaggggagcttcgactgggagggtccacattgactggtagttttgaacaggggtgtgaaccagagtgaggaccggaccagctcagaccagcgcagacaggaccagaccggaagtaccacagacggcgcagcagcggcagctgtggcctcgaccgggaactttagcggtaagcatgtatggggagtgcttttttttaggagcctagacaggttgtgtggactgatggagagccttgactgggagagacagggagccgcagcttctcgaagctgtcttaagatttgttttgaagccgggcgttggtggcgcacgcttattaatcccagcacttggggggaggcagaggcaggcggatttctgagttcgacaccagcctggtctacaaagtgagttccaggacagccagggctactcagagaaaccctgtctcgaaagaaaaaaaaaaaaaagatttgttttgagttttttaatttcatacacaaactatatgtaatatatagttcttaattacatgtagtatgctctgtatcaatatatacagactaatatacttccataatggtacaaatttatgtaggggaacagtaatgtgtatacatacacacacatacacattacctaagagtctatatgtgagaaaatataatgaagcccacttattaaaatggttttaaaaatagctaggttgaactcttagtggttaaagtgggaatatgtgaaatcccagcactccggaggtgggcacaagtatggagcaatgtctctggttaagagcaccaagtgctcttcagttcccagcaccgacagacaaggtggttaacgggctggaatgtcagtctcaagggatctgttgccctcttctggcttctttgggtactgaatgcatagcatataacaggcatatatgcaggtaaaacatccatacatgtaaaatcaaagaaatatatttttaaacaatgaggtccgtaagccttataaggttagagtttgctttggggctcaactaagttacattctcatcttaaaacctgattttcttgattttatttggttaattattgcttttggaaactcttgtgtatggttttatagtttggtggtgttttcaaaagtgaggaaattcagtgatatatttatattcctagttactaaggaagagtatatgcagaggctaaactgggaacagtgtgatagcacaagtttgagcataacctgacttcaatagccaggcatctcaaaaaacagggagggggagatagagaaccagggttagaaatagcacagtggcttctataagtgtgatatatttcttattccacattttcagatggttttttaattgtgtgcttgtttaaatcttaaattgtttctgttattttctgaccaggaaaaaaaaatcatatcctaagtgattgaatctataacttagctgatagctacttgtctttctgtgaatttttcaggccccccctcatttgttaatgttatttgtatggttaaattttgccatcagtcttcttatacggtaatttaaaaagaaaagtttctggtttatgggtttttttgagtggtagcatcctatagttcaattgtatgtctagtcagttagttgtttaaattgaaaagtgtgagtcatttacgtgagtatggaaattatatttttgttgtttatatgatgtgtgtgttcatgtgtgtgtatgtgtgcatgtgcacatgtgtgacacagagcatgcatggaaatcaggataatttgcagggttcacctaacatcccctgaaattaagttcaatggaaattgaacttaggttgataagtttgcagggcaagtgcttttactgtctggtaaaagctatctcaatgtctcagaaagcaaatgtgtgaacatttaatagtttgggtcagtagaatgcacttggaagttgtgttttgtaatgggtctttttgcttggttagtttttagctttctgtttatttgagaacagggtttcatgaaggcttatctgcccctaacctcactgtgtagctgaggctggccttgaattccctattctgcttctgcatcttagctgctggaattttaggtatgtactacctctcccagccttttctgtgtgatgttaaagttagatattttatagtaaagttgtatagaaatttagaaattctgatgaaatgcccacaagggtcttgatgaaatagacttgacataaccctgctagaaaaataatgggcattcattgctcactatacaatatttaatcatttctttttgatcaattcaatatgaattatagttcatttagaagggagtgttaaaattttgaatagtaattttgattcggtagtcagcaataggacggtgctgcttaccttatgttatctttttctctgcatgcctgcctcctgcctcccaatccattttcagttcttctgagcaagaacacctgtgttccagccagggagtgctttactgcctcctcacaggtaaatgttctcaccgagttctgcagaacctcctttagagaatcatgcaaaactacttttatgacctgcttatagttgtttaaaatgaaatgaagaaggtggcatgggtacccattttaaaaatgacttagagaaattcagagcatatgtatgctgtgagatgtgatagatattttatagaggaccagccattccctcccctgtgttatcactaaaatagatattcaaactctttccctgagtctctagagctccaaactacaaacagcgatagagtcacttctggggagttgctgacctaagttagagacattatttctacaacttatcccctcccaaatttattttttgtttatgtgcttgggcacatatatggaggtcagaagagtagttagatcccatggaactggagttccaggtggctgtgagccccacctgatgtgagtgctgggaactaaattctggtcctctctaagaacagtatttactgtgaactgcaggctgccctctagtcccacaacttcttccccagaggcatccttttccagctgctgcttcctgtctttcgtgctgtggctgtgactgagaaacattaacattcctatgctcttctcatatcacaagaatgaagtctgagctttaagttatttttttttttttaattttagaaaatctagttgacggtggaagaattacctggagtggactgcaaaaaaaaaaaaaaaaaaaaaaaacagaactgcaagagtcaagagagtgttggtgtgttcaggtaccttttatggatataacagtgtgatttttgaagagaatgtgaaagccagctctttctgagatggtagtgggtaggaatataagacctatgcaacaaatgggtgatagtaaatgtgggagcttatgggcttatcccactcatagcatatatttggtacagaggtccagaaaacatgcatacgccatataagtaacaaataggccacttctgcaaaccttgacccttccatatcttttcaaaatgttgctgagactccttttttcctctttatttttttatttattattttctttatatacatttcaaatgctatccggaaagttccgtataccctccccccgccctgctcccctacccacccactcccacttcttggccctggtgttcccctgtactggggcatatagagttgttgctgagactcttaaggcattctgggagtcgaaaactcacttagcttattttcactataggtttttgaatagtctgtctactcagctggtttctaacatacatttctatattttaaactcctgtttaaattgtgaatgaatttgggcatcagaatctgggaaggatttgtgttctacttgctaaggcaccttgacacctgtgtctcccatttcatgtaaaatggatggatgaatggatttgattaagttgggtgtgacaaaaagaatcaatttcaagtgaacttcactgaatgtttgctctatataatatgcattctttcttgttactctttaggccagagtctctgttctatacagcagcaaatcctaggacttgattggtaagcacattgtatttgttgtattttaactcagattattgtctgagtttttccccaggtgtatagaggtcctgtacctgaacttgagtttatctttactgttagttttctggctaagaatataacttcatcaagattcctttttaaaattttatttgatatttatgcatggttttcctatatatgtatatatatgtgccatatatatgcctagtgcctgcatctgatcacttagaaatgaagatacaaatggttgtaaactaccatgtgagtgctaagaaccgaatctgggtcctttggaagaagaacaagctcttaactgttgaaggatctcccggagacccaggatttttttttcttttttttaattaggtattttctttatttacatttcaaatgttatcccctttcctggtttcccttccaaaaaccccctccccctcctcctctccccttcccctggtccccaacccaccgactcccacatcctggccctggcattcccctacactggggcatagagccttcacaggacctctcctcccattgatgtccaactaggccactgggatttctttctaatgtgttatagaattgcctgtcaatttaagattgaagcattcagtatattagaataccaaatttcagactagagatacttctaaagaaagattatattttagaatgggggaaaaacaagtcaaacaaacccctaaatatttaaaatagaaactaaaacttttatacagcatactgacatttcaaagctgatttatcctgaaattagttactctaaagctctagaaagtagaggtcattgttacttctcttcaagcagtaggccgaggccagaagtatttagagaaagcgttatctagaatcagctagtggagcttgccagccttgggcctacctgaagtggtatgatgtagatccggaattcttcccggtggtagtttccttttgaatggaattctacctactgcacagtaatattcaatctcttcatttgggagtttttggaggaaaacctaaaagtactttagtgtgtacttttgttaagtgttagcttcacattctaaagtagttatgaggctgaagaatatgaattggaaaatctctacttgggtggatagccttagaatttggacactgtaggaatagtgaaaataaccttatttggaactcaggctaaagtgtggcttctaggtaccaaggcagttcagatgtttcccttctaccttaactgtgatccactttgatatccaggtattttacgttttaatgtgctaatccatggtgtggttttactctcttaaacctttacttagattaaatgtgttttcatgctgcttattttatatgagtaccagagagagtttagattgcaaaggtcattttaggttaagcttatgggataatggctgttttatggaggaaaggggctttttgcatagtacttcatgaaaaggcactatttacacagaaggttttttttatattttttaaattaggtattttactcatttacatttccaatgctatcccaaaagtccccataccctcctccccactcctctacccacccactcccactttttggccctggcgttcccctgtactggggcatataaagtttgcaagtccaatgggcctctctttccagtgatggccgactaggccatcttttttttttttttttttttaattaggtatttaactcatttacatttccaatgctataccaaaagtcccccatatccacccacccccactcccctgcccacccactccccctttttggccctggaattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgggtcctttcagcaaaatcttgctagtctatgcaatggtgtcagtgtttggaggctgattatgggatggatccccggatatggcagtctctagatggtccatccttttgtctcagctccaaactttgtctctgtaactccttccatgggtgttttgttcccaattctaagaaggggcaaagtgtctacactttggtcttcgttcttcttgagtttcattacacagaagttaatataggctcaatgttgacttccaaattattattgcaatatgtgcttataaggaaagtctagagactacaaaaagtggtgtttaaaaacaattggttttccacaggaaaagaaaaatcaggtatgtgggatttttccagtttctcagatgtaaatgctttcacatggagtagttttaaacaattataatgacataggtgaatacaaatttaggagaagatacacaattagttcatctgggtaagttctaagcagcattgagtagatctaaaattactcactgtccaggtatctagtcaggacccctctgaacattttaatgttactccaactaatgtttttgtgaaaatatccatattaattctgagaagatatctttatataaagtgtcattctcattcaagtgtcttcatttcttatttctaaactttaatattctatatgtagggaaaggtataggaactaattcaatttaaagaatgtattttgttaaaccagataatctagacagctttgtaatgtgtggaattgtaaaagctgtgtaggtcatgcagatgtatgtgccgtttcagtaacagcatgtgtagaagcagtaaaaatgatctacatagtaactttggcacttggtgaagcttgatgcagtcactgaaggtcctatgaaaacatgtgaaaagaattctcttttgtccagttcatagtaaggtttagtgttcgaattggactatggggatttattgcctcttatgttagggacaggcctacttgaggatccaaaaggaactgtggaacatataattttaaaagctgtgcccgaggcctagaaggagctgatgaggttgtcccatcagggctaagtctgccagattcttgaggttgtacaagtgaaatagggaaatccagatagccacaagtgccccccataaaccccatgcagacttcctaaaaacttgagacttgcgaggttttgtgtgtgtgtgtgtgtgggggggtctttcatagttagcatagaggctttgctccccttactctggtcttgatagctgggcaagaacttcactagacaatgaagggcaaaaaataaccactgataacaccaaaggggaaagtggcaggagtttcaattcacaaggagtatagggagcctgctactcagggattttttttcttacccaaatttggtctctttcaacagctctccattcactgtttctacctgtgctgagtgcctgtcctaagattctgatagaggtaagactgagagatacacacagttttttaattataaagcagaacagttacaggtaaagatttgaaagcttctgtgaatatttattaaaataatctaaagtctagattgtaagaggtacttgtataataaacatatccataacaaagctgcatttttttacttaaaaccatgcaggctatgaagatatctcatggaaatcccatttcggtgagatcaagttttctcagggttcctacataagcatctccatagatccgtggttaatattaatgcagatcatttgaattaatcaatctaattcctccaaatgttttgtcttaggagtttggttttggcttatcctatttattcttcctggaatttcagtcatccctaacatgctgattgaagggattggtatcagcttaggacccccaagaccatttctcagcacaaaggggatttatttgccccatagggacaaagggcagggaatatcaacaaagacaggagacagaagatgagggagaaggggaagggaacaaagagggaaggaagaagtatttgtcctaagagtagggacagtaacaaaagactgcttttggatagaggagatgtggcacagtaaaattgcagttaaaaaggtgaaaggggaaatcccatgttaaaatgaggtgtttagttttagttttggcacgttaatttggtgagccaaaggaggggtttgattgttggacttcaatacctggatcttggtagtcagcctcaggaggaggaagtggccaaataagggaatagatcttgggggctagctttagtaatgtacttcaacaatttttagccaagctgaggttataggggagaagggaaaggcccgtcagaggcatatttgccatgcttaggcttgatacctatccatcctttaactcattggagtgtgttgtgttaattgtttattgttgtataactcttataatcatgaaatgggaaaacttatatggtataaggataggtaagaattaggtttgtacaaagacataaaagatgagaatttaaatgaaggcagtgagcttgaacatgttttataaaatccagagagatggcatcttgagctttgaccccagtgccttcagagcacaggacccagtcactaggtaacttcaagtggagattttgtagcttaggatctggaaggggaagagaaggtaaattggggacaaagtggggatattagttatctgtttttgaaactgcagggtttgttgtccctttttgtagccacttggtatctggggttagagtgagctgcctgctgacagcttagacaagtgaagacttttttatttttgctggggggagagatacaaataattactgaagcctttaaaacacaaatttacctaaaccgagtcatgtcctaaaaacaactctgggagtcagcaagggaagtagctatgtcaattcctccctgccaccaagataatagtgccagttaagggccttctccctctccctctccctctccctctccctctccctctccctctccctttccctctccctctccctctccctctccctctccctctctccctgttcctccctccctccttccctctccctctctctctcttcctccttcactccttccctctcttttctttctttcttcctttccttctttctttctttctttttttttaaagatttatttatttattatatgtaagtacattgtagctgtcttcagacacaccagaagagggagtcagatcttgttacggatggttgtgagccaccatgtggttgctgggatttgaactctggacctttggaagagcagtcgggtgctcttacccaatgagccatctcaccagccctcccttccttccttccttccttccttccttccttccttccttccttccttcctttctttctttctttctttctttctttctttctttctctctctctctctttttctctctctctctctctctctctctctctttctttctttctttctttctttctttctctttttgattagtcctggtttaacattcattggttgaaattactctaatacaacagtttcttgaaccaaaaaggatgtcaaatacccaataatccaacataaaattccagtagcttgatttatgtctcctcactagtatctaactacgtataaataacagtgagctctagctcactgccttcatttaaattctcatcttttatttctttgtacaaacctaattcttacctatccttacactatataagttctcccattttatgattataacaatgaacaagtaaataatcttgtaagctctaaagaaaaagctcatcataattaacatagatatgtgaatttgtgttgatcttgacatttaaaaaaattatttatttacattgtagacattgccccccttccatccccctcacacagtttttcatcccattcctgctcccctttgcctctgagagggtgccctccctccaccatcccccatccccagacatccccttttcctgggccctcaagtctctctgcatcctctcaaactgaggtcagacaaggcagtcctctgccacatatggcttagttcctgggagctctcaggtctgggttagttgagactgtcggtcttcctatggggttgccatccccttcagctcctttagtcctgcccctaactcttccataggggtccctgacttctgtccaacggttggatgtatctgtgtctgtcttggttagctgctggtagggcctctcaggacagccatattaggctgcagtatgtaagcacaacatagcagtaatagtgtcaggccttgatgtccccttcccattggatggatcccaagttgggcaggtcactggatggactttccttcagtctctgctccatttttgttcctgcagttcttttagacaggaacaattttgggtcagaaattttgacggtgggttggtaactctgtccctctacttggagccctgtctatctactggaggtgggctcttcaggtttcctctccccactgctaggcattttggttagggtcacctccattgagttctgggagcctctcatatcccagatctctaggacttcctagagagttccccaactctccacccccagaagtgcatgtttccattcattctcctgtcccctgggcttctctcctgttttactccccatacctaaccatgcccctcatttcccctcccctcccccacccagttctatcatccctctacctcctgtgattattttgttccctcttctaagtgggatggaagtatcctcacttgagccttctttcttgttaaacttgttatggtctgtgggttgtatcctaggtattctgtactttttggctaatacccttctgcaagacccaaatagctagcttcctagaaatttgaccttagcttaggacgttggcttttggtgaaagaatcctttataaagttcatcaaggtctgtacagatctttattattattattatcatcatatattttctttatttacatttcaaatgctatcccgaaagtcccctatactctttcccccaccctgctcccctacccacccactcttgcttcctggccctggcgttctcctgtactggagcatataaagtttgcaagaccaaggggcctctcttcccaatgatggccgactaggccatcttctgctacatatgcagctagagacacaagctctgggggtactcgatagttcatattgttgttccacctatagggttgcagaccctttcagctccttgggtactttctctagctcctatattgggggccctgtgttccatccaatagctgactgtgagcacccacttctgtatttgccaggcactggcatagcctcacttgagacagctatatcagggtcctttcagcaaaatcttgctggcatatgcaatagtgttgcacagatcttttaaaaagtacattgcacctttgtatgtttatgtttgaaccgttcattgtttttagcatattctttttgcagcatactctgaaaaataaagaaaagaagcctacttcaaagataaatgtgtattcctataaagatgcactgtctaatgtttagaaatgaacactcatgttttcttttatataaaatgctttacatcaccagttaggaccacattcaggggtttcccagtactcttccctaatccctattagtcctcattctcacccccttaagactgacaaggtccttgtagatcagttcccacactgtgagaagagaaatggaaattttgggaacaaaggtgacacattgtgattgaattgacagtggtcttatctcctgctagttatcatgattttcattctgccattcatattttcttctccagagaatgaaacttaagaatagtctaacaaagacaggaaagtaaaagttgagtatgagatgacagaatggaaagaatcatagtgactttattattatttcatagtcaacaggtcaagaatctgcccacaacttacatcagaactaggacagtgtttggggaacaatgttatggattaggtgtctaatgctttcatttcttaggctagttggtatgtgctgcattggctatttatctgttaaacatatgtctagaattaaaagtcttgtagccctctaagtggctgttttcagagatgggtcagggttaggcttgaggtataagaggtagagagtggagtcatgtgagtatgcatagttgaatctagtttgggtttagccatctagaaatttctgggtgcatttattagtcacattttataatcatgtaatcagaaggtatagaagagtaaccactactcttgggctggatctggacctactgtttttatatcaacactctggagtgttaatattaggcatagatacaaaacaaggctctcaaacaaatttcctgtagagtttggggactgattgtctgagacaggaaagaaatttaaccattagatgttattagaggaaagtacattatttttaaggattccatgaagaaggtttggatggacatgttattttattaactcacaaataagcatttgttctagtatatttatagaacagtttgtgggcctttagtaactcgttatttagcctatatagtataaggagagtgaattgtaaaatcagtgttaactttgtgaatggactatcatatttctacttaaaaatcatttcccatcttagatttttgactaaaagctgtaattagtttaaatattattatacactgattgctatactgcttgcaataaaataacacccttgctaattacaacttctttggagtctttccatttgaatttttaattctagttttgaaagaattctgtgaaaatcaacaacgtaaatgtttaaagttatctttccaaaggatttattcacaatcattttgtaaagcaatgtgcgaatacttataaaccaagtaggctgtttattctaattgtccaattcaggcccatttgtgttcatggactcgtcaacatgctgtgagagggaatcttttcgagaagatatgaggttaaccagatgtgcctggaaggttccttcattttttttttttggaatatttatttatttcatttatatgagtacactgtagctgtcttcagaaacaccagagagggcatcagatccctttacagatggttgtgagccaccatgtggttgctgagaattgtgctcaggacctctgaaagaacagtcagtgctcttaactgctgagccatctctccagcccagttccttcaaatttttttctttttccaattttttattaggtattttcttcatttacatttcaaatgctatcctgaaagtcccccatgccctcccctccccgctcccctacccacccattcccaattcttggccctggtgttccactgtactggggcatataaagtttgcaagacgcgggggtctctcttcccaatgatggcagactaggccatcttctcctacatatacggctagagacacaagctctagggtactggttagttcatattgttgtttcacctataggattgcagacccctttagctccttgggtactttctctagctcctccattggggccctgtgttccatccaatagctgactgtgagcatctacttttgtatttgccaggcactggcatagcctcacaggagacagctatatcagggtcctttcagcaaaatcttgctggcatatgcaatagtgtctgcgtttggtggctgattatgggatggatccccaggtgtggcagtctctggatggtccattctttcacctcagctccaaactttgtctctgtaactccttccatgagtgttttgttctgaattctaagaagggacaatctatccacattttggtcttcgttcttgattttcaagttttttgaaaattgtatcctaggtattctaactttttgggttaatatccacttatcagtgagtacatatcaagggagttcttttgtgactgggttacctcactcaggatgataccctccagatccatccatttgcctaggaatttcatgaattcattgtttttaatagctgagtcgtactccattgtatacatgtaccacattttctgtatccattcctctgttgagtgacatctaagttctttccagcttctggttattataaataaggctgctatgaatatagtggagcatgtgtccttattaccagttggaacatcttctggatatatgcccaggaatgttattgtgggatcctctggtaggactatgtccaattttctgaggaaccaccagactgatttctagagtggttatacaagcttgcaatcccaccaacaatggaggagtgttcctctttctccatatcctcggcagcatctgttgtcacctgaatttttgatcttagccattctgactggtgtgaggttgaatctcagggttgttttgatttgcatttccctgatgattaaggatgttgaacatcttttcaggtgattctcagccattcgatattcctcagttgagaattctttgtttatctctgtgcaccattttttaatggggttatttgactttctggagtccaccttcttgagttctttatacatattggatattagtcccctatctgatttaggattggtaaagatccttttccaatctgttggtggcctttttgtcttattgacagtgtcttttgtcttacagaagctttgcaattttatgaggtcccatttgtcgattctcgatcttacagcacaaaccattgctgttctattcaggaatttttcctctgtgcccatatcttcgaggttttccccccactttctcctctataaatttcagtgtctctggttttatgtggagttccttgatccacttagatttgaccttagtacaaggagataagattggatcaatttgcattcttctacatgataaccaccagttgtgccagcaccatttgttgaaaatgctgtcctctttccactggatggttttagctcccttgtcaaagatcaagtgaccataggtgtgtgggttcatttctgggacttcaattctattccatttatctacctgtctgtcactgtaccagtaccatgcagtttttaatcacaattgctctatagtatagtttaaggtcagcattggtgattccaccaaaggttcttttattgttgggtatagtttttgctatcctaggttttttgttattccagatgaatttgtaaattgccctttctaattcattgaagaattgagttggaattttgatggggattgcattgaatctgtagattgctttcggcaagatagccatttttactatattgatcctgccaatccatgagcatgggagatctttccatcttctgagatcttctttgatttctttcttcagagactcgaagttcttatcatacaggtctatcacttccttagttagagtcataccaaggtattttatattatttgtgactattgtgaagggtgttgtttccctagtttctttctcatcctgtttatcctttgtgtagagaaaggctattgatttgtttgagttaattttatatctagctacttcacttaagctgtttatgaggtttaagagttctctcctgaggaataccgaatggcagagaaacacctgaaaaaatgttcaacatccttaatcaccagggaaatgcaaatcaaaacaacactgacattccatctcactccagtcagaatggctaagatcaaaaactcaggtgacagcagatgctggcgaggatgtggagaaagaggaacactcctccattgttggtgggagtgcaggcttgtacaatcactctggaaatcagtctggtggttcctcagaaaattggacatagtactaccggaggatcccacaatacctctcctaggcatatatccagaagatgtcccaaccggtaagaaggacacatgctccactatgttcatagcagccttatttataatagccagaagctggaaagaacccagatgcccttcaacagaggaatggatacagaaaatgtggtacatttacacaatggaatactactcagctattaaaagtgaatttatgaaattcctaggcaaatggatggacctggagggtatcatcctgagtgaagtaacccaatcacaaaggaactcgcacaatatgtactcactgataagtggataatagcccagaaacttaggatacccaagatataagatacaacttgccaaacgcatgaaattcaagaagaacgaagaccactttaaagtgtggacactttaccctttcttagaaatgggaacaaaacacccaaagaaggagttacagagacaaaatttggagctgtgacgaaaggatggaccatctagtgactgccatatgcagggatccatcccataatcagcttccaaatgctgacaccattgcatacactagcaagatttcgctgaaaggacccagttatagctctctcttgtgagactatgccggggcctagcaaacacagaagtggatgatcacagacagctattggatgggtcacacggcccctaatggaggagctagagaaattacccaaggagctatagggaaatgcaaccctataggtggaacaacaatatgaactaaccagtaccccggagctcttgactctagctgcatatgtatcaaaagatggcctagtcggccatcactggaaagagaggcccattggacttgcaaactttatatgccccagtacaggggaacaccagggtcaaaaagggggagtgggtgggtaggggattggggggggtgggtatgggggacctttgggatagcattgaaaatgtaaatgaggaaaatacctaattaaaaaaaaaagagttctctggtgtaatttttaatttttagggttacttatatatactatcatatcatctgcaaacagtgatatgttgacttttttttttttttggttttttggttttttggttttttctgagactgggtttttctctgaagccctggttgtcctggaactcagtctgtagaacaggctagcctagaatcagaaattcacctgcctctgcctcccaagtgctgggattaaaggcgtgtgccatcacgcctgcttgacttctttcactctgaggtagtgtcttgtctgtttccctgagatgggtttcctgtaaacagcaaaatattgggtcctgtttatgtagccagtctgttagtttatgtctttttattggagaatcgagtccattgatattagagatattaaggaaaagtaattcttgcttcctgttatttttgttgttagagtttagattctgttcttgtggctgtcttgttttaggtttattgaaggattactttcttgctttttctagtgcatagtttccatccttgtattggtgttttccccttgtcatcctttgaagggctggattcgtggaaagatattgtgtgaatttagttttgtcatggaatactttggtttctccatctatggtaattgaaaatttggctgggcatagtagcctgggctggcatttgtgttctcttagtgtctgtataacatctgtccaggctcttctggctttcatagtctctggtgaaaagtctggtgtaattctgataggcttgcctttatatgttacttgacctttttcccttactgcttttaatattctgtcttcatttagtgcatttgttgttctgattattatgtgtcgggaggaatttcttttctggtccagtctatttggagttctttaggcttcttgtttgttcatgggcatctctttatttaggtatggaaagttttcttctataattttgttgaagatttttactggccctttaagttgaaaatcttcattctcatttactcctattatctgtgggtttggtcttttcattgtgttctggatttattttctttgattgttgtgtgatgttccctatggaatcttctgcacctgagattctctcttctgtctcttgtattctgttgctgatgctcgtatctatggttcctgatttctttcctaggttttctgtctccagagttttctccctttgtgttttctttattgtttctacttccatttttagatcctggatggttttgttcaatttcatcacctgtttggtagtgttttcctgtaactctctaagaaatttttgtgtttcctccttaaaggcttctagctgtttacctgtgttttcctgtatttccttcttaaagtcctccttcatcatcatgagaagtgactttagaaccatgtcttgctttttagtgtgatggtgtatccaggacttgctatggtgggagagtttggttctgatgatgccaagtaaccttggtttctgttgcttctgttctttttttttttgttgttttgttttgtttttgttttgttttgttttgtttttgttttgttttgttttgttttttgggttttttttttttttgagacagggtttctctgtatagccatggctgtcctggaactcactctgtagaccaggctggcctcgaactctgaaatccatctgcctctgcttgcctcctgccatctgattatctgaagtacttgttgccctcactatatctgattggaacctgtccttcctataatcccagttgattcaggactcctcagagtccagctttctctgtgatcctttgattttgggctcctgtgaacctgagattctgggtatgtcagagttcttggcagtcaagttcccctgagaccctgaaatactgatgtgacctagctcttgttatcctgggatcttgttgttctaagatcctaggcctgttacagtgcctagaagtggtgtctcctttgaggatcgtggagctgtctgatcagtggtcctaagattgcatggagagtcctctagggaccttgggggtctccaccgactctgcatacaaggtgatctggtgctggcgccgaccagaagggacttgtgccctggtcaggccggttttctgcttcctaattctgtctcaggtcccgagtgattggattggaacagaagttgtgttccactcaccagtggtcctaagatcatgtagagagtcctctagggaccgtgggtgactctgcacaaggtgacccgtcacgttccttcaaatttttcacatgtaatttggtaaaaaatggtacataggacaaaaactttctagaaattatacttaaagcctccctcccatagttagatctgataaaattgagagttactggtttcttttcttttctttttcaatcttctctaaaagaagagaaacaggaaggatggtttcacagttaagagcatataatagtcttgcagaggacccaagattggtgcccagcatccatgttaagtggattacaatcatctgtatcttcagttccagaaatatctgatgtatctttcctctgtaggctcttgaacatctatgggtattccattagaaataataaatatttttctttaagctaattctttttatttttgagattctattttaattacactatttttatccccctttcaaattcatggcctctttaaatttaatacaatttttttaaggtctgttaagacccgaagttccaaagaacagaacttgaacttcacatgtgttagtagtaaaagctatttccctattaggtcacttgtatcctgctctccctccctctttcctctactttcacttccttctgtcttacttcccctccctgttctcattctccaagtcagattactttcaaagttgtatttgcttttctattgcataccctgaacatagccccattttactttcctggtttctgtagttactacaggctatgtcctctaagctaaagatttggagctaggagcctttaataagagagaacacacatttttctttctgggtctgggttacttcattgaatttttttagttccatatatttacctataatctaatgatttcatttttatttacaatagatattattccatagtgtggttgtgccacatcttcattacccgcttgtcagttgaggacatttcggttgttcccatttgctgcctcttgtgattagagctgagggagcgcgtatggaggaacatgtcaagttcctttgcgaacatgccagggaatatctgggtcatatgagagactttcagctttttagggatttcccatgctgacttttaaagtatctgaatctgtctgtaattctaccagcagtgagtgagtgagggtttccttttcccagcatccttgccagtatttgttgttacctgttttgtttatctttgctgtcctgatggggcaaaatgaaatctcaaaagttgtcttgatttgcatttctataattgttaggggcaatgaatgtttttgatatattgaccatttttaattatttggagaacaattcaagtctcagaccatttcatttatttattttctttttgttttctagttctgtatatattacatatattaatcctatgtcagatgtataccagtagtagtagttttgtttgttttttgctgttttactaagcagactggtaactttgaggccgttaattctgactcaggtctagttataacacaagataaaagtgttcatgcttttgtttttttgtttttgtttttttctgagatggagttgcactgtattacctagtctgatctccactttctgaccccaagtaatccacccatgacatcccattatgaactgcaattgcatacacttccaacttacccagttaaaatttgagtattctagtaacacaacctcaaaagacccttctattcttcaagtcatgttctaagcaatgaagatgctacacaggtcagacagataataaggtagattggtgatctgaaacagaaagtaatattacaaagagaaaagtgcgtctagcaggcatggaaaggcagggagcaaacagctaattgcattgaggacattgtcacaccaattccctgtgttctgtttcatactggaaaaattgtcagtagcctttggggctactgcatattgttttaaattattattaggctacatttaaacttttaaaaaattcaaatcattgaaatcaagtgtttcttgggtcaagttactattgctagactacaggagctagtaaagatattactatattagggaagctctgagaaaagaaccacatacaaatcctcccaaataaatcatatttgaagtatttgttataagtctccatggaaaacattttagaagctcttagaaaaatattccttaggctacaatgtctatttggatattcctttgctcatgttgaggtgtgtggtttagttttatccacaatgatttaattttatagtgaaaattagtataaccaaggcctcaagcttataccagactatccaaatgagtatattaattctgcaggcttttcttctaacgaggagaattttatcagcatggagtagagacattttaaaattattagactgaaaatagctttataggcaccctgaagcttaaatatgtcagttgataataattaaataacaccaaaatacaattttcaataaaggaaaatgagctggttttagaaagtctgaaagataaatcagatcatcaacattctaacattcatatgagaaacttatataattcacatcaagcatgtcagatcaactggaaaattagagtaattaaatgttcaaggggaaggaattttattatacaagctataaaaacttgacatggcaaaagcacttgcagagaccacattttcaaggcacccaggaaaatgcagcaacactgggctagagccagtgagaaataatcggtttcctggagaccttaataggaaagaaatggaatcctagttagacactctcagtgaacataggtggacctagaatttcttaacatagtagaaaaaaacacaaattccataaagttatagtaaaaatgctttgaagtatacggtggattagtaatgaagatcaacaaccacttctctccgggatctctatcccctctaccttcctctgacctttttttttttaagtgcttgttacttccctatcaatgtatattgtcttaataactactatctagcgtttatttaggatatctactattttctctgataatagtacattaatgtgatttctcctgccaaaatttgttaattctgctatttgacttagcgacttgagccactgtgttccagcctattatctggccttaggtcaggaccgcatgtgtgcaaaaggcagtcattttgcatttccttcttattgtttttttctagttctaactgtagaatatgcttttgatttttcatttttgaaggtcatccagtacagttttaattcttacagtaatcacagtaaattgcagtagagtaatttctttttttggagtaaaattttaggtacatgtgtaagacctggtttgagaattgtttagtaagtatatttctaatctattgggcctcatatttagttgacatttgatatagaactctatattccaaaaactgtatactttcattttcttctgtcatttagggtctttttttttttttttttttttttgtagtcgcatgctggccctcctagacctagcatctgtaatatctaagttgctttctacatgtctctgaggtttttgcctaacattcaggggatatagtcctaagatggtgaagcttgttttactgaacaccattttgggccacagtcgatgccctagctgtgctatgtttcatctttcttaggttccattcctggtgatttctattaggttccttacatccaatgatgatactagctgtgctggtaggcaggcaaagaacccattgattctagtcttcagattttgtctctaataagtaagaaatagtcttcatttcttctgtctttctctttcataacaatgccatttctctcccttaaaacattataatgtagagtaagataccagatctaagtttctttgtcaaaacatcctgaaatttgcctttgataatgccagaccatgaattttaatttactttattttcatgaacttgtaccattactgattttatactattccctctagaattgtgataaataaaaatagcacaaagttatatgttatataaaccactcaacatataaattaacaagtagaggaaggcaggctacttataggaggtttcctgtcaagaatttaaaatctctgacattctgtttacatatagtttttagatagcatgtagttgattaataaaaagcctcaaaatattgccttggtaatccaggtgcagtgtgctttaacatatatcaagtcattgaagttctgcagtttactgcagtttactcttctaaatgtaaaacattccttcgctcatgccagttctagagagctttgcttcagggatgctattttatgctgaatgaaatcttttcagattcagaactgatctcccacttactgcaggattccttttacttggttctctacctgcttctcttgcctattaatggaccaaatccttctacctgaatagggtgttcaaattgttagtacatgcagttagataaatgagaaaagtgtgcgcgcacacacatgtacacacacaaacacacacacatacacgggcacagatatgagaaataatcacaaggaaaagagactaaaagcaagtacaaaccaaacattaaagtaaaagcctgtctcagtattgccttcctctgaggaagtggatgtggggacccttcaaattgagttttgcatagagtgggtccgtagtagattcaaacaggttaggccagcatgggcttatttgcaagtgggggccttctgcctttcctattagattatgctagcaaactatggctgctgctgtttgtattcctgctgatgttccagggaagtgaataggatccctctgtttctgaaagctaagcctgaaaactccccttggatgagtaccattttgttgtgcccaaatgttaggatcttttcctaaatatgaaacccaatatttaaagatttttccctggtctttctcttcagtttactgttattcccagtccctgcagctttgtaccttatgttttgttttaggctttgtaaggtgcaggaaggtacccagtgtttcagggctgcctttctacctttttgtttgtttgtttgtttgtttgtttttgttttttgagacagggtttctctgtgtagccctggctgtcctggaactcactctgtagaccaggctggcctcaaacttggaaatccacctgcctctgccttccgagtgctggaattaaaggcgtgtgctaccactgcccagcgcctttctaccttcttaaagtaatgtctttagatagggcctcctgtatcccagcctgaacttagactcaccatgttacaaaggatagcattggatttctgatacttctacctaccaagtcttgggattaaagatgtctactaccatgcccaaccagattaatagtttactttaaaaattatgtatttgtgggaggaggaccatgggcagatagctaaaaggtagcttacagataactagctataagactccagttatagtcctttttgataattacatccttggtattgttttatggagagatagccaatgtcttctggaatgacgtaatgttgatacagccccaaagcccgttacttgtatgtgcactaaactgtcatatccgatatttatgtactgaagccctaacctcccaatgtgagtactaagagatgattttaaacttaattatggttaaatgaagtcataatgctgagtttataattctttaagatcggtggccttatagaagagaaacagcccagtctttcctttctccaccctctccatctgcttttctcctttcccctccctgccttctttctgccaccacacacttgcatacacagaggggctgtgtgaggataaagggacaaggtaaccatggctgtcaggacgaaaggtctcacaggaagtaaaatggtagaggaccttgatcttcagttcccagcatgagaagtgtgagaaaatgcattgagtgttgcctaaggcacatgttcagtcttgaggattatggcactctgagcacagtcagcagcctctcacatcttgagagagggaagcactccagggtattggccgaatgcacaataacagataaggacactcgccatgtggaagttgcatgtttacaattgtttaaagggcaattggctgtcttttggggtttcaataggatggcatttcacataataactcaattctgaagctgagtctaatcttgatgtggaaggggagtttacattctttgcttgtgatttccgtcacctgacacctactgtaatgacttccactgcaagggccattgctacggctatgcagcttcaatccatcactggcaaccttctgagagctgggtatcccattcaatcagcaacctagtgctgtgcataattaattacatccgttttcccaaaccccaccgaccgctacacatcaattctctgaaaaactaagtgaaagcagtatttttctcatgccttcctcctcagtaagtgcagatttagaggcatgtacaatcaatcactgagactttcagcttttttctttttaatttcaagtattcatgaccatgtctgtgttgaaaattgcaaatggattcatttgaggatgccattagtacctgagctccataagtagctgctggactccaggtcagtctttgaagctgcatggagttcagccatctgcgtgtgagcagaagcaatctctgtgattgtcttttaggactataacagatgttttagctgataaataacacctataatttagtgtcaacattgttcaatgatggtatctaaaagccagtaattctgtcggctaggctggattgataagcatatagggtaatagaatgtgggactgtggtttcaagggcaaggtttgctatgattatgtaggatgtatcattaggcattattacaccaagtaatttattcaagtggatggtcttcaattttcaagtcactcagactctatgtgactgataagttaagagaaaggttcattatgtgcagagaagaagcaaggtacatggaaagctttaaaaaggacagaatcttaaaaccaaacaagcccctaatgcattcccccaaatgttaagacactagtatgttaagacgttctctgctttccttataaaggtctctgagcatattttctgttggccattaaggcagagcaaggcaagacagcaattttgacttgaatgctcagtgctgtaaaactattatgtgaatctattttagtttggaatagatggaataataaataataataaatggaagatgatggtgcctcaatgctgtttgtatcattaaaactcaggagggaaacggtaaagggaatgggaaagaagaaagtaaaaaaaaaaaaaattaattggagctgtgaaaccagagatactcctacccagtcagccatatctgtacttgaaaaattaaaggctgtctagaggacgtggaatgagtcacttcttgaatctctagaaggctgttaaccttttgcccacttgtaggaagcacagtccctgggatttagcttaattctctgcactggaaagtagagatcagggtcaggcaggcattcttggattttatccaggtgagtttagttactgaaataaagatcctcatcacccaaactcttccccaggctaacacagttccagtacttgctgccatttgtgctgcttcctgtaaacagaatcaaaactccaaaggtagcttgggaataaaagagactctgtacttagataggaggcttgagttcagtctagggaactcaaggactggggaagacttgcagtcttggctcaaatgctgatgtcctctctgacctcaatgtccttatctggcaaacttggcagtgatgctaaagatctttcattgcctatcaacaccaagcatttctaagtccttctgtttactgtcctcagagctccctgctctatggcccaactgtggagagaggtggatttacttagatctatggaaaacactgactaggcttctgaatttccacatgaaaaattaatctgtattttaaacttgcctcaggtatgaatctgtctcatatctgccataggaaaaattagccttctgctttaagaatattttcagaaaatgtgctcatagtattattcatggttaatttaatatctttatcttatttaatcctgtttaatgtcattggctgatttaaatatatttttatattatttgtgtatgtctgtgtgtatacatacgcacatgcatgcatatacatgctaccacaaacatgtagagatcagaggacaatttaggagagtagttctaagttccaaggagtcaaatcataaactgtcaggcttggcagcaggaacttttctgctgatctatcttgctaactcatcttaccagtttgtatttgctctctctctcacttttttgctctcattcttgctctctttcccctctaaattcttactgcctttcttcttttttggggtgtgtgttatcctagagattgagcctagggtattgcagatgttagccaaatgacctaccactgagctacatcctttgctttcacactttttgtcttgaagagacaggatctcactaaattgcttgatcagccttgtattcattccatacccaatgtgggcatcaaacttgcaattcatttgtctcaggttcccaattagctggcattataggacaggactgagataccaagattgtcagtatgggtcactctcagcagatgtcagaaaggaaaacaattcaaattaggtgtaaggaagtaaaggaatttgtatcatataactaagaaactctcaggtggcacttagtattatatggagtattatctttgtgtcacagctgtacttcttttctgagtcatggctcttttatgacagagttcccatatgagcaattaaagacagtttttttttgtgcctctcctattgaagacaccccagatttagaggagttctggctctcctagaatgactgtatgtcctatttttccactaattttggtagattggagttcccacagtgataatgcagtattctgcctatagattaaaagaaataataacacttcagtcagtttagacctctaatactctaactaaatgtcttccaagttcttattttcctgggactgtgttcaaaccactttagacctcagcctgaaatcacaaacatactcattctcctacttaaaataagcaaaaaacaaacaaagaatcaggttgaagtttcttataatatctgtagtggcatttcttgcctaaattgtaaaacaagacatataagtagtctttaagaggagcatcgatcttttttatccgaaatcactttttttggtagacacaaatgtatttactctctttcctgaaatttcatgtggttcggaagctctctaaacatggagactcactgtgttcagtgggtcacacatatgacaactgatgatacttacagattgtgatctgagtgacaaatttcctttcccagtcaggcatgctgcctgaatgccaccttgtgtgtaactgactgtaactgtcttctaacctttgttgaattcaaacaccactgacatgaaatatagttttttcccatctctggcactcactaaattccacagtgtagaggcacgttttgccaaattctatactgaaaggggtgttacctgatcttgcaagatgtttcatgttttccaactgccttgttctttttttttttgtcttttttttcccatttttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctctggggtactggttagttcataatgttgttccacctatagggttgcagatccctttagctccttggctactttctctagctcctccattgggagccctatgatccatccattagctgactgtgagcatccacttctgtgtttgctaggccccggcatattctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcctctggatatatgcccaggagaggtattgctggatcctccggtagtactatgtccagttttctgaggaaccgccagactgatttccagagtggttgtacaagcctgcactcccaccaacaatggaggagtgttcctctttctccacatccacgccagcatctgctgtcacctgaatttttgatcttagccattctgactggtgtgaggtggaatctcagggttgttttgatttaactgccttgttcttgatgatgcagatcactcttctttaacttcatctatatccctttgtcacccccatccttacatactaaagcaatcaacagtgtgaaaaagagaattaaatagtggaatgataggaagatgaaattattgcaaagagctctagaaacttaaataagtggggtctcaattatttgatttatgttttatagaattctatcttaggctgttaaactttctgtttaagggtttttttcccaacacgagtctgggtggtttgcaatattatttactcacgtttgacttcatataagtaaaaaacatttatttcatagatttccagcttcagggtcatatatataagagttttgctagttgtcacaccacagagaatgtgttggtagtaaatttgttccttacatagtagttcaagattattgcaaaaggctgctgcccttgtgatcatgcagtttccccttccattctaaaggtgttagctttccagttcagttgatgtaaaataacttttacactctcaccctttggacttaaatgtcatgctcctgcatagtccatggtcaacttcatgcaacaaatgctctggcagttgttatagttggcccagtgacatcttctgggaaccatatatataagtagtagttttactgatttaatttcatctttgttcaaatctcctgaggggatagataacttatttcggctattcgctatatgtttaattgtcttctgtttcacatacttgcctattccagtgtcatggctatacttagctggtgaaaaaggaaaaagcaaatggtaaatagcaaaataagtccttccggtcatgtcttctttatccaataaactcagtagattagtgctgtctgtcgactgctgtgttccatgtactctgcaccatggaagaggtgttagacatgtgggagatcggagttaggtcactgagacttcagtagctgtcccttgaaagtacatacattttctaaaactggcagtgtattaaactatgcctactctaatcttttatagatcatatatgtatccagtagaataactatttacagttacttgtcagttatttaggttgtttcacaaataataaatggtatatcaactgttttattatttgcatacatggatacatgtagctcctgctactcttaatttcttaaaataagttagtttgatgcttcctcagatgttattaatcacattgtggctgtagctagaggtgaagatatctccggagagtaaacattactctttctcccctagattgcaatgctaactgcgctcttctaataaaagaaccttaatatggaaaaccgcatgcttgacagcaacccaccacttcagcaccctaattagaacatgttgaaaatcctgagtatttgtggcacttttttttcccccacctaaaaattgatccttaccagtaaatcattcccctagggtctatctagcttctctgtatggttttatcccctcaacagagaagtaagtagccaagcagcataagcatctatacattgaaaatatcctggaccctctccgagatccactttctttgtttacacatagccatccagaagacagaagtatacaagggattagtgagttctgaacgcagacctttgctatgatgacagacatattgactgtatgtacttgatagcaaaagaatacaagggaatttgatcaaatcagtcatttattcatgagcctattttcatcttttgggaatgaagaacttggacaaatttttacagcataaattttatgcttccataaagggcatagccctgcttcagtgtttgaaacttataaaatcaacactctcaaatgaaaaaggacacgagaaatttctgaagacaactacagtaaaaactatctagcacaactcactgtcacttccagtgagaaaattgcaagttctcaaagaagttttcattaattctgacccttgtcaagagtcactgagcaaatcgatacattattgattaacctactcttgtgaacgtatttttcttcctttttcatttgtatatctatatgattaagtgacatatcccatacaagcctgtgtaattactgagaaacttcttgggggcaagcatatgtgggtcacatttgtgttttgaagagacaaataggctataaaagaaagaatctgtatttcttgatactgttggctttaaattggcaccaggtataatatgtcaatattaaatattatttgttataccatttgcatagtcacagtcatgaaaacccatgggcatgtaatacagaaaagttccaatccaaatatttttgaatggattcaagaacttgttagttaccccatgcctcctaaatgcaagccaatcccatcattttgccctataaataaatgatattttctttttgagttattgctcttttctcatttattatatctttaccacagtttcccctccctcttccccttagaaaagagcaggcctctaagggacatcaaccaaacccagcataacaagctacaataggaccaggcatatactaccacatcaaggctggacaaggcaatccaaaagtgggaaaactgtcgtacaagtataccaaaagagtcagggacaatcccaagtcccactttgaggacttccacaagaaccccaagtcacttagccataacatatatgtagaggacctaggtcaggacccacccccaccccccttacaggctccctgatctcaagtttccatgagtcccagtcagttgattctctaggctatgttcttgtgctatgtccctgatccctctggttcctccatctcttcctcctctttagcagtactaattgtatttaaagatagtaaatattaagactatttcaagatatttttaaaatagaatgaataaagtcaacttgagattttttttcctattcaaaatttggaagtcattctgatagatttttgtttgagccctggtggcacttactacattttccaggttctttttgcaaacagtggctatttaaaattctcttaccaagttttaaacctggaatgtgtttattcttaagtcagatgaagattgacttccctgccctctttgccttggtaaggaaaatgctgtagtgcccccttgtgtcgtgtggagtctaaaacacccctgattgaaccccaaagctgaatctactccactaatatccttaaagtgtctccttgcagctttgggggtaaggtatggcattgctataaagtcaagtataaaggaatccttgtaagatgttatgttctgctagataaaaacttgaacttgctcactactcatttggaatgagatgttaactcttcaaaattgttctagcggtcataaatgttccaaggatgacgttgacccaagggagattattagaataatggatgggcttaactcttattaccacaggctgtctttgcctgtttctcatttgttttccttacttagacttcaacatcctactttcaccgaggcatatagtacaaaaaaaatcttataatttatcttagattttccctcacaagaggagatgctcaagtttcgggcataaatccaaagtcagtatctatacatatatcaccatcttcttacttgtgatacttgtttcttttagaagaactgtgctttgtggaacaggaacctagatttacctgggctttgaagttgttgctatgggatagagcctaaacctatttatgttgggtagtagctctctttagtcacatgtcaggggtatatattagcaaatgtagcaaagaatggtttggacaagagaatacatggattgttggacgcagactgatagttctgggcaaagagcatcagcatgggacatcatataaaactgtgcttaaaggtcatcctgggaagacaattgtagttcggtaagtttgtacacaaagtgtgagatgggcaactgtatataggagttttggggaacccaaggaatcctcttgcagtggcagttaatatttagttggtctaccttgaactggctacagccctaccttttggttcatcttgatgaatattagaaccagtgaatccccatataagatggttctaaagctttttctttttcttttcttttcttttttttttttttttttttttttttttttttgagacagggtttctctgtgtagccctggctgtcctggaactcactctgtagaccaggctggcctcaaactcagatcagaaatccaccagcctctgcctcccaagggctgggatcaaaggcgagcgccaccactggccggcctaaagctttttcaattcaatattaatttcaactcctaatcttatttcagatgcccctgaaacttgattaccttcactattgttcagatcatatgcttactgttatgtttttaataccaaactaactgcccacaagactgactagcagccttggattctctgtatctctgaaagaattcaaacagatgacattttctttattctctccaactttagtctagactgtgatctctttaagtttaatgttgccttgttgttaaatttggtcctagacctaccttctcattttgtttttagcctttggtaattagagaatgtggatccacagtagtgacaggcacatagaaacggcttgagatcattaatactgtgtcttaactagggtacaacatacttgctagggaaggagtaaattattttctggacaaacttttgcagtgatattttgctcatgttatttgatggttactgctccattgtggttctcctgtactttgggacagaacaagttcccttgttgctgtggtttttccccattttttctattgtctctatgttcatctaatgactgggtctttgttcaaaatgtctatgagattagaatgtatcatatggcagagacaggggagagaaaagaaatgagatgaaaagtccatgaaaacaagttgagttctaatgctaggctagatgcctaagatcaagaggaaaacaacaacaaaggttggctgttagctgcatacataaggaaaacgagcaagacccttttttgtttagccttctgtatattagactttttgtttttaagctgtcagagtgatctagtgaccaacatgttgtgtttaagaaacaatggtcagcagtctgcagagtcaaatgtatataccaccacattggtaatttgtgcatatgtgtagtaaaatgattggaagagaggattagcagtaaatgggatataagtttccgacaataaaatatttagacataaaggcagaagccccacccatgcctgttctcaaacgttgacaactaccacaggcaaaagctgtcacttctgcaagtgagaagggaagtaagcagtcaccactgttagtgaaattctcttcttgggatgcaaacctaccatgtgaaatcacaaactttcttattcattgtgaagaacaagtcaattcctgccctttgtaatacttaaaaccccacgggtatgcatgtttccaagactttttagactcacaatccggttttctgtcctaataggttgttttcccttggcatatacacacactgctgagttgggaagctgcttcatttgcatttagcatccagtgccagtctctggtaagttgcgttctcttacaattttctgtacccctataatgggtcgaaaaaggcatctctctcaggtagtcaccttttcctgaaacttccgttggcatgattgcttcatgggattgttttctcgttttcttgagacattgcctatataacccagactggttatgaatgccctgtttagctgaaggtgaccttgaattttttttttaattctcctgccgctacttcccaagggttgggattaaaggcatgtacttaccacatcatacactttgaaaactaatgtgacttagatttgattcaataaactatatggtacctcaaaactaagcacaacttcggttataggggaatacctatacctatacctctttttctgccctctggatactaggctcacatgatgaataaacatgcatgcaggcaaaacacaaaataataaaaatttaagaacacagtggaggttggtggctcctgatccccccccaaaaaaaaccactcaatgttgacctttgacctctacacccactcatacacaaatagcaacaatctcccttacacaatacaaaaagagaaaatactatgagaagttgagggggcagatgataacacatagactttggtaacacatggattggcttttaattaatacatttttccttgtactgctattgtttgtattatttgtctgataacttctctgagagcaggaattttttactgccttatatttttctttgtcccatagtcaactaaatatgaaaagatattttggttagtaggtgaataaagaaacaatagttagaaataaggcctataaaatactaagatgataggttacagtagagaaagaattaatgccaagaatttctctcatgctgtatatagcaaatacatgctttttcatgagagaacattctttagtgaaataatatttatcttttgaaaattatctatgcattgttctcagctatgtcttattaggagcactaacataatcatttttaaagaataaaaaacatgctctgccaaatctctctcagacagaatacaaagcttgaatagttcatgggaacaatttgctagtctagagaattcttcctattttggtcaggacctcctatagagtgatttatgtgcagtttatgtcaagaggcgaagtaatggcatttctctgctatacaatgatttggatgtgtgctgagtgtggaaatgcacctttaagccagacaggcaaggagaaaatctgtcttgatccaatcgttttgaaaagccaggcacactgatactggaaacgaacagaatgactggatttaattgctaatgctctagaggcagtgcagtgttgacctttaacccaaacttgaagggtagaaaaaaggagagggtggtttcttctttcctttcatcagatctcaacttgcctaccccttatacctgatcctgcctgctttcaacccaatccacatacacgtaacattcagctttgtcctcctttcttattgcttgcttccagcttaggggcaagttgagaatgaatagaaaacagaaaaacaaaaaggaagaggaaaggacaataggagaaggaactattttaacttgttgacagctgcttagacgcaggagacagaattacagctactaaaataagagcgactctgtcaactgatgttacaactatagcctcggaattatggagcatatccctatatgtattttaatattttattatgtttcatgtgttttgtgtatatgtgatcatgtgagcacatggatgtcattgcacatatggtggtcaggacaattctaggtaatcagtgctctccttacaccatttgggttgggagactgaactcagattgtaaagcatggcagcaagtccccatggactcgttagcaactgagccatgccccaggctcacattttcctctattttaatcctctgtcctcgtgttacttttctcttcaaagatttattttatttttgtttttgtgtatgtgtatgtatctaggtttatgtacattaagtgcagttatccacagtggccaggacataatagcatcttatccctggagctacctgatatgaggtctgagaaccaaactgggtcctttttccaaaagcagtaagcattctgaactgctgagacatttcatcaattttaaaggccatgtttatgagcatacccttctttattcctacagctctgctatttcttttttcttgtatggttacgttggaatgagtggaatccaccaacaagtcaaaaatcagagttcctatttttatatgttgccccaggacaactaagtggctacatggcactggagaaagcaaactgatgattgatcccatcgtacatccgtgcctgtgagtctaaggcagccctgtgccatggagctgcttagtaaggttatgaagccatttgctttcctgctcttctatagtgccttcagtactgtctttcactgcagatgcctttacatttttccctgaaagggaatcatgtttagtctttctcccatctagaacacagactctactatattattgccaggtgtacacaagtctgaagaatgcctacccccattaccaatagtatagtgtttattttcctttactctccttttctttgaggaggttgctctctctattttctgtctccccatttatccctcctctctcctacctctcctctctctaaccccttctcactctctctctctttctctctctctctctctctctctctgtgtggtgtgtgtgtgtgtgtgtgtgtgtgtgtgtgtgtgtgtgtgtgtgcacgtacatacgtgtacaggcacttgtttatgcatgtatgcctgctgtgtatttgcaaatgtaggttaacctcaggtattgctcttcaaatgcctaccttctatttttgacagcatctcccaggagcataggacttactgattagactagtctttctggtaaggaaaccccaggaattctgtctttccttcactgctgaaagtataagtaggcaccatcattgtttataggttttggagattaaatcaggtccttgtgtttgtgtagcatgtaattaacatgtaagcttatccacccctccaccaacaccctttctttgataattgctacaatatgtcctatttattttatgcatatatattttttgttttcttggatatttttaggtgattagtactgaacacagggcctcacatactagacaagtaatctactattgagctatatgcctagccctatgtgtaagtttttcaactctgctacagagagtttggtaaaagtctggattttgtatttctttacaatattgtatccccacaaatttatagtggttttcagcattccatgtctattttttaatgaagtaatggatgaattaatgtagagttgcttttgataatgctcctggctttcagagtgccccttttcatttaccaaattcagcatattcacatacttttcaagttcagatgtaaggaacactaagccattgttggaggaagccttttagattctcttgggaaatccagtgttctttattaattatatatgcttgttaatgatattgtatctagaatcaaacttccatagaacaagtcctccaagacagctttgaggctaacttcagtccattgaatggaatctgatagtgccactgaccttgcctaaaacctcgtagatactcataatttcacagaaatgtaaattgaaggtttcattttcagaggttttgcttgggctcattagaggtaggcagaactttattatgagccccagtggcaaatatatgatattttattatttccactccctacatacatggactaggtcactaccttttagaacctttattgtttctattcagtgaggtaactaagcaggacttgttagcatatactagttatatctttcccctactatctcaaatgttttctgagtgttctgagagctgagagtatatacttcagtgattgatcatatgcttggcatgtgtgaggacttaagtacaattcccagcatagttaaaacaagggtgaaacatgataattaaaacttaacactgctatttcagcaccttctacatgttaaccttaatctactcaattgagataaacaagtacttgattttatttcagatgaacacagcttactcatgtcagtgaaggagaacagacaaataatttttttatagtcattgcttagaaacaaccttctagagtttgtgtacctatctccagactatgactctttaattttggaatttttgagacagaatctgactatgtatctcagacaatcctgaaactatgtaggaaaagatagcttgaacatgtagaaatcctcctgcctcagtctccaaagtgctgtgtttataggcataagccaccatacctgccttgtagatcacttcttgtataagatataactattggttatctttttattattattctttaatattattttatagtccagttgttacctcctcctggtctgtcctctgactgttcttcatcccataccttctcacacaccattccctgtctccaagaagatgtctccacccttctaccccaactcccacaccaccaaccctccccactccctctccctggggcctcaagtctcaggggttaggcacatcttctctcactgaggccagatcaggcagtccactgatgtatatgagttggcggcctcttatcatgtggtgtatgctgcctggttggtggctcagtgtctgaaagatctaaggggcccaggttagttaagacaactggtcttcctatggggttgatctcctcctcagcttcttcctgccttttcctaattcaaccacttcaggggtccctggcttcagtccaatggttgggtgtaagtatctacatctgagcctctcagaaggcagtcatgtaggcacattatagcatcaataatagtgtcaggccttagggcctccccttaagctggatccaaatttggacctgccaccagacctccttcccctcaggctcttctccatttttgtccctgacattatttcagacaggaagaattctgggtcagagttttttttgattgtccgatgtcaaccacatccctctacttgatgccctgtctttctactggaggtggactttacaaattccctctccccactgtagggcatttcatctaaggtccctccctttgagtcctgagagtctctcacctcccaggtctctggtgcattctggagggtcccctacctcctatctcccgaggttacttgtttccattctttctgctggctcttagggcttcagacctgttctctccaccttcccccttttcccctccctgtcccctttctcactcaggtccccccccccatcctgtgattgctttcttctccctcccaagtaggactgaggcatcgtcacttgggtccttcagcttgttaaccttcttgagttctgtggattttatcctgggtattctgtactttttttggctaatatccacttttagtgagtacatgccatgtatgtccctttgggtctgagttacctcactcaggatgatattttctagttccatacatttgcttttcacactcagtgaggctaaagtaattttctttattcagaaatgaaatgtatgtcaaactttaaggaaatattgaaaaatacagatacagtttcatgagcgcatctcctgtcttttgttttgttttgtatgagataggtctctatgcagtactggctatcctagagctcattaagtagactgggccaacctcaaactcctggagagccacctgcttctgcttccaaagtgctctggctaaagacttgtgacattatgcctagctcctaattgtttttttgaatatcgagagtagaaatgccaagaggatttaaattattatgagtatcattagaaagaaaggacattacatttttgggaggatagtgtacagattgattggggattgtagaaactctgaaagtagatctgaatgctaaggtgtaggttttgttgaatatttaaacaagctaaaactgttgtggagagaaaaatgtttaaacccgtgcttagcatccacagaagaacagtgaactgtacataatctagacaatttgaagtcagatgtcgtgttgcatacttttgatcccagcactcaagaagcagaaaggtggggctagtgagatggctcagtggttaagagcactgactgctcttctgaaggtcctgagttcaaatcccagcaaccacatggtggctcacaaccatccgtaacgagatatgactccctcttctggtgtgtctttagacagctacagggcacttatatataataaataaataaatcttttaaaaaaaaaaagaaaggtgggaactttttgttcaaggccagcctgcctacagagtgatttacaggacagccagagctacacaggtgtattgaacctccccatatcttcctcaaatgtagaaagcttaaatttgctgctatgcctaaatgtttatatggaaagttttcactatgataaagataatcattatttaactcgggagcatgtgcacttttatatatgggtgatcacaactactgcatagaacaaaaacttcaccatagactaccagttttcaatttttggtcatttaagtacagattaagcagaagtttttcctgatactgacagtttactgagttaggtaacagcacaggcaagactaagggagactattaactagttaggagaacacataacttccaatgaatcactgagcatgatttctgatgtaaatccccccgagtactctggaaagtttacatttcagtaattaaatatatctgatccttcttcactagttttgtaaaatttattttgggttctcagaattgacactggatttttttttttttccattcggagcatgcactataacatataactaagagcttccccactcagtttggtcaaattgcagagctggctaccaaaatcatcttagttagaaagctatttattttttaacttttgcaatgaagggtaaaatgtatggaatttcctcagtgccaaataaaagaaggtgatgtaactggcattagaaggaggtagatacatgtactcagtatccaatgtctgaatttctctactcatcaggagatatccatccatccgcagttgaggtaagggctatgtagtgcttctaattaattgcttcaacatttattttggtttccctgtgaggtcattctgtgtcaggaagattagcacattatatgtctatacagaacatactgttcagtatgctttttaattgtgccttaaaagtcattgaaagttttagaatttctattggaaaggtgaaatttaattagaatggaaaacaagactgcagaggaaaagagattcagtgcttaagaatggagtttgggttttctataagtatttctctcagaaatgaaagaactgttttttggattttttaaaatcatgttcttgggttgataatcaagatttttgtcatcttacaaccatggatttttcttaaatggtgttgagttagtaactaaagggttacagacccacgatttttgtataaagccaacattagaaatagtcatggtatgtaaaaagttatatgctgtctctttgttgtctccttaggtaaacttgggaaacaaatagaaactccgagattgttaatcagtatacgtgagtttacttgcaaagaaaaaagaagtatggagcccatattgataaatgctcaagtccagatgtggagtgcaaaggcaggaatgtccaagtcaagaaatgcactcattgaaacatgtgtaggaaaacgagaagttaaacttattctctatttcagcactggaaagattaagactttgcaactacacgataatattaaaagtgtggtccttcaaacctatggcgaagaccagaattacctacatttgacttttaaaaataatgatttcttgtttgttgagaaactcaccaccacagatgccagaagactgaagagatttctagacaaaacctctcaaggtagtattcggccagccagaagtgatgagagatgtggtgagcctagcacaagtgcacaggagttgaatggctctggaagttcatgtgaaacaaatagtgagtgctttgaatcacccaaagaaagtgaaatgtgcatgtttcgtgagttgtctttgcttccatcctcatcaacctttcttcacaatgtaggattattagaaaaccaattcataaagaggaaaagatttttctctgatttagcaaaaaatgaaaaacagagcaacctgaaggacagtatcagggactttgaggcaaatttagtggtgtgtatctctaatgaaaagggaaaagaaaggaatgtaagagaagtagacatcagtaagccagggtttggatttccatttgagaccaactatcctgaagatagtggtgtggatgttcgtgatcttaatgatctcattacaaaattattttctccagttctgttggaaacacactgtattgagaacggcctagagtggcatgaatatatgaagacatacttgctttacccagagaaattgtggcaaggcctgcctaatgtgggaaacacctgctatataaatgttgtattacagtctctatgctcaataccactgtttattaatgatttattcaaccagggtttcccatggattaaagctcccaaagatgattttaacatgctcttgatgcaactgcttgttttgaaagatatttacaacgcaagatttagacagaagttacttataggtattacaaaagccctccccatatttggagagatatttgctgttgacaggcagaatgatgctcatgagtttttaagtctctgtttagttcagttgaaggagactttccaaagagtaaccatgatgtggcagtctgaaaatgattcgggggatttttacttacttaaagacatttttgctgattatgctactatcaacaaaatgcccgtttgtcctgttaccaataattttgaatttgagttgctaagctccattttttgtaaagcttgtggcctgactctttttaagggagaaccaagtagatacctttctatcaacattccccaaggagggaaagacatgtccatccagtccactttagatcttttctttagtgcagaggagcttgagcataggtgtgaaaagtgtttgtacaacaaatctgtttcatttcacaggtttggccggctacccagggtaattattgttcatctgaaacgctatcactttaatgagtcatgggtaatgaagaaggatgagcggcccatccttgtttccaaatacttaaggctgtcttgtcactgtagcaaaagcacaaaaccgcccccaccccttcgcccaggtgaacatgttaagaatcttgacttattaaaaccccttgaagtgttgggttccgaaatactcaaattgccttttaattcagtgaggacctctagatccaagggtttcgaaactataaacatcacatcaaacagggagtcagaagcacaaagtgggaaaagagtctctgaagtgttgagtggaaaagtgcagcaggaaaattcagggaaaggtgacacagcacatatagttgggtcagaacttacaaaggagactgagaaactcaagaaacatgaggaagagcatagacccagtgatttagattctggtagtatcagggaggcccaaaagtaccaacaggctgagaaatgtaacgaagggagaagtgataagcagatttccctagaggcacttactcaaagccgtccaaaaccaatctcccaggaacagacagaaaaccttgggaaaactacactgtcacatacccaggatagtagtcagagttcacagagctcatcagattccagtaagagctcccgatgcagtgatgatctcgataagaaggcaaagcctacacgcaaggtggatccaacaaagttaaataaaaaagaagataatgtttacaggcttgttaatattatcaaccatattgggaacagtcccaatggaggccactacatcaatgatgcctttgacttcaagaggcagagttggttcacttatagtgatctacatgtaacaagaacccaagaggactttgtatataggggtcggagttctactgggtatgtcttcttttacatgcataatgatatatttgaagagctcttggcaaaggaaactcagtctaccagcacatccaagggttagtaagaggagtgtatgcttcacagtacatgtctatccaaatgcctcacttatctaaattggatagagaaggacagataattagcccaggaccaacagctcaacgaacatttatagagaaacgtttgttccaaccctgaccacatcagtcttataattacagctcatgctaatgagtgttctcttatacaagtttggaactgtaacttttgtatagtattttgtcataaattttattattgacagtaaggtttttcagtattttggtggaagttatataatccaaagttgcctttataccgattaaaatgacttattttgcttccagtaaaaggtatgttttctctcatttctgctttctttcttgcatggcagcataataagttctaatgaaaaagcttttatatatcagaaggaaaaccacacatgcccagacacagcacagttcagacgagtctatccagcgctgttaccccagcctgctgctctcttgctctttctacatttggaatggttcggtgtcatcctcccctcctggctttctcacagtggatgccaattaatggtgatgcttaagtgaagagagaagagaacattttatggctgcacatgttggaaaaaatacaaaaatggggagagggctgcatttagcttttgttgatttttaggagttttcattaacactgaacaatgttcttactgttctctgatttaggccttggttttataaactgttttcaaaatagtttgattttgttaagtctgttttccagtgtctgtctttagttgtcttgtctttaatggggttattttcttattaggaaaaaaacaatttccacttctagaattaacgttgaaggagctctgcatgtgctcgggacctactgtgtgctcctttctccagaattctctgtttgggatggttgacaccgtacttgtattaactggacagaatagatcagttgagagccttctgataacactggaggatcctggtctacagatgtagccaatctggatgcttgaactttttcacctcttcagtggctttctgatatgtctcagtcataagtttgtagaaatcgagcttctctcccgtctggccttcagctctttgatagagcatcctgcggttccttatcacctggcctttcattccagctgccaaaccagatgctttgcctttgagtgttcctcctcagtggatatcctttcccaaatgacaactctggttaactgctcattgactgcagccctctcgttctaggttcctcacttgcttatggcatcaacagttttttgattacttctaggttccaatggcagcttctcagctgcttttcaactcatcatcaaaaatggaagcactgta

SEQ ID NO: 437 - DNA, 418 bp, mus musculus
agagtggtctgcatccatttgctacatatcccaggcaaggagcccacagggaagagagctgagtgctgagctcctgcatcttatcttttgtgggagagatgagaataagtaaaactgggaagagcacatcttctcagtgactcttagccacatggatggagtggcgaagttgtcccaggccaaagactgtccactgccttgtccccttggaagccctttccttgtgtacaaataaccagtcagaaaatctggaaaacatagcagatcatttcaaaatgagttctcaggtcttcagaaagactacaatcatgcaagtctcttcctgctctaaaagtcatttagatcccagaattctactgaactgaaagcccacaaagaggcggtttcatgttactattcaatcttcagctgtaagagg

SEQ ID NO: 438 - DNA, 549 bp, mus musculus
gacagaatgtgaaggcacaagcagggttctgagccaattgccagactgtgttcaaacaccaggacaagaacagaatgagacttcattcatagttggagattggaagagactgcagatcaccccttttttttttattgagttgaatcacatgtaacttgatttcttgaacccacccaaacttaaagtggaccccatccagcaaagtaaagattcttgatgtagtctcccttgaaagaagaacggcactcaggacgtcccacttaacccatggacacgtaggcttggggatgtttattaaacaccagataagttaggaagtcacagtgtaccaattttttgttttagtgctgacactttctgttttttttttttttatcccgatggcagtagcaagtgaccagcgatctcatttgttcccctgtgttagagtgatgcagatttctgaccttctgaccactctgggcagagtgccataaaagggagctgtctgggctccgtgaatagctgttaacactcttttgagcagtttttgtctagtgtgtacatatt

SEQ ID NO: 439 - DNA, 3004 bp, mus musculus
tttcacatgggcagagtggatatgccgggtatgtatttcttctctcctacagactttcgggacactttcaatctagctgtgaggtagtgcgcatgcgcgcactcgttgggacgtggggacacctgggtcccacaactgcttgggcctcgtagcctatctccagagggggatgggacaagcgcttcaggagcctgaccggacaaggtagtaatgagtgcgccattctgggcaggcgactgtggcactggtttagactggcatcccatgggtgcttggattaaggaaggactctggtgttggggacagaagggcaaggctgagggagcgggtcctgtgtgtcactggggcaccgtgggctttggcctgggcggtgtgggggttccatttcctaattcctgtgtgggccgagtgggcgggggcgggctttcccccctaggctattaaaggcgaagggcgggcttttcccagggatcgggctttgggacgcagctcgaggtgacggaccgctgccacaggctcgtgtgcacaagtggtgctgcgcggacactttgggggttaggtgtgcgtgggccgccggggcgcgtttcctgcacgtggctcctcgccgccctccctcctccaccagctaggagagcagagggccaggagctctaggaagatgcgtgcggttccctgatcctggcaggcaggacagcagcgggatggtcgcgcgcgccacctgccagggcgggtcactggcagatcccctacgcgcttgttctggatgactggaccaggagatgcgtacctccgcgggcgcagctgtgatcccagagagttaactaaggtgggaggggatggagctggcaagacttgagaaaagcaaagtacctgagtgtagttgaggggtgccaggcaactcgtgagaaaaggactctcccttgttgctctgaaggtttctggagaacttgtgggtggtcaaatgccagggtgcacgtggggtgtggggcgggaggactcccgacctaccttggtttccctcccaccaacccgagaatggagggagaggcttaagcttggcgcgttttgggggctttgaatggagaactccgtttcccataatgctttgtttctttctgtttaattttggtggccgctaaggtgtcttgaagacctaagcgcgtggcatgactggctggagcacaccctgcgttcccaggaggttcacagatctctactggagccgctgctgaagatgcgggaatagaccagagaaaatcccgaaatggtaaaagactgggtcctctttgcaattttagaagttgtacagcgactttctagtatatatgatggagagcagatgtgttaaagaaaggtattagctagaaggagctttctctggagggctgaggtatggttttgcgaagttgagtcaggttttgtaatatatttttagtggaggcaaaaatctctagttgtaggaacccagttcaagaagaaaagtataataagccaatacttgcactataggaagcagatttcatatttacttcaaaagttttgctaatttatatttaaaatgttttaagaactatcttagtcactaagtggcttcgaaaagttccaacatttaaaatatcctttctcattgaacacatttcaagttttgtgtccctgaagtttattggtgtccccccatcaacacaaacattccatcatgggagggagggagctcgtgacccctcagactgtcctctgcagcattttcctgggtaagatacacacttggaaatgagagaggtttttcctgtggaagataatgacatgaagccaaagagctaatctgacttctttaggtttaatggagaaaatgggtccataaatgtttaaacagaagtagagccctttgaaatagatgaaaatgtgacatctctaggccatctgtgcggtatgtgaagagtgtaaaactgtttcttaaagcggctctgaaatttctatcattttctcttaatgggctgggggcagggatgcttcatgtaatcaaacatagagaccttccgagtggctccccaaagctctggatgagctcaagacgtcagtactcaccctaatgttatttatttatttttttgcttacatcttttcctgggctcttgcctcttagaaaaccatggtggatattacagctctgcaaattttctgggatgcgaatctcaaatttccttagacggagagggagtccaaaatcctcttactcttaagagtcagacattctgagattgccagtgttattcatgtttaagtctgtgtaaataattgagcttattaatgtttgaagtaacacaaccccatttgcactcttaacggaaggcaaacttgttttagaaatagtaactcacagttcacttacttgctgtgtgtgtgtgtgtgtgtttatccaggtgagtctgcagatctggcaaagaagagttcgtggaagacttcaaggttacactcctggagtatgccttggccatgtcaaagtgctaacagtgcaggtagctttttgagttctactgcagtgccagcacttcttacattaccatggtgatttaatcagaggccgctgagtcccctggtttctgcatagttagattgtggatgtttttgagctgctccttgtaatgtgtctcttgtgttaaggtgcatctagtgctgttagtgaagcagcttacaatctactgccctaaatgccccttctcgcacaggctacttcttaccttgcatttgaaaagcatatcttgagaaatgatttgaacggcacaagtttcaaaggctctttcagtgtttcgccgagaaacagatggcggagactgtagtatacagttgtgtagaagaacaagctcggatcctagtagtgccaaagtgctcatagtgcaggtagtttttataccactctactgcagtgtgagcacttctagtactcctggatcaaccaaggtcttgttgaagcaactacagcgcaaggacattgctacttacgatt

SEQ ID NO: 440 - DNA, 2031 bp, mus musculus
gggatcgggctttgggacgcagctcgaggtgacggaccgctgccacaggctcgtgtgcacaagtggtgctgcgcggacactttgggggttaggtgtgcgtgggccgccggggcgcgtttcctgcacgtggctcctcgccgccctccctcctccaccagctaggagagcagagggccaggagctctaggaagatgcgtgcggttccctgatcctggcaggcaggacagcagcgggatggtcgcgcgcgccacctgccagggcgggtcactggcagatcccctacgcgcttgttctggatgactggaccaggagatgcgtacctccgcgggcgcagctgtgatcccagagagttaactaaggtgggaggggatggagctggcaagacttgagaaaagcaaagtacctgagtgtagttgaggggtgccaggcaactcgtgagaaaaggactctcccttgttgctctgaaggtttctggagaacttgtgggtggtcaaatgccagggtgcacgtggggtgtggggcgggaggactcccgacctaccttggtttccctcccaccaacccgagaatggagggagaggcttaagcttggcgcgttttgggggctttgaatggagaactccgtttcccataatgctttgtttctttctgtttaattttggtggccgctaaggtgtcttgaagacctaagcgcgtggcatgactggctggagcacaccctgcgttcccaggaggttcacagatctctactggagccgctgctgaagatgcgggaatagaccagagaaaatcccgaaatggtaaaagactgggtcctctttgcaattttagaagttgtacagcgactttctagtatatatgatggagagcagatgtgttaaagaaaggtattagctagaaggagctttctctggagggctgaggtatggttttgcgaagttgagtcaggttttgtaatatatttttagtggaggcaaaaatctctagttgtaggaacccagttcaagaagaaaagtataataagccaatacttgcactataggaagcagatttcatatttacttcaaaagttttgctaatttatatttaaaatgttttaagaactatcttagtcactaagtggcttcgaaaagttccaacatttaaaatatcctttctcattgaacacatttcaagttttgtgtccctgaagtttattggtgtccccccatcaacacaaacattccatcatgggagggagggagctcgtgacccctcagactgtcctctgcagcattttcctgggtaagatacacacttggaaatgagagaggtttttcctgtggaagataatgacatgaagccaaagagctaatctgacttctttaggtttaatggagaaaatgggtccataaatgtttaaacagaagtagagccctttgaaatagatgaaaatgtgacatctctaggccatctgtgcggtatgtgaagagtgtaaaactgtttcttaaagcggctctgaaatttctatcattttctcttaatgggctgggggcagggatgcttcatgtaatcaaacatagagaccttccgagtggctccccaaagctctggatgagctcaagacgtcagtactcaccctaatgttatttatttatttttttgcttacatcttttcctgggctcttgcctcttagaaaaccatggtggatattacagctctgcaaattttctgggatgcgaatctcaaatttccttagacggagagggagtccaaaatcctcttactcttaagagtcagacattctgagattgccagtgttattcatgtttaagtctgtgtaaataattgagcttattaatgtttgaagtaacacaaccccatttgcactcttaacggaaggcaaacttgttttagaaatagtaactcacagttcacttacttgctgtgtgtgtgtgtgtgtgtttatccaggtgagtctgcagatctggcaaagaagagttcgtggaagacttcaaggttacactcctggagtatgccttggccatgtc

SEQ ID NO: 441 - DNA, 2031 bp, mus musculus; identical to SEQ ID NO: 440

SEQ ID NO: 442 - DNA, 2031 bp, mus musculus; identical to SEQ ID NO: 440

SEQ ID NO: 443 - DNA, 2031 bp, mus musculus; identical to SEQ ID NO: 440

SEQ ID NO: 444 - DNA, 2031 bp, mus musculus; identical to SEQ ID NO: 440

SEQ ID NO: 445 - DNA, 44700 bp, mus musculus
cgtcctgtgggtcgtgtgcgtacggagggaggcaacgtaagggcgctcggcgagcccgtctctcctcgaatgaaaggaaactacccctggcgacagagccccgctcttcggcagtgccggagaaccgactcccgccttccccgtcttccctcgtgggcgctgtcctcccttcgcccagccgtgagccccactggtgagttccccgcggtagccaggggccccccattctctctctggcgggagaagacgaagaggatggcggtggccaggccgccgcccctgcccgttgttacgggggggactggcggtggtctccttcattgtcagggacccccagaggcgccgcgcattgtcggtgctccctacagaggctggcgacctagtgccgtgggggcgctgagggacatgttaggcggcagcctagacttcgggggagggggcttcacatcggaggagagaaatactgggatgggggcttcaaaaaaaaaaaaactctgctgacgcttagatggtttcagtggtaaggagggtgactacttccgaagtgtaagagaaaaaaaaaatggttaggatggcatgagggtaagccttacggaatgagggggagaaaaagaaaaactccccagtaaggggaatcgggcgaaagtgatggataaggagatgcttcggagtcaggtccttagaggacgaactcctggggaagggaggagtgtgaagaaggtgatattttcctgaattccagagacttggccaaggacaatcggaggggggggggaccccgactttctggctgaaaggaacctactgaagtgttgggaaggaagagactttttcgagtttatccagcgccttggttagagggagatctaggaggctagtgtgcgattggggaatacataacggagagaatccgctctgtttcctgcctggtcctttattacatgggcgaacagcacggcgttcttttgcagtttctattcgtttcgatattctgtgtgaaagtgaaaaacaaatcttttgatgtttgaaaagcctttaattttcctctggttcctacgtaatatcgggtcttattcatacagttcaaatttcttcactaccctttggcttgaaacaactggaaaattcctttagtttccttttgaataaccgcaaaaaaaaaaaaaaaaaaagcagtgcgaagcatgtaataatatcgtgcaaccaaattcaggtgcccttccggtacatttcctattcatttatttctcttcactgcaactttgctgagagaaagaccgtgttatctttggaggatcgcacttatatctgtgaatttcaactggcttgcatgcggaaggtttttcatcttccggaactgcagttttgttttgtttgtttttttcggtagaaaacgttcttttaagatactagccattgactaagctctcgagttggttctcgaatgccctccttggtcatccaggtggtttctacctcgatgcttcacagcatcttggaaaatcggaaatgcattcattgtttcagcggggtttctttttcagacatttaaactgtatttcccataaaattactgttgtttctttcacctttacacattatccataatgttacctttctttgaaacatctcattgttgggttaaagtattgaactttgagctttgcctgttcttgaaaaacctttaaattaaaacgaaagcgctcaatagatgtttttgagccccataagtaatgctgattgaatgtccttattctgcttaaccctagaccacaagtgtgacagtagtagataaaaatctgtattttttttgatagacagttttgctaggcgtcattgtttccatgatgggctctgctgctgcatggtttataaggcagatgtaaaaaatcagcaagctctgcacacatgcattatttgaattttagtggaaaaatccaattagtcattgcatagcaaggcaaatttttaatcgtttgttgcacatttgtgtgtttctgttcactttcaaataaaatataaattaccaagaaatgtgtgaatgctttacaatgcaaagtaagtatatgtgtgtatgtatgtgtgtgtgtgaaaatatatatatatatatatatatatatatatatatatatatatatatatatatatatattctcttttagattttggaatctttggtatctagaaaagcaggttctgaaaattaagatgaaaaaatacactgtttgttagttaaaagaggcaatagtgaataaagatagaatggagcggggtaccatttcagattcaatttggggaataaaggatgattttccctctaagaattttgcttatcttcagccattttttaaaagctagtgctgggattgtttagaaacaacacattaaagatgcctatgaagataagatttgtaatgtagcatcttttcagctgccccggctgacctggagaaatgctgaatacatacatcatggtgacttaacagtgcctataattcattgcatggtagtaaagaaaacacatttagaactccagtagcagatctgggtgctatttatgaatcttggtgtttttgcatagctctaaaaactggagcagctatatttttcataaagcaagtggacatatacttgccagagcaaatgcaaacacacttcctcttttgtttcttttgtttctctgctttcttctttttttttttttaatgctaaaagctttgctgcctatttccaattagtttcagggtttatagccagtgttctgaaatcagtattactgagaagtaccccatggcacttggaagactggggtatttaaaattataggtagcattaagagtttgttaaaatcagcaaaggagagacagcaaaacctttgaagtctcgttcaaaagcaaatagtggatataaattaatgagaagaaatgttttctttgtggcttcatattactttacatcctgatgatcctccgtgaatggctctgaatggcgcattaccttgctgctgctgctgctgctgttactgctgctgctgctgctgaagagatgcttctcagagagttaccaactagttagtgagccatgtctctaagcacaatgtcctgagaatatttaaatgtatataaatggcaataactgaataaactaatttgaagacagacgtttgagattctattgattgtgatgagtgttatgccaacctgggtctaagctgcttattcccagtaattgggcgaattatacagatcaaaacactgatttgaaatttgttgagtgatggtattaaatgatgtctgttgagaatgatgatccaaatctgtagacttctgtgttacagcttttcttcccttttttggtttgacggtacagcctataattataatctgatcaaatgtgaggctcattcagaattttccttccacttcacagcattgctaacttatatatggaagttagcattgctaacttatatgtgaaagttgctgcatgtaggagatcactatcagattgccttttaataagtagacttgggataaatctcagtcaaataaaatggtttagtaaatagtgggatcctaaagactgcattttatggtacacgagtagaagctttattatttcattacaagaaaagggaacaatagcaatagtctaaggtcaaaaacatgattttcttatatttgaagtatttcaagttttaaaaataactgtttcaaagttatgcttaattttacttttaatactttattcagtatgtgaactggacaaaatcaagcaactaaataattcagttctctcaatattttgtagttttctttgtagttttaacttgttcttagatcttcatcattctgtttccttggtggacatatatctaaacttgaaatttatttttttatctttaattatactagtggatgatttaattttgtgattttggttttctggatggtcctcaggctcaccttgtggtgcaggcaggcctcttacttatgaccttttacctgaaccgaagctgtgttatatattcttatcacacaagaggaatttgatttcacatcttctaatttggatttattttgatttctctcaatgactctagatttgattgctttcttgccacttctttttccctttcttaacatctattatgtatggaaggcatcttgggtttttgatatttatctctactagtatttaagtaaactatattacaacctgggtcagatatagagctacttgtgtggatccgtataaggtcattttgaatggaaattaaccattttgttgccgtttttatcctctatagcatttcttgaggcttaaagtggcagtctctaaacactttaaaaatcatgtcaagctcaattgaacagaaaaaagggtctacgagacagcgtaaatgtggcttttgtaagtcaaatagagacaaggaatgtggacagttactgatatctgaaaaccagaaggtggcagcacaccacaagtgcatggtgagtatactggcatccatcaaggcaccgaaaaaccattctcgagaaataatcttttttttgttttttgttttttttttttttttggtttgtttttcgagacaaggtttctctgtatagccctggctgtcctggaactcactctgtagaccaggctggcctcgaactcagaaatccacctgcctctgcctcccgagtgctgggattaaaggcgtgcgccaccatgcccagttcgagaaagaatcttaataactaacatattagtattactaaatatgaaaagcaaaaaaaaccggttagatttgtaagaaatggtttaacactatacaatgtcattttaatagaaaatttatttttaagtttagcatcttagtcattgtcttgatgtaattatatgcaaactgtaattttttcaaatgttatttatagctgttttcgtctgctttggtgtcctcacattctgataatgagagtcttggtggattttctattgaagatgttcaaaaggaaattaaaagaggcacaaagctggtaagttggtatttctgcctcttaagcttagaattacttaaaactcacgaagaaggaaattacttattttaaagtgttttactttgtagatttcctataattttaaattgtgggctgtttttattttctagcgagtaaatccaaagcttggtttgtttacaactcaacaaaaaggagtgaatcaatatcttgaaatatttcttctccaaaggaaaatcttaaagcctgtgattacttacaaaataagcaggttacttaatttgcatgtatcatgtttcaaatcttcattcaaatgtaattttcataattctggtatgtcttcccttttcatcataaagttaggatgggtcatcacagactgagatgacagtggcccagtcagcagggaagtgataagtcttgctaacagaatcttggtctggggtttggctatatgacacagcatctatgactttggataacttttggtgaattttccaggaatttttccaaagctacgctagagttatgttcctgtagttatctttaccaccagtaaccagtgtggccagctgttatattggtccttgggaaaagtagcgtaatctcaattggtatttacaacaccgacttatcgtgcagtgcttcattgactgaaagatttcttttcatttggctgttttttcttgtttgatctcttaattggaattacatccattgttgtagtgagatcttaactgtgaatgctatcttatcatcccaaccctaaactgtaaataagaatagaaaagacctggggtttttaaatgtgatttccctttgatgacttttctttgcttcatgtaactgtagtatgctgatcattttaaagggaccaggataccatatttttatttcctggtccttaaaagtaattcagattcaattagagaatgctatttacttgaaaatagtgctgtaaaccttatggcttagcataccctttgtcattataataacccttcctgttcttgataagataaacagggcacacttgataatgcctccggttctcaaacctggtatttgcccctgttactgacagaggattaagaaacttggtgccatcattttgaatgttacatgaggcaggagtatacatctgtcagtggtgctgtattcaatcgagatttcatttatttgaacctgtttgtaaagaaaataccagaactggatagaagttttactattaggaactattttgttttgaatgtcataaactggtgtgttaatttctcccacccccagccccaccccaggagtagtgtgctataaatagctcaaattgctccttgatctcgtgagtggaataatattgagggttaaatgcctagaaatagtaataggcttgggcttgaatcccatccctgtcactaactgggtgaccctgagtaagttatttccttccctaagctgggccttcttatataagggatagtgcacacacctgactcacaatgttattactaggattaaaagagaatacgcaggactaagcgtgctgctcagttcttggttaatattaagatgtgaccaatggtagccacctctggttattctttacagataaaatcctgctaatgtcatagaagactaattgaaagcatgctaggcagacaagtcatgagatgaaatatttttaggtgcttgagattgaatccatggcttaaatatgcagagcatatgctttactcctaaacgacacccccagccctatagctttcttttctgggaaattaccatggacacattgttatctcagacaagtcactaccttccttgtcttttgctgccgatcagtagatactgttttatcatcacatactactaaacagcaatgagaagaaattgttataaaaggtagaaggatttaccagaggctggtgggaatgactcattgatagaagatttctcaagcatgcacactattgccagcactaatgcactaagagttacgacttgtttcaaaggctacttgacactgtggctgtcttgaattgtgggatagcggcaattcggcatccaaagtcttagaatttaaattactcatttggtgaattgggagagcaacatttatctatttcagtttgaaatgatttcttaaatttaaaatttttggtttatttaatgtgcctgcatgtttgcctgcttgtatgtatatatgtacgtatgtgcactgtgtgaatgcctggggcacatggaggccggaggagggtatcggattcccctgatattggagctgccatgcacgtaatcttctgaaaggatcctatgaaagagcaacaagggcccttaacgactaatccatctcattagccccttaaattttcctctaagatttagttttgtttcacttatgtgtacaggtatgtttatatgagggcagcttcccatggagaccagaaggcagcattcattgccctggagcaggaattataggcagttatgagttgcctgatgttaatgctggtagcagaacttgaatcttttacaaaagtaatatatactcttaacagctaaattctctctccaggcactgacatagcttagcttgcagttttcttccttacattatattgttttctttttaatgaggtactgccaattaaccaatattctttattttagttatctttactttccctggtatagctttgtctaagcaataaaaggacctcagttcatataggagagaataaaaaatagctttatatatctaaactatgtataaaccaagtaactggtttccctgggcagctttttaaagcatttaattctgtgagcctttttgccctgactccagttcctgtgcatctcgagatgaaaagggtcatgagtacccactgaaaacagtccaaagcaggagtccagtctgctgtgtgcattcatggtcaacttcagccagtacctgctgttccttctgaaggtgttcatttgccccatagaagaggagctgactcagggcttgatgcaggatgcaggtggctggatgggaatcttgcagaggcggggatgctcagtagagcaagaaatgtgggtagatggttcctgcaggtatacagctcctctacccataagcacttttctcacatttccatatcagcttcaaggatcagagatggaaagtcattttgtatgactgtatttatctcttttctccattttattaagtacataagcccaaagctgtgcttggtagagcacacctttaatcccagcactttggaggcagaagcaggtggatgtctgtgagttcaaggccaacctgatctacaaatggactccaggaaagccagggctacacaaagaaaccctgtcaccccccccccaaaaaaaaaaaaaaactttaactaactaaataaaatatataggcccaagatataggaagaaaaaaagaaaataactatttgcagttcttatttatttttcccataatgacttccagttctttattgaagacatataagatgccatatctgtactctgttccagctatattttgtttttgagtcaaggtttcatgtgaccctggcaggcctgaaactcactgtgtagctgagggtggctttgattactaatccccctgacccctctttccaagtgtcgagatattatacgtatgtgctgtagccacctgataagtctatccttgttcaccacggagacaaaaaggtgatttcccagggaagttctaagtaatggttgctcgtttgaatttgctgtgaggagacagtggagcgtggtatttgattagaagaatggattctttcggaagcacctcgtgatagcactgagatctcaggctgagagtcacttttactaattgctccctgggtcaggtcagagagataacggatgtcaaaagaattccggaggtcacgcagttcaccttccttacccctaggcaagatttacctaagccatccaggatgatacactcctctgccctgttcgggtgttagcagactgattctctactcaagtcacatgaaatacgaacagtattgtatttgagaaaatcatccctctgtaattttagtacatctcttcatttgaagctctttattctatttccattaacgaactattcaggattgttgtttttttctccctttatttaaaaagaatccttcctatacacaatggccattctcacatgattctgaaactatcctattttcaaatgagaattttctactacaccttatgaactccgctgaatggatttttttaaagaccttttatttttattttatatttacacgtgagtacactgttgctgtcctcagacacactagaagagggtatcggatcccattccagatggttgtgagccaccatgtggtttctgggaattgaactgaggtcctctggaagagcagccagtgagtgctcttaacctctgagccatctctccagcccctgaatgtctgaatgaatgttttatactttttctaatagtagaacctgctgatacttacggagtacttgatatgtgctaaggagtaggctattttaaatacagatcctgattaatcctcacagtcatactgcaagaaaagaaagtactcattcctgccttatacaaaaggaaactgaggctcagagaagtaaagtctgtggtcatatagctagcacttggcagatcacagatttgaacccatggccagagctcctaatcatcaggttatactacctgttcgttttagctgctccatgccaaatcacatttttaaaaagtatgatggctttctaatgcagatggcaaagtttgggacatgctcagactcctatttaatgtattttgtcagtagcattatcttactgttaggacagaaccctatatgtatgctaggtaaaaatggtctattcttactctggagatattttttgtagtctcggaccataagaaaacacattctacatagcatttatgcagttggaggggggcatgcaacatggcagaggcagggtgtgtatagttatgatctaaatagccaactcctagtgagtgttcattctttttggagggtgttccttatttaaaaggttaagacttcctagagatagtcaggtactggaatgaatgtagaaaacactttgagttttaccagattaaaattgagtaaaggcaggcagtggtggcacaagcctttaatcccagcacttgagaggcagaggtaggtggccagaatgagttccaggacagccagggatacacaaagaaaccctgtctcggggggaaaaaaagaatggttaaaagtttttttttttttttttttaagatcagacaagaattttaactgagaacaaaaaaggcaagtaggattttttggagacatgatctataccacaggttctgtggagaatgaagcataatgattgcaatttactggcctgcttgttctccgttgatgtcctgcaggcatgttaaactacctgtctaaaccagtatttagaaccttcggctctgaactctgagtctctttctttctgaatcccttaccttcagtccttccacatctgttgtgtagattctctctctgagcatgctttgtctttttaaaggtttatttattttatatacatgagtacactgtagctgtcttaaggcgcaccagaagaggccatcagattccatgttgtgagccacatggttgctgggaattgaactcaggatctcgggaagagcagccctctctccagcctgtcttttctttcttaatggtaccctctatcaagttttcctcttcttgtttcctaataaacataaccacttgtacttgcctaactacctttaatagctactaccaggcttgtgagatggttcggctctggtaaaggtacttgccaccaagcctgacaacctgagtttgatccctaggatgcacatggtggaaggggggaaccaacatgattctgagaaagcctgtcttaacggactgttcctggcctgctctcctttctcagcttttcagacatcccctctatgtgttccttcactgctgcttcacaaaagttccttttgtacggctcagctcaaactcctgcttgtcactgccgtatagaccagcactgcatgctttgtagtcaggacacatgggcaagctttttcttccatggtgaactgtggtctccaagagagttgaaaatatattctctttgcctggtgtattatcacatgggcatagtacatgaatgtatttggcacagtgctttaaatcttctttgtgatcagtaagtgggcactgatcagtccttgcatttcaaagaggagtgggtctggataggaaaaagtgagaagcctttaataacgggctgggtttagactggaataacataaaaaaatcccgatttggttaatcggtgttgtagtattgttttgacgctttggcagtttgaaaggggagtagaattaacttcgcttaaaaaaattagcctggttatttcttcagtatggtggggaatgtgtatttctcaaagatgagaaatgttttcgaattatctccttaaccatcactcacccagtgttgttacttttgttatattcttgggcattctatttgtcaggtaaaccttcggttttatctttatatgtgtttatcaaatagtccagcacctacttcgtgccaggcacagtgctagatactttggaaatagacttaaaataaattagccttagaagtaaagagccatgggagagctgggaaagaagaccacagctgatgtacctgagaagtcacaaggttttgtgggaagtgacatctgagcctagtatggtgacccacatcagtaataccagcaactcaggaggctgaggcaggaggaggatgggagctcctgacaagcttgggctacagaggataaccttttcctggtttttttttttttaaagggtggtctgatactgtggaactcaaaggtagaagggaaggtttcaaggaagaagtgttgggtgatggtggatgctacataggttcttataacaatgatccttcaccaacttgaataaatgagaaaaggactggttttaagaaaagcacaccttggcttttataagatagagtctcagtgtatactctgtgtactggctagttttgtgtcaacttgacacagctggagttatcacagagaaaggagcttcagttgaggaaatgcctccatgagatccagctgtaaggcattttctcaattagtgatcaagggggaaaggccccttgtgggtgggaccatctctgggctggtagtcttggggtctataagagagcaggctgagcaagccaggggaggcaagccagtgaagaacatccctccatggcctctgcatcagctcctgcttcctgacctgcttgagttccagtcctgacttccttggtgatgaacgcagtatggaagtgtaagctgaataaaccctttcctccccaacctgcttctggtcatgatgtttgtgcaggaatataaactctgactttaaaattttcctgccccaatcttctgaatgctaggagtacaggtgtctgacacaaggcaaactttttaataaaagactagataataaagttgtaaggccttccccagctacttgggcttaattgtaatcaaaggcaacaaaggcgtttttgctttgctacagttaaacttcatttacaagaacaaaaagcaggccatgttgctctcccaggacatttgccatagagtatttggggaggaaaaagaggtaaaatttccctgtgaagaactttttcttcatctttgtaactgtgtacacgtgcattaggaatgtattcatgcaagtgggaattctttttaaaagccagttgtggcatgcaggttaattttaatgtctgtaggtattttatcagaaatttctattaaagtgaactttgcattcgtggtgattaagtagactaagcagtgctggagaaaactgtctggctattatggaaatgcatttatttaaatgcaatcttttttctttgccttcctgtagtcgttttgcaattgggagcactaactttatgtcatagaattctcatttgtgtttgcgaatggaggagaactaaaaccagtaatgtaaaggcagagctccgctcaggaggtgcagctcactgcaggattgtttgtacagtatggtcaagaacctgagttcaatcctcagaaccgcaaaaaccactggccagtaatggcaaatgggctctgtgtggcttgggggactctcttggtgcttacttgagtgtgcctgtgttttgggccttcttcacagattaaatatagcaagcatcctggcagttcacaatattcacagctgcaacgacccatagctgagaaaaatctaaacaaatatgtttgcacttgcaaaatgcctgaaattttcagctgaagaaaatgggaaagaagcaaacttgacgtgctccagtgggagactgtttttcttatcagacatggtttgggtaattggatcgagttggaatagttgagtactcagcggaaggtcagaggggatagattaggcaagaacttcccagtctaagtttactgtccttcaggttccaagtctccctcaactacttcatttcctctgttactctggtaaaaaaaatatatgacaagtgcttttcattggctctattgtttttttagagatacctagaatttgaagtccaaatctgtcttctaagcaacttgtcactacttttcaaggatgtgagtgttcagattttattgaggggttttagcttccttttagacttcctaagcctgttttgatttgtgatccccttcgaaaagactggttttgaaaacacgagtagagctataatatcacatcgaagcagtttgtaattcataccccatccttggcagtgccattcttttaaaaaaaaattgtaacaagtaatttggtgactgtcaactaacttggtaagccagaggctgcttctgtctatgttggctatgtgaggttttattattctccactatgatcctggagttgtacagcaatattagggcatttctgactgtttgctttaactgtactggcctgctttctggtttttatgggagatgatgttattacagccagaagaactagccaggccgctgtaaggtgagcttgtttcttgtgaagacagcctaggtatgggtgtccctttctttaggtgcttttgacaatttgtttctttgcattacaggctcaggctcatggcttcttttcataccttcttttgcattttctgtattcaaagcagttttctgaagcgagtgtctccaacgcagttaaccacattgatctgctgggagcatatatatgtgctgggagttcctctgctacagctgagctctgggagcctcctctaagggtctccaggtagccactggattctagcttttccacaaacgctttctttttctgcctagccatgaagttggcaacctctttttcattttcttccccgtggctgctgagaaaacagtgtttttccttttgatccttaagacttggtggagacttggtttcattattggccttgttcagttgactgaagcgcaggtatgcttcgctgtctgcttcctacggtccagctaaattttagtctttgagttctttgtgtggcctctcatgcgtgacttggttcctctttcatctgcgggtcagctccctgagacctgcttgtgtggtacagcttaacccacgttagcatgccagaacttgcggctggtcccacagcttctgagcatcctgcagaaaggctgagcggtcccctgtgactggacaggacctcctttccaaacctccaagtttggagctggggattcagaattgaggtttctcagctcttccaggagtaaggtgaagagggggtaaaagaaaaaagcattatcgctgacaatgtttttgcctgtttaaaagaagaccaaccgtggagtgggatacaagcagagtaagccgagaattaacatgtatacctacatggggaaaaggaaattgggcctcaagagaatatttagtaggtaggtcagcctcctctctcttgagccgggaaaggacaccattgttcttgaaaaacgtgttcctgtcagtttagtttttattttcccacatctgaaggcaacagggacacattggaagtgtgatgaaaacggcaactgatgctcttcttctggatggcaagtagtgggaaagagggtgacaaacttcagagcagatattgtctgtaaagtcagccgctgggtacggagctaggtcccatctcacataccttgatgtgctgatgatggtggcaatggtgcggtctcgtttgttttttgtttgagagaagggtctctctttgtatcccagctggcttgaaactcacagacctgaccctgcttcttccttcctggagctgagattaaggcatgtgccactgtgcccaacatgcttctaaattttatttcattcactgaccatttcatacatttatgcaatttatttttatcatgtgtatcctccattaccttcctccagctgctcctagtgtcccccaccttgtcaccctgctaacttcatgaccttccttttgttactactagccccatgagtccaattattgctgcccatatgtgcatgtgtgggaggccatccaccggggtatggggaacctctcggcagccaggtccccaaaggacagtgcttctcccttcctttctaatgttttttgttttagaagaagccatctcttttatttcagaaatggttctccctacctgtcttctttcctagcttctttaattatgatatttatctgtaagctttcaattttgtttctagaagagctaatctgttctccctactttctgtgtttgttgaactgaattgtactcaattttacttttccagttcttgaacatagagctcgtaatttattttgtgtgtcttttgtttgtttgaatgtatgtgagttttgtgcatgtgttgggcagtgcattcagaggtcagaagagaatgtagagctaacagattgttatgaaccactgtgttgattctgagaactgaacctgggccagtgttctcatccaaggaaccatctctattactcactgtttctgagaaagggtctcagtgtagctcagattaactctgaactcaggttgccatcacacaagactctcaacttagtcgccagagttctgctattaaaggcatatacctatatccagttcataattatatttagaaatacctgaaggtaaattaggtaaagtcttccaatgtgtgtgtgtgggtgggttgcgcgcatgcactacagcgcacttgtgtagttagaagacaactttgtagagtcagttgtcttccttctgcctttatgtgcctttatgtggcttttatctcaaaaaggaaactaagtctctggagagatggctcacaaccgtgtgtaactccaattccaggggatctgatgccctcttctgattttctcaagcacacaaacacccatatacataaaaaaaaaaaaaataaggaaaaaaagtttaagtaaaacgaacaccctctccccaaaatctaaagcccccccccaattttctattcctaattttgacaaatattttcttctgtaaaatattttattgatattttgtcctatttttcattgaatagaactaataacaaaataagcttttgaacactttaaaaaatatggtcttctggggctggtaagatggctcagtggtttagctcattggttagtcttccaaaggtcctgagttcaagtcccagcaaccacatgctggttcatgaccatctttaaggggatttggtgccctctactggcaggtgcgtatacctgcagcagaacccttatatgttaaataaaattttaaaaatggtcttcctgtgtttcctatgattacttataaaattgctttctgttaccttagctgcttaaaccacttatttggacaaatctgagtttatagatgccacagtcatccctcccccaattattcaaatattttggtttcctttgctttctcagttgagaggcaggcattgaattcattggcggctgcactattcctgatacttttgaaaacaaatttttgtataacaaaatactgaacgttgtagaaaaatcagaaaatacagagaattaagaaaatcattcaaagataacaacccaacattttgctatttacttcccaccccttttcaaagactatatactggagaccttattgagattgaaattcacatagtttcatattctctattagctttccacttagcatatataaacccattattttgaagctgggatgttactcatgcctgccattccagcacttggtaggctcacaatcttgagttcagcttgggcaacaatgtgagatgttctctgaaagaaaaattctcagaaggagattcattgaaacatgtttcagttgttttaaaattgggactattcaaaacaattctgcaatgaatatgcttgtacagtcattgtttatgcctgttactattttcagtaaataagttggaaatataattgctagaacaagagctataaactttgggaaggtagtatttctaatcctttgctttggaggggttgaaatttgaacctagggctcacacatgtgagcaagtgtgctatgtatgatcttgctatataccccgatcagcactgcgtttctttttatagtaattacttgaagtttcagtactcatttgaagaagtgggttatttcttgtgtagccctcgtgttttctgggaagtacctacattgagaactttttttttttttttttacttacatgggtatttttaaaaaatgatagcatgaatgagtttgagtgtttgatttccttagagaagtacaagaaattttattggaatttatattagcctgctagtgtgtgcatcgacattacttagggatcaagtagtccaaatgttggatcgtaagtttctgtctctttgcttgttgtttgatcttggaggtagagtgtgtgtaatgtagcccaggttggcctgaaactcaaccctgccttagcctcctgattattgagatcagtgtttagaacaaggcgtttggcaaccaggaaacaacgtgaaggttttgttgttgccttactgtggttcactttgatgtggcatttatagcttaggagatggcgcattaaaagcctgctgggtatggtacactgtgttttgtgaaccaaagctattaataatgattgctgtgtaccttttaaaaaaggaattgtttttggggctggcaagatggctcagcgggtaagggcactgactgctcttccaaaggtcctgagttcaagtcccagcaaccacatggtggcttacaaccattcgtaatgagatctgacgccctcttctggtgtgcctgaagacagcaacagtgtacttacatataataaataaataaatctttaaaaaaaagagagagagaaactcttaaaaaaagaattgtttttgaaatatagagctggtcaatcactaataagttcagaatataaggtaaatttgagttgaaagaatctttttttttctgttggcttgaattcataatgcaaagggtaagtaagattaaattaaagcagacaggcatattttcacagtataatcaattagctatcacaaaatatcctcaactcaagagattcaaagtagtatatctttcttttaccctctccactggcctaccctccagttgattttaccagcttccccaaaatactgtagggaagtttttctcaaaagattttcatttaagtctttattaatcttccttaaatctttaataaatcttcatttaactctgattttaagaactctttgccgatgatattaggactggtggcaggacattgtgactgggatagcagtagcatccttactgtggaagttttagaaaaaaaaagtctcatgagatatttttcctaattactggtatccagcaagttctggattgcaaaagagatctaggtttttatagtgtcagttgtatctagctcagctccatgatttatagcatttcaaatgttctcctgaccacagtagaccatcacacatttatagcatcctacatattttgtcagtaaaatagaaagtaccatcagaataattttattcaatttttttcaggagacaaaataaggaaaataacatgaattagacttttttctataaccagtttgcttttcctgacagaaattggaatgtcctagcctgtttgggacagtattagcagaattacatttgaatattgttttgttgtttttccctagatgtgttctctttgtcattgtcctggagcaaccattggctgtgatgtgaaaacctgccacaggacataccactaccactgtgcattgcatgataaagctcagatccgagagaaaccttcgcaagggatttacatgtaactggctcattttgcttggttttaaagcagccccgctgtccttcaggcttttccattttcctccattcaaagcatttcaccgtcactatgaaggcttttttgatatgtatgatatgtaatagttaaagcaatgatttaggaagtgtcacactgaggtttataacataattccagtttatgaataaggtggactgtgctgctcatttttgtaatttgaaaatgaattgaatttagttttatatacttcacattttgtatttttccccttcagggtttattgtcgaaaacacaagaaaactgcacataactcggaaggtatgtttcattagccagttttatgtttcaagagaaaattagagtaaaatataaatgagtagtcctctactaagtttttccttatgataggtcttattattcaatatctttataattggagatgttattacatcagtccaatgtaaatagtcaaaaagagctaaatttttaaagaaaaaaatgccccagaaatcttatgaatatactgaaaactcatgtcatattaggaagaaactgtggtagaggtgacatgtttctccacaggtggttattggattcttgctcccaatagctattacagtgtgagcctaggaatcctagtgcactttggatcagcgtgcactctggtgaaatgtcaacaccccatctctgcttttgcttttcatggttcacttattccatggttcagctcattgcatcatgagctgtcatgatccaaaaatggaagtttccaaaaagaaacaagtttcaaatcagtttgattataatatattatgctttattgatgtcttactgtgtccaatttataagtcaggctttataatgtgtaggcatgtgtagggaaaaccacatttagtattattcatgattttgtgtatctactgggaatgtaaaaacaaatcccccactgagaaataagtggagacatactatgttttttttctagaaagcaaaagtttgtaagtaactaaatttaaaatagaagcttatcaagttattttatagtttgtttccacttaaatttataaaactagtttaataatatttatatagtgttagccaagttggatcaaacgtgttttttttaatttttaaatttttattctatttgaattatgtgagtgttttgcctgcgggtatgtctgtgtaccatgagcatgtcaggtgcccatgagcatgtcaggtgcccatgaagttcatagggaactggagttacagatggttgtaagctgtcatgtggttgctggtaatcaaacataggttctttgaagaccagctagtgctcttccaccagcacactgagccacctctctagctccacatcaaacctattcgaagaatagatggttttggtaaatttagtagcagtataaaatgggttagattcaatctcggattatcctatgttttcatttaaatttgactcaatctttaattttttttttagcttcaaagactgttctgttcaaaattaaaatagatcagatacagatgttttaggaaattgatccttttgagacagggtctctattatttagcctgggctggcctggaacatactatacagaacaggatggcctgaactcacagcgattcacctgcctctgcttcccaaaagtgctaggattaaaggcgtgtgccaccatactgggctttggaagtttgatctttttaaagactaagctaggggttagagagatatatagccatcttgtaaaatatctgaaataagttcctgactccgatactgggcagctcttgaggtctgatgtctttggcttctatgagtacctatactcatatattcctaaaacacagacacacagacacacgcacaaacacacatgtgaataataaaataaatctttagaaaattgatgtacctaatttgattcctggtgtaaatattaaaactggttccccttttgatctcttataatttgctttcataatagaaaattgtactattttcacatctgaagtccacattaatacaaatacttgtgactgctggttcaaaatatagtcatcatacacatgtattaaaatatccctgtactgtatatacatcatacttattatatgttaattaagatatttaaatgaaatgatttagtagatatacatgctaaccatgatttggtcataacacattgtatacatgaattgagttattgtgctgtattctacaaatatgtacagataatagttgaatattaattcaactcaacattgaatattgagtagacatacatgtacagaaataataattgaattttaaaaaacatttttgtgctgttttttagaaagagtatagggctggagattaagcatttgatgctattgtagagaactaaagtttggttcctagcattcacatcaggcccctccatctgcctgtgactccaactccagggatccagccccctcttcaggccttattggaaatagactggataagcaataagaacaaaatacttggaggtgatagagtgtgattgaaaagcccatataactattttcctagtttttcctcacttaattctagaagtgaatttaacatcttttgtgaaaagttctaagtagggactagtagtgtgtctcagtggtaggtggcttgcttggcatgcatgatgctctgggttctaactccaacactacatttaaaaaggacgaaagagccactgcaaggaataactattgtaggcaagcttttctatattccattacttcaagatgttaacgatgtatttatgcagtgcccttttatgattagagtggccatctatgttaatagctgaggattaagattcatgatctgattaatacaagtatatgagtatactggaactagatacttgaaatacttaaagatgattaatatatactgattaacatagctggcttctattttactttctaggcttctgaagccaatactgccatctagtggtagagaagagccactgcagtgcatactgtataaggaatgatgattaaaaattaggttttttaaacatttatttagtgtacgagcgtgtgtgtgtgtgagagagaggggggggggcagacagacagacagacagaaactaacttgtgggagtcagttttctcctatcatgtgtaactcaggattgaattcatgtcttcagccttagcaagtgcccttttctgcctgaatcctctcaaagacgcaaccaaaatgattttgagtgccttttgcttagtgagagtgttctaattctacttcatattttacaagcaacttcaaattggcctgattttggttcatggtctacttctgtagaatattggtcccttttgtttccttggaatatagtgtgtgtttatacttacattctggaatttgaggcataatcttcatgtattgcagtttttgaagatatattttcataattatgtcctgcatgtacatctgtgtactgcatgcatgcctactgtccatggagaagatcagaaggcggctcaggatcccctgtagctagagttcttgagttatgagctgctgtgtgggtgctgggaagagagtcagtgctttgaaccaatgagacagacagctctccagccccagtgttggcattatttatatttagagaatttggctttttagctcaaatttattttttattgagtactttgtcagaaacagctaagatttgttctgatgggaaatgtgttctactttatgatggtaatttatgatggggagttaaaggattttatttcaggcattctccaagaactatacttcattggtctctagggcaaaggacttgatacctgtgacagtttctttagcatttactatctgtagctcaatatttctgatactaatctgtcatgttagccttatgcaacatgaagtgttatgaagcactaaattcaagaatagttttataataaagcaatttaattttccaaccctaagtaaaatattatttcatattaaatgcctgaaactcatgtcatctgttttggaaataaaacttgggaggttaaatctagtatccgaatgagacagaggtatcagaaatgacaccaaggtttttgatatacttgagtcagttactgaatgatgctatttaagtaggcagtgttagacttggaaaaggcttatgaagagagttaatgagttaaactttggaaggtcaagtctgagatatattacgccttatccatgtagggtatcagctaagtggatgggtgggttaatatcactctagttttctgaatagagaccttggctaatgataagaatttgccactgttggtcagtatatctcagacagtagaggaaaagttgcctatagagaaagctcggaggagatgaaggcctaagactgagtcttgaaggctgttaatggttgaaggatgggcctgcaaaggcagaggggacgtgggtagagagaaggaggaaagtcagcttagtgttaaagctgtagggtcgaagaaaggtggagtgtaatcccagaaggaactgaatggttagttttgttcttgagaaagcatccactggctcaatgactatagagccattcgtgatttcagagaaggctttggggagagaagtgtgcccacagaggccagaagaaatcattggagcctctggatccttgccactagacaagcaaaaagatagcattgaaggccttggaactgaagttatgtacggttgtgaatttctatatggatgctggaaattgaatccaagtcctctgcaagaggtggtctaaactgctaagccatctttctagcccctgattaggtagttctaagttcataaaaatcccctgtgaacatgtagagtctccttagcactcaacaatatagagtaaagcagtgcatttgtttcagtctgtgatacaacacggatacatgattatcacctgaactccctacattttataaaggttcaatggttatgtgaaacatactgtggattttcacacatctgtaatgatgcatacccatctttacacacacaaacacacacacacacacacacacacacacacacacacacacacatgcacgcacaggtggaattttctttgatgttctttctttgcattacctagtgtggtagctatgtgtggtattaagtagtgttcttaaaaattatactctttttctattattattattattttttttgagacagggtttctctgtagagccctggctgtcctggaactcactttgtagaccaggctggcctcaaactcagaaatctgcctgtctctgcctcctgagtgctgggattaaaggcgtgcaccaccaccgcccggcttctatttttctattcttaatgggatatttatgcattaaacatggataagagttaccagaatcaagtccactgtgttttgtcatgttgtgctgttttgaaacagggtcttactgtgtagtccaggctggcctccagctcagtatcctgctgctttcagtctgagtgcagacactttgggcatttgtcactatacttagctaagccctacaccttctgtgtttgcctgtgtgtgtgtgtgtgtttggataagagcaatattctttattttaatgttttaaagctattcactttatttttgcacattttacagtttttttgtatgtgtttgtgatgcacaagtttgtgtgtacatgcaggggctaaactcagtatattagttagggttctctagagtcacagaacttatggatagtctctatagagtaaagtaatttattgatgacttacagcctgcagtccaattcccaacaatggttcagtagcagctgtgaatggaagtccaaggatctagcagttactcagtctcacatgggcaagcaggcaggcaaaggagcaagagtcccttcttccaatgtccttatattgtctccagcagaaggtatagcccagattaaaggtgtgttccaccatacctttaatcccggatgaccttgaatttggagatttaatctcctggaacccatagtcactatgtctcaagatctccataccaagatccagatcagaaacttctatctccaagcctccagataagggtcactggtgagccttccaattctggattgtagttcattccagatatagtcaagttgacaaccaggaatagccactacactcagattatcaggcttggtgacaagcatcttaacccaatgagccatctttctggcccctttttactcctttgaaaagcaacattttaaagatagtaagcatggggtcagagaaatggctcagcaattcagagatctgggtcttcttccagaagatcttggctcactacccagcacgcacatgtcagctgtctgtaactccagatccagaggagctgacactttcttctagcctctgcagacactgcacatacatggtacacagaaataattacaggcaaaatgcccatacttggacaatcaaaagagatacaacttcaaaagaagcttaaaattaataaacatggtgctggaaaggtggctccgtgctaagagcacatgccgttctttcagaagacacagtccccagtacctgcatcaggtggctactcctataactcaagctcctggggatccagcatcttcttctggcttcttcaggaaacagcatgaatgtgtacacatacaaaaatacaaaaataaatcttcttaagagatgttagtaatagcaactaggtctagcttataactattactactattctatacttaaagaagtaacttgatagcacaatttgtaaccactaagcatttgagtatctacaaggaactatgattatgaaaggtagtttatttaagataatttttaggttgcagatatggtcacttgaacctttggctccagcactcagtcaaggtaggaggaatgccatgagtccaaggtcagctgagactacaggggcaaacatgtctcgaaaaataaaaagtttaaagaggtttggagaaatgctgcagttgcagagagcctgaatttggttcccagcacccatgtgattcctcataattgtttataattccagttctcagggctccaataccctcttctgacttccttctgcgtcaggcacatatgtaataaacatacattcatgcttgcacatctatacacatagaataaaagtaagcaaaataagtaaaatagagtaaaaattgtactagacatattctcatcagtgatgaatgaatagtccccttcttacaattagaaaagcttatttaaatattgcttatttaaatcaccaaataatacagaggtgttattaaaattagtttaaaatttttgctacatttacttatgcatgcgtgtgtgtgtgtgtgtgtgtgtgtgtgtgtgtgtgtgtgtgtgtgtgtgttttgcaggccatgcacatgccacagtgtgcacacggaggtcacaggacaaaagagggctggctctctccttccaccatgtggaccctagggactgagctcaggtagtcagggttggcaccaagcactcttacctactgagtcactatttcacaggcccccacatcaccaccaaggtgaattaatatttggtctttataccattttgaatactacattatatagtgaggttaaaaatgtttactgtgtgtatgtatgatgcatgtgtgtaccagagagcacctgtggaggtcaggacaacttaagggtattgttttgttctttccaccattatgttggttctgggaatcaaatttagggtaccaagcttgggtgcatgcaccgtcacccaatatgctgtcttgtgggccattaataaataaatacttatagtgaataactgagtgaaacactgttagtggtagaattattttcttatttatgggaaaaatcattgtatttctatgagtttaatgaaaatgtttacagctaactcacaaaatggctttttcttgccatttcttcttgttagagcttctttttgtacttgggacatgtttcattacttgatgagttagctcaatcatagatggctttgaagctgaagctgtccattcataatggaagaactgtctatatcagtgctgtgcagtcgaagtgcagtgacggaaggaaggaagcaggtcaggctgacactgttgcctctggcctggtatggctaattcgtttttgagatctggtcagtgtgactgaaaagtgagattcttttattataactgacctaatcgtgtttaaaagccaaacaacctgtatcacagaacccatttttacggaattacagaatcaaagcaaatgaggttataatggttccaatcaaaaggtctgtattcagttatttgaaacactggattgagcccctttgagtagaacatagaccaggtaggtatcctcgtttctaggggccatttcatgctagcgaaaagtgtagttcctgcagactcatggacctactgctgattgttaaaactgacccatataaatatagcttttgtttctttttgagcagctgatttagaagaaagttttaatgagcatgaactggagccctcatctccaaagactaagaagaaaagtcgcaaaggaagaccgagaaaaactaaccttaaaggcttgccagaagacagcaggtccacatcctcccatggaacagatgaaatggaaagtagctcctacgtaagtcaaacctggtgggctcccaccattgccggcaccctgaagactttcacttgaactgtgtctacagggaacttatactgtttgaagaattaaataagccttgaatccatttataagtggtttcctccttttatatttacagcgagataggtctccacacaggagcagtcctaatgataccaggcctaaatgtggattttgccatgtaggggaggaagaaaatgaagcaagagggaaattgcatatatttaatgccaagaaggcagccgcacattacaagtgcatggtaggcatggttttcttatgtatttttttcaaaaatcatttagctggtaatctaatatggtacttttgctttaaacattgttttagggctttgcatagagaagtatagtaaagtatttctttactcattgctttgacagaatacataggcaacttaagaaagggtttccgaggagtggagtggtacgtttgcctttaatcccagcactagggaggcagaggcaggcaggtctcagagttcaaggccagtcagagcatcatagtgagaccctgtctcaaaagacaaaatgaaaaagaaaagaaaaggaaaatgaagggagggcgggcacgagggtaggtgggcttgtttagtttggattatccggcaagggggagtccatggtgatgggaagtgaggtgcagtggcaggagcatgaggcggctgctcgcgctctatctacaggcaagaagccaaggaccccagtccacgaaatggtgccacccatatttatagtatgtctcctcacctaagcctaatctataaattccctaacagacatgcctagagatttgtctccagggtgattacagactgggtcaaattgccaatgaatacaaaccatcacaagtaatatgttatgctctgaaaagtttttcaagacagggtttctcagtatagccctgaactgccctggaacttgactaagctggtcttgacctcagagatctgcctgcctctgcctcctgagtgctgaaattaaaaggcatgtcccaccactgggccccaaatcttaatgtacttcagacttattaaaaaaacaggatttgaagtaataattatagttaccatattgaaatactcttaatttatagtataagaatttaattttataatcatcattaaaaacatttatgaatatgtataaatgtcttgggcttcaacttataacctagtaaatatcactgttatggtacttaacacactgtatttcagttatttataaattttttttttcctaatagaccctaaagttccttggagagattctgacctgatcttttgagctagatttattgaattactcatctcacttaggattaattttgaaaagttatttatataagaagttgttgcctaagtgtaaagtcacaaggctgagaacctagcactttgaaacctgaagcagaaagaatgtctcaggtttgagttcaaagctaacctatagcacatagtgagacactgtctcaaaagccaaataaattgggcctatgaaatggcccaggcaggtaaaggcatttgctgtctccaggacttggatgtcagaaagaactgacaactgccagttttttgacctccacccacataaagagtcacatatagaaatatataagtataataaaaaatttaagacaacccctcaaaaaagtctccaaataaacagaaattctgtactagagtgcatattagattcacccagaattttctttttcaaaatatatatcttaagggacccccatggattagattctagttatatatttgttttggaaatagaaaataagaaagtattttaattgtatcattaattgaaatttaccaatttaaactatttttcaaaatttgggggaatattaaatagttaggcaaatagggtgatggtattattgaagtctttgttatttaaagctgggtattagctccagttggtaatcttagttgggtttttaattgtttccattttggcttatattgtaatgagacaggaaaatgtttaaaatagttgatactgattatttaggcaaagtctctggaagatttcgaaatgtaacaatttgtaattgtgctgtttaatctttccttgtaagagctgcccagtggtgatggtttgtggtattcttttgtagttgttttcttctggcactgttcagctcacaacaacatcaagagcagaatttggagatttcgatattaaaactgtacttcaggagattaagcgaggaaaaaggatggtctgtgatttttttttatatatttatatgtatttgtattatgccgtgatacctttgattcttgctttaaattaaggatacatctcctatttatccagttattaagaatgttgatataaagcacttcatagttttaaatataatctggtcattggtcactagctttaagaactacaacttgactgcagagaggatcagtggagtgcaaacctttttttcaagttggttttgaaaaatttcagactggtaacaaacaatacaggtccttaccctgattcatcagttaccaagtccttacgtcacttgtactttcaattcttgttgcttctactcttttttttcagcatttgtttgtatgtgtgcatgtgcgcacgtgtgtttgggctgctttgcgtctatgtgagtgcatttggaggcaagaatcagatgtcaggtgtcctgccctgtctctctttaccttgttcctttgatgtacagtttttctctgaacctggagctaggctggtgggctgcaaacttcagtggtcttcctatgaaatgtcttctgtgcttcttttccatttttagattttaattttaggtctctgtctctctctgtctctctgtgtctttgtgtacttgtttatgcatgtgcctgcagaagacataaaagggcattagattccttacagctggagcaacaggaggttgtgaaccacaatgtagaatattgaaccaaacttgaatattctgcaagagtggtgtaaattctttaccactgagcctctctccagctcctacattgattcgtgtgtgtgtgtgtgtgtgtgtgtgtgtgtgtgcgcgcgcgtgcacgtgagagaaagtatatatgtatgtatttaattttatctgtatgggtattttgtctgcatatattcatgtgcatgaaatgcccgtggaggtcagacaatgagtttgggtactgtagaactagagctaaagacagttgtgagccatcatgggattgctgggaattgaacctgggtcatctagaaaaacagctagtgctcctgagccatctctgtagccccctctacctcattttctctgacttattgaagaactcaaactacattttttttgctttttaatcttgtttttccaccctccgtatttatatttaaagtgggaattatagaggcttgagagacagctcaaggactaagagatcatactgagaggacctgaattaggttcccagcacccagatcacaactgccagtaacttcctgtaactctaactccaggtctaacaccccgttctccactggtacctgttcttacgtgtgaacatttgcccacatagatacatacatataaacctaattaagagtaagaaataatttgaaaaattaaataagaggttggagaggtagatggcttagcagttaagagtactgacatttcttacaaaggacttggatcagtctccagcacccacacagtgatcaactgtctgtaactttagttccaagggttctaggcattcatgtagtgtgtgtgtggtgtgtgtgtgtgtgtgtgtgtgtgtgtgtgtgtgtgtgtgtgtgtgacagagagagagagagattgattcagtcaaaacactcgtaacatatttgcagaagatggcctagtgggccatcagtggaaagagaggccccttggtctttcaaactttatatgccccagtacaggggaatgccagggccaagaagtgggagtgggtgggtaggggagtgtgtgtgggggagggtatgggggaccttcaggatagcatttgaaatgtaaataaagaaaatatctaataataaaaaaagaagaagtaaactaggaattacacataaggacatgaacagattcagtttcccctcttagagacataatactatcccacaggaaggactgtagcgtcccatgtgggcctatctggtccataatggctgtcctggatgagatggtccattttccccctgctatgcagttcttcaggctttcctgtgggagcttcagatggttgtggtctttgtccagctccactagaaatgactgtttctttgtggaacttcccatgttaaagtgaaaatgatctgttctttagattcgggtcatttgattgttaattttgatcactttgaaactaaaatccttagtactaaaacctagtcgtcttgtgcagcaagcagtgctgggttgtttcgcagaagtctaagtaggtgaatgggacaaaaatgtagttctcttcatttgaaaaggttagggtgaatgctaacctagcaaccccctacatatactctagtagaagttagtccatcacaatcctcctccgcctctccaataatacaagggcatctgaagttgaataaacttgctatccatttactatgccccccttcctggagaagggctttgaaacattctggaaaagagaatgtttgcctcctgccagtcgctcttactgcgcatgaacctgcctttccagtgggcacctgttcctctagcagctttctttaggaggagcttctctagactccactgagaagctctgaaaagatttctgccctgcccatctcccttctgtacactgcagagaacctcctagtgcagagattgctttcctgtttttctcagtttttccaatcataataggaaaggatctgattccaggaaggaaagggagtcaaaccactaaaatatacaatattattctttttgtgctagtaaagtgaaggagtgtcatctatatttagagtccaactttacatggtgtcatggctttgattacatgccatataagttaacgttgttggtgtaatttttgccatagaaaatgtctactgtttttcttctattcttaatacttattttcgtttatgggtatgttggtctgcctggatgcacacgtgttgtgggtgaccatgaaggccagaagaaaggtttcaggtacacagagctccaggcagttgtaagctgcctgcaacctctgagtaccaggtagcgggagttagaggcatggggagctatgcagcatggttgcccggaagtggactctgatcctctgtaagaacggcaagtacccttaaccactgggttactgcaccagcccctgactgctctcttctgtgtaaactgaagtaattggctaaaaatagaatacatatcattgcctaaaccttgaaatattgcttctgattgttctttctttcttttaacagaaatgtacactttgcagtcagcctggtgctactattggatgcgaaataaaagcctgtgttaaaacctaccattaccactgtggtgtacaagacaaggcaaaatacattgaaaatatgtcacgaggaatttacaagtaagataacgagtgtccattttccttaacatgtcagtaagttagtgcccttaaaaagataacactgagtttttaaattaaattatttattcactttagaacccaatattagtccttcctctccttccagtaccccctcgtgtaaatccttcccccatttcctcttagaatgggaagccccctcttggtgtcacccttcacccccaccctgcatatcaagtcgctgtgggcctaggcacgtctcccactgaggccagacaaggctgtccatttacggatgagatccatagacaggcaggccagcaacaggttcagggacagcccctgctccagttgttgggggactcacgtgaagaccaagctgcacatctgctacatatgtacagggacctaggtccagcctgtgctcactctttgattggtaaagttcagtctctggagtccccaagggagcactagttttttgaatctctagttttgatgatgttccaaggaaatgtagaataccaaagctattgtataaggagtgagaggtacggtttgcctctttccctgaaggtgtgtccctgggctagcactcattcatctgtgacctatgcgctaggcagtggactggagctgctcattcacaagactgtcctcagcaagcgtacagcttattgcgctctctcaagggctctccctttgaattacatggccagacaaatcagtgctcagttacaagttatatcaacacctacaagtagttacaaacacctataatattgaagatgaaagggctaacctaacctgtgctaagaagtgtttgagtttgctcttaggagtttgagctgagacataaagggcaaaggtgaacctagtacaggtgtcctggtgtgtgcataacagataagtacccccacactgagagaactctagctttgggactttgttttgtctttattttattttattaagacaaggtctcagtgtgtagcccccactggcctctagctcacacacatcttccaccttggtgctgggattaaaggcatttacttactttggcgtctaccttcacaactgcacactagtctaaagtctcaacagttctcacctggactactgtcaacagcctgttcattcttcttgtctcctttttgcttctgttcccctgatatcctcagattagggtgtgtgtttgttgtatgtaagttttgctttcacgcctcacataagagagggagacagaatgtattcggaaattcaggatgcccatcactctttgtaatgggatttctacttacctgtgtatctatagtggctccattatttccatcatgcagagtaattggataggaatctctgaacttgatgtgcttttgagacttgtgaaacactttcacagggttaatatgtagttaaacgataactaacattcaattaaacagctcctttgggctcttgtgtttgtggataaagcagttacacattaagtcatcaagccctttgggtgcccacagaagcattctaatgctatcaggcctttaagcaacagatattatgaagattattatgtagacatctaacacaaagcaggaaatggaagacttctactttattgtgtaaggcatgcttagctggaatggcaaacaattcaaatcagcaaactatacctgtctcatcaatatgaattacaaagtcagtataaatttttatatatagtcagtataagttatagacatccaacccagctctgtaatatgatactaaaatttgaaaataagtgttcatgtgatctattgtaaattggtaaagaaaaaccatgtcaccacctcccaggtaaatggtgaaaggacagtttataactttgagtgtcaactcagattcttagattattgtgtcaagggcacttttactaagttgggaatcataatagggtgtccagaagaaatcaacaaatagtttatttattgttgaagtaaaagcaatagccctaacccagggttgggcctcagaatcaccagacttagactgggcctttttggaattgtctatgcgtgtgtcctaccacagatgctttaattcagtaggtttgcaaagagggtcaaacttgaggcaattcccatgttcatccctaacagaacaattagactacacacatattcattcagattaggaccaagacaaaggtaccaacaccaacattatcttcaacatactctgtagagttagctcttgcaacaagaaaagaaagaggagctagagcgtagctcaacagcagcacagttgactaggacattcaagaatccaagttttgttccaagcaccacaaaaagaaaaacagatatataataaatgcagtgattggctcttgttaggtgattatctactaagaaaatgcaaaagaatcaagtataaactcaggagaattactgaaagcacatcaagattgcataatatgagatgctttttaaaaggcaattccagtcataattgttttgaaaatgtaaagaaaaatgtttctttcccctctccctatgtgcacgcgcatacatgtacacactttctccaactttaaaagcacttgcattttgctaagtacccaagagagctatattacattcctcagtagaaggacttaacattgaaagattcctggtcactgggcagtggtggcgcacgcctttaatcccagcagcactcgggaggcaggggcaggtggatttctgagttcaaggacagccagggctacatagaaaccctgtctcggaaaagagagagagagagagagagagagagagagagagagagagagagagagagagagagagaggagagagaagagaggggggagaggaaagggaggagagagagggagaggggggagacagagagagggaggggagagagagaggagaaagagagaggagagagagagggaggggagagagagagaggagaaagagagaggagagagagagggaggggagagagagagagaggaaaaagagagagagagagagaaaagaaagatacctagtcatcaaactaatgtaaaaaccaatataaagttaagcagagttttgtctaaacagtaatcagagcattattaaaaagaattaggaggcacacagaggaaagatgtcagatgtgggaggcagttgcttaaaatctgtcttccatttgttgtatctgggacatttaacaaattctacatctgctttatgattgtatggtttttttcattgtattggttaatcacttttttattggctcctgttttagacatttagattaacttcttggctgtcagaaaatcatgtttcagggctgggttggcttagttggtggagacttgcctagcatgcatgaagccctgaattcagtccctgtcacagcataaaaacaggtgtgcataacactttgaatgttgagacaggtatttagttagctgttcaaagtcatcctctgctatatagcaaactcaggccatatgaggctacatgagagcctattgtctcaaataagcaaaggaaaaaaatcatgtttcaagctgagcggtggtggtgcacgcctttaatcccagcacttgggaggcagaggcaggcggatttctgagttcgaggccagcctggtctacaaagtgagttccaagacagccagggctacacagagaaaccctgtctcaatcctaccccacaaaaaaaaaaaaaaaaaaaaaaaacatgtttcagtggccacctctaaaaagtatttggccatgctaatttaaattgttctttaaactttgtccagtaaaatatacttcttatgggctggagagatggctcagaggttgagaacactgactgttcttccagaggtcctaaatccaccagtggattacaacaatgtataatgagatctggtgccctcttgtggcgtgcaggcttatatgcaggcagaacactgcatacatagtaaatgaatcttttttttaagacctttttttttagatttatttatttttgtgtgagtacactgtagctattttcagacagaccagaagagggtatcagatcgcattatagatggttgtgagccaccatgtggttgctgggaattgaactcaggacttctggaagagcagtcagtgctcttaaccactgagccatctctctagtccccccgccacccccgtaaatgaatctttaaaaaaaaatttaaaaatctaatatatatatatatatatacacacatatatatacatacacacacacacacatatacatatatatatatatatatatatccttcaatccctgcaatatctgttccagatagactgttgactttgaatgggtgtcttcatgcgcatagattatggagagaagtagtcaaacaggttcaaatgcaaaggaatatttctgaatgaagtaacatgtggaccacttaaatatggcctttcttctttaactgccatttttaaattatttgttgttattttatggacatctgtgttttgacttacgtatgtctgtatgagggggtcatatctcctgaaacaggagttgcagatggttgtgagctaccttgtgggtgctgggaattgaacccaggtcctctggaagaacagctggtgttcttaaccacctagccatctctcctacaccctcaaaaatagctgttttagagctctaactttatagttggaaaggcaagggaagttgggcatggtagtacatgccagagagatggggagcgggggagggagacagactccataatagttcttatgtagaagagtaaacatttagggcagtccccaccctatcactctcacctctcccctcctttgtaagcatccttggaaaagtttccaaattctgtccttatctgtttactgccctgattcttactgtgtttccgcttcctcttcacctttgctgtaaagtttaatttggttcaaatgcttaagttagactggggctatgtttgggggaagatgcttaacagatgatggcactgcctaaagtcctcgctctggatatctgaacctgtggtttaaaaataattaatatacatgatgcagtcccaatgtaccgtatttgaagaggagtacagattatctgtgaagctactaagtgttttacaacatgaaggaaaataatgaacaaaactagattgacaatctgggcaaggatggtgcacgtgtgttatcccagcactcagaatatggaggctggaggatcaaggtcagcctcagctacagtgagtttaagggcagcctgggctagctatataagtctgtcttggtgaaacagagcaaacaaacaaaaaagtcctaaattaaggatggcaggagacatagctcattgctgtcactcataccgtcatgagtctgagctagcccacatacatattctaggttggcccctaggactgcctgttctctttggctacataatgagaccacatctcaaaaaaacctcacagagctgtattcagttattataataccccaagcccatcattgctttctgttctattcaaatgttccttgtaaacctttggggagtaaatgcctatttttatccagaactgaccacaagagagtactgttctatttttgtctaatgtagaagttacctgaaaccaggtttgagttagcccaccattagcatcttttttttatcctcccttctttttgttactatatactaactgaataagtgggttttgttacagcacacatataatatactttgatcacactcagccgttactttcttctgcccctccccccatccttaataatcacccttttagtttcgtggtcttttccagcccgtaacctccacatacttggtcttcatggaattgatcttaattaacaggatggtctccacttccatccattttcctgcaccaataaaaatgtattcttgatagctaagcaaagttctagtgaacgcatatactacattttcttcagatcatcttttctgtgtatgtgcacatgtgtgcatgagtgtgtttctggggattgaacatgtacatgctagataaataagtctactactgaagtatattcctaggccttttttcttttctcatcacccccccccccatttttttttgagccagggtctcactgggttttctagtcaggccttgaacttgcattcttcattccatagctaattatcaaaaggcacatacatatacaaggacacactctgccttggtcactgctaccttaatgacatgaagtatagcatcattgataggggaacattggaagtctcgtgcctccagaagtgagcaggattagttatgcagtatgctggttgatggactaaagatggacctgtagcttagcaaactcagatttgattcctagtttatatgaaatggagtaagagagaagcaaagaaaatggcattagacaaatccatagtatggtgcagctgacaagctgtctgtttcagtcgggtctttaataggtcagtgttgtgacatgaaatgaaattgggaggtccagtatagaggaagagaaacatagccaagtaagatgcaggtggaagagctgacccatgaagagattgtagggaaggcaaggacgcttgtgtgtgatgtgacagcattggaagactttgaggaaggctgtatcaaaataaaagcagaaagcaacagtgtatagagaatagatattcccttccctctgtgtgtgtgtgtgtgtgtgtgtatggtgtggtgtattgttcgctcatttgtgttcttctacaatatttgtgttcttctacaatgtgggtcctggggattaaacactggccagtggggttggtggcaagcacctttaatccatcccttggccagagagatgctcagtagttaagaacactttgtgctccttgagaagatccagtacccttctttggcttttggctgaacatatacacacagacaaatacaaagtagatatgttttaaaactgtatctcaaaatatagttgtaaagtatgtacatgaaataactttgtggcttttaattagttcattagtttacctcaaagctgactcttggattttgtttggaattgttttaaaacacagtctcagtccagaacccaggctggcctcaaactcaccaaagccctcctatccataaaagttgtgttttaaaagaaatttcataagtctattttatttatttgttgggaggcacatgtgtgtggcatggtgtacaagtggagatctgaggacaagttctgggtgtctgttgtctccttctgacaataagcatgtgggcctattgtcaggtgccgttatctgatgacatatgatactaagtatgaaggagcaaacccatattttataagagacccaacatcctctgctagtagttatataattatattcttatcaacattagaagaaggatttttgagatgtttgtctttcatcattgtagactctattgtaaaaaccatagtggaaatgatgagcgagatgaagaagatgaggagcgagagagtaaaagccgtggaagagtagcgattgatcagcagctaacccagcagcagcttaatggaaactaggtatggaagttgatttaaagctctgttgtcggaacaccgtgcacactaaaacagaatgatgagatgcagcaaaactattaagcctattgtatagagttcctaatgtggggccaggatgcttagttaggattctacaggctgccctgtagagttgtatttgcttttctttacctggtccgttttagagccataaacaagctatctacttcatcagtaaacatagttaggatatggcattagtaagatacccttgttccttaataatgttatgtcaattatatcaccttaagcatcatattttacttttttttatcatcttttaaacaggttcgtgggacagagagagttagaaaactgagaaaaaacaactataactcctgtgcttcttttccacttttttctaaaataaagggtttgtaactttttactgcccgactcttagatccttcattgaactgcctaaatcaccttgttagttttctgagccttcagtagacggccgaatttgacatattgatattacgtagctgtagtttgcagtttctgggaagcagtcaaaacactattagccctgtgtatactgtcagcagttaaaacagacattgaatgaagtaaactgtatttctggacagaacaaagttgtactgtttagagtatgtaagtttgtgtagtagatccacgctcaaaggaaaccagaagcaagttgtactccaccttgcaaacatgcctctggtagcaacacctggcaatttgggcaatggaaacgacaaatgaagagactcttctttttgtcttggctttgacagcacatgctctaaccatttctttcacgaagcgtgctgaagcctacctgtggtcctttttagagttattctcactgagcagcatggactctgggcgactggtgatgataagctctgagctccagtgcttctgccaaaactctggacagtacacctttctgtgctgtacagagagcttctggcaaaataatggaatcgtatcaagatcaaaataatgtttggcaacatcagattaaacctctttgaaattcaagaggtcagcaatgcgctaaaggactttggacatcatgtctgaaaccagcttctctcaagtgccctgttgtgtggaacacttcacatattggcccagcatatataaggaggtcttatatgctaacattttttttaaaggaaccatctttgtgcaaaacagtatttctttttgactctgtgaccactattttagaaacattatttaatgctttcagtcatcagtttgcttacagattgaataagcttttgtgccctgtttttcttcgagggctcggaagtgttttctcaatcaccagatttttagaaaggctttctttccactggcatttctcactcgtgacacacatccacttacctgctgaagcacatttacatatttctttatggcaaaaccaaaaaagttagttgtggtctgcctaatattaccatagcacctcagtatgaaaggtaaggattctgagttccacatcattagttaacctcccatagtgaatcagatttgcaaataagaaataacgtactaacttgactgtacatccatctattctgtagctggtagaacagcgttttgaaatgtaacaggtggaaaattacactgtgcttattgactgaatttttaaactgcttgtcccttaagatcatgtttgttaaggtgtgtatttacacatttacttaaatcaagggactcaatgcttgctttcttttaaccatcttttattgttattttagaaggaaactagctttagtggattgccttgtgcgtcttctcctttcgctcttaatatgccatgatgtgtatgtgattaattttcaaggttcatcatgacttgaagtgcaaggacagatctcagtttgtttaccaagcgatgcgacttttcccaaaggatctgtactttatttccttataacagcttgaaaaccattcttttttaaatctttaaatcactgtgtctaggtaatttttccattgtgtgccatagaacttacccatggagaaatggagccccttcatttttggacaactactgtaatgattttttttaagaaaaatggaaggtgccaggggtaattatggccagtcaataattatataaaggacttcaaatactatagccgtcagttgatggatttgatatgtagtacatgtatgattttgtatgggtttcttcagccctttctctgccactagcaaccagaaaagcactttaccttttggttggttagataagtggctaactacctgtttttctcactgtggtgtgattggctagataaccttcatttaaagttgaaatgtaaactgaagtcacattaaacactcacgtttggctgtaaacttccaatagtttgattctttgttcctgttttcattctatgctgagtaaaagtgccttacaatgtaaaaattgtacagtacttacgttcccaagtagcagcttcaccatctggctaggcgtcacattgtggtaggagtattagatcaatagacctcagcagtgtatttactgtacaactcttaagtccttaactgtagttttaataagcatgacattatttggcaaatatatggcatttacatcatttccaaaaatactgccattgctgtctactgcgtatttttagcctgaaattttgatgcgtctttttttcttgtttttttttctttatttcttttgttcccttttgtcattattaatattaaaccgtgtaatctttgcaagcgtatattgaagattattctggagcatttattgccttaccagaaatgttagtaagaaatgttctttagagtagaagggtagacttgagtttctatactttaataagacctctttgttcctggggggaggggggagttttgctttcatctcattgttttaaagcccacacaagaaattaatttcatgtcaaggatcagcagttttcaaacttgaggtggttcttagtacacacgactcaagatactaacagagtaacatgatctacagatctgctattgaatcgaatctatgtacttgaacaaatgtgtgaatctcaaatatctcaaagcaaaagtgttgtagaatgttgttgctttttgaaaaagcactgaagttagaccaaggcacagttttgttttagcagacatttaagttaattgtaaagataaggaatgcatcatgggtcaaaaatcaaacattcctcaatgttatgtatattttgttcctgttatattggctttattttcaaaattgtagtttgtagtattagtttccttttaatggtattcttgcatatactattcattcaataaatgagttctggatttca

SEQ ID NO: 446 - DNA, 33608 bp, mus musculus; identical to SEQ ID NO: 41

SEQ ID NO: 447 - DNA, 520 bp, mus musculus; identical to SEQ ID NO: 42

SEQ ID NO: 448 - DNA, 95 bp, mus musculus; identical to SEQ ID NO: 43

SEQ ID NO: 449 - DNA, 2145 bp, mus musculus; identical to SEQ ID NO: 44

SEQ ID NO: 450 - DNA, 2145 bp, mus musculus; identical to SEQ ID NO: 44

SEQ ID NO: 451 - DNA, 1467 bp, mus musculus; identical to SEQ ID NO: 46

SEQ ID NO: 452 - DNA, 1467 bp, mus musculus; identical to SEQ ID NO: 46

SEQ ID NO: 453 - DNA, 998 bp, mus musculus; identical to SEQ ID NO: 48

SEQ ID NO: 454 - DNA, 998 bp, mus musculus; identical to SEQ ID NO: 48

SEQ ID NO: 455 - DNA, 998 bp, mus musculus; identical to SEQ ID NO: 48

SEQ ID NO: 456 - DNA, 998 bp, mus musculus; identical to SEQ ID NO: 48

SEQ ID NO: 457 - DNA, 294 bp, mus musculus
atgatgaaaggaacttcatcctttggaaagcatcacaataagacatatatgctgtgccgccgctgtagctccaaggcctaccaccttcagaagttgacctgtggcaaatgtggctaacctgtcaaacacaagagaaagtataagtggagtggcaaggctaagagatgaaacactaccgggactggtctgatgaggcatgtaaggattgtctatcgcagattcagacatggatttcatgaaggaacaacacctagacccaagagggcagctgttgcagcatccagttcatcgtga

SEQ ID NO: 458 - DNA, 5564 bp, mus musculus
gggatcggcgctctcctgcggcggaggcacgacgcagcgactcagctaggcagagtttcgttgaggctacgcctggtttgcgcccccgggcgaggaggtcggtcagtctagcctggcggtcgcgagtccaactccgggcgtccccgaggcatgtaaggcagcgagtgagcaccccggttccactgtgccgcgccggcagcctgcagacagcatgaagaaggacagcctgagtcgcgccgatcagcagtatgagtgcgtggcggagaataccgaaggcgcctaaaagaaggtgttcaaggcccaagatgtgaagaatggcggccgcttctttactctgaagcgcgtgtgagtgaagaccagtgaggagggcatgtggctctccaccatctgcgaagtggtggtgctgaggcacctggagaatttgagcacctcaacgtggtcaggtgagctgggcgccctgactatggagtccaggaaggtgctgggcaaggggcggctggtggcccaactaaagttaagagttgagtttccccagataaaacctgtgaccctgctagacagggcagaaaaagagacctgcggtggcttcccagcagtcaagctattctggagagctttcgctctgtgtgccccaagtggtccagtggctttgggtgtcttttagggacaaaaccagacaaccacagaaatgtccctccagcccttacttaacttttcccgtacgtggagggatttttgagagacagagtgagatagttatccagcttgcagataattagaaggaaactttaagggtggagcataatgtaaataaagtttaagaaaatgcagaaatgtgcaagaatgtgtttgccaatcacacccacagtggtgactttgtttttatagttgtaaaatggcttctgatagtcttagaagttcagaagtttagactctgactcctagtgttaaacatcgtttgaaaaatgtttttcaaggctaggtactgggaacactgaaccaggaagatccagagttcaataccctcctgagctacaaaagaccctgtctgagaaaagaaagggagggagagtgggtggtagggtggagggcaattgcttctcaaaaggttttctgattgtatcatttagtatctgtggactggtatgatctgacttagaatacctctctcagagtttagatgtgagtctgcactttagattctaaagcctctgttttccctggaagagtcctgcaggtgggtgggggaggcattcctaaccaactctcctgtgattgaagataatggtgttttcttgaagatgctgggatttccccattgtgccttttatcattctctttttaaaacagatgcatagctggaagttaaaagggattgcacagacttttctacaaattaggtgatgagttaacattctgagctcttctttttaaagggatgatcttggtgtcttcatcctgtcttctcattcctgtaggaattccttacaacaaatatgtgtctactgtatgccctcgagcgtcccaggcttgatgagccaatagtgtcctgcacacagatttgctctagttttacggttcgtaatcttgaattctggagcctttgtcagaataagactgtatggccagagtgttcccattccataggtgagttctgtttgtcatccttatagactgcctgaatctatctttggtgaaagtattccatggccattgtgtgctccctgagattcatgtttattccttcaggttagttcagccttgtgtagactttgaaggtacagatagaaccagagactgctgaacacctcttccaaatggtacaggcctgttttgaaagataattatttttctaactaatcaaggattggtaaaaatggtgagggctctgtgtgtatgcggtgtgtgtgtgtgtgtatggtatggtgtgtgtgtgtatgtatgtgtatgtatgtgtgtggggggaggtgtttgattggaatgcaaatttttccatagggaaacaataaggaagtgtatttctctattaagggaagaaaactagtacatcatgcaaagtcaaatttattagaaactcttttggtaagtagaaggaagacaagctaaagaataaattaattaatgaatagaatagaatagaacagaacagaacagaacagaacagaacagaacagaacagaacagaacagagctggggaagtcataggcctcaagttgtgagagcttatcactaatatttagctaactttacacaatgtcagattgtcttctcaatgtcagtgttagtcatttctaatgactcaagtgatcaaaactttgtactttacataaacttaaagagaattagaagtgtcagagagctgtcctataactgttctatactaaacccagataagatgtagtcaagactcaccaaaacgaatggcgtatcagagaaaaaggttgatctttggttattatacaaaatagtgaatctggatatttggaaaatgatttctggtataatcaatgttagaatctgggctcggttataacaatgatatttgagaaatcatttatcttctgacatgttaacttatttctcattcaaatggagagattgagccacttactgagcagaacttttctaaagatgaaaaataaatgtaggtttcatggctttgcaaactataaggggttgaaaacaagtaagtatgcctatgacaatccctactgcaacaaggcctgaagctgcattgtttgtctgagttaatgcagatgcagtgaccccaccctttgttggagcttactcttccagatatggattcctgtaacaaatgatttaacacacttgctctgatattctatagtcatttaaaaaatagaattttgccctttctaataacaatacattagctttagcctgatgactaaattttcatgtcagtaatagtcttccttcatactatttattaatgatgttctaaagattaattagttgtatgccaaatgctatagtacttaatggaggtaattgagcaagacaaaataaaaatgtatacctttggtgaattactagatagatgattattatgaagagccaaagaaccaacagcttatatcaccagtctcttaatatataaaacttcatcatcttaaaggtaaacttatggtgtttttattataagaaacaattgaacatacttcaaaatttacaagccattttcagataaataagaccaaaactgtcaatatagtggatatttcaaatcatataatatccttgggattgaaatgaattgctaaaaagggaatgtttctatttgtagtaacataaatggaaaactaggatactgctatactttaacattgaaatagattttgcagttttgagatggtgtatcatagtagaaattgtttcttgcacatacagtagtgatccatccattggaaataaattcacattatataagtaataatatcatatatagctattttgaaataatgttcttacttttcaattttcgatatacaatatttgttattttagatacatttactacaagtaaaagtgagattctaatagcaaaactgtgataatactaagtgattagtacatgaaaatttcagcaaatcactattagtttacctacaggaaagaacattttattttagaatgacttatactttttaaatgcttttatattacacacacaaacacacatattgtcatatatcacacaacattgggcaaagattatgagaaatatgtcattagtcaattttacattatgtgaacatatgagagtatattggcaggtagtaaaggttatattccaagactataggatatatcctattctattaaactactaatttgtatggaatactgtaggctactgtaaaccaatgactattggtgtctataaacatgaaaaagagcaaaggtgaaaatattgtacaaatgtaagatatacctgtagctagtccttaccatcacaagaacttacagatttacacatacttcttgctgacaggtagcatgaatgaggagtatggaactatcagacattatcatatactgttgtatactttataaacattgcagtatgacatagtgactctatttagataattttaattatttactaaattaatccaagctcattttaaaaatgcaaaatctcaggttgaagtacaaaagctgaaattttagaagttcataaaataatcatcaaaagtttagctaaatttcatcccgaactaacacacacacacacacacacacacacacactcctctgaacctacacatggttaggagtatagctatacatcaccactttcttctcatctctttccatggaacttcttcacaatgaaacatatgtggttctgtcctgttctttctggatcccagacttgtttctagatcactgttgaggatgtccatgaagctcttgctgaacaggtgccactgtcttcagaaagatatgaaggtcaagtttcccttttcattttctgtgggatggtgggctgtgcacagacagcctgctccctgggtgaccaaaggtctggaaccccaatgatctggtgggtggtaatttccacctgcatgggacagaaggtcccatgcctcctgggtccctggctcctgtcatgtagctacagcctcccacagccctcaccctgcagagaggtatgtggtcattagtcatgtaggagtagcaggagccctcccacatgcaaatcaggtttccccaaagctctcagaccaaaccaatgagagatacctgttgtcagacacttacccaccctgaaactttatataagaaccctatccagaaggaataaagctgtgcaagaactattctgtcatcggaaccttctgtcctaagagctgttaacccttaggaagaggtctgttctctggaagtgatgcctgaagctccactgcactcctcactgactagtcggtcttgtgtcagcccagctagacctgactcagtgcagggtggtgtggagtaaccaagtaacctggaagacacaacaagacagaggtggagccaaatgtagcagcagaagtggaggaagcaacttcccctccctcccggcacttgttaaccttcactggaactctagcaccaagcagggtcagagatctccgtggaagcctctggtacacaggcccacaattttgtgttatatacttgcttgttaacttatcatgaatattgaacattcttctctatggaggaaggtctttctgtgttgagatatatgtttgggaatgtttaagcatcttcttgaggtaagtgcattttctacctattcttcttcatagttatattttctcttataatttcttcagttatgtgttcatcaccaagttctagccaccctcaattacttgggaaatatgagtaaaatctgcttcatttaattctcatccacaaccaagctaaacttgtttgccattgcacccacaaccttattgaatttgtatgcctctaatccttggaaaatcctctgtactcatggaaaaatctaagtgctgtaaaattaataaataaaatgtagtaattt

SEQ ID NO: 459 - DNA, 5564 bp, mus musculus; identical to SEQ ID NO: 458

SEQ ID NO: 460 - DNA, 19276 bp, mus musculus
cagttgccggtgagcttgggagagccgtgggcgcagaggcggtgagtcccggagcggacagagggcgtggctgtccctggggcgcgggcgcgggtaacggggctcttttttgcaaggctggggccacacaaactggcaaatttcatatgtgccctgggagccaggccccaggagcaaagaggagcggcgggctcctattcgttcagggaccccgccgccgctccctgcgacctggccaggccttgctgggagtccacgatggcagggagtgcccatctgggtggtcggacattgtcatccaagagctcttggacaccacgtccctaacactggcatggggttttaaaccagcttttaggcttttcagggacatgtcacgcctgctgtttccccaagtgccctctttgattaacggtgccttacgggtaggccctgtgagggtggattcagaggcaagcttgggggcggggggggggggcactgttccttaatgaagtgaagtttttactatgtagggcccaggaaagaaacctagagaaacacttccctggtagacgtggtggaaggttttgggtcagccaggagaggcttccctagccagctgtgcgactggagcagcttaagtactgggtccccagccaacagactgcagatccttggatatcctccagcaacggttccatgcctgggctcaggaaactagaagcttcctaggaaggagtcttgaccagcaataaacttcacttgagttctcgccttgtgccaggcgggctgctattcactttctgtgccatttgatcctcgaaggattattttttatgacgttgatgctatcgttatgtgcttgttgtaaacagaggcatttgggtgtgaggactgcacagcaaattatgcctaaatacatttggcacagaaggacaggttactgttacagtgatggttgatatgaagtcagtttcagtccagttgacagagtgggaagaggttccggactcttttccttgaatcctcttcaaaaaccttaaagaggacaggtataagagttgtctcaaccaaaaaaaaaaaaaaaaaaaaaaaaagtataggcagaggcaggcggatttctaagttcaaggccagcctggtctacaaagtgagttccaggacagccagggctacacagagaaaccctgtctcgaaaaaccaaaaaaaaaaaaaaaaatagttgtctcagtagatgggggagggggcatagtgtatatgcatattcaggtcctgagccctggatagacatgtatacaaccaaccctgtgacctcagagattgcactaaaaatatcttgacactattagttatttaggaagtaccgtattgtccctcctacatttcttttgaaatctccatatagaaaaatagaatgacttggaattagggtaggaatggaattaaattaaatcagtggggccttaagaaaaggcagggttcttacctgtctctgtaagatattagagaagtgctttggataatgcgatttactgagccccttacatttatctggcatatcggaggaagcaaattgaatttttggttaaacttacaataccatttggtgtccttgtcatataagatagagctttctagactctagctagaatttagaggctatgtgagtttcctggagattttgtaaatatttgaactgtatctacaattgattgtgcctatacgtgttcttctgggaagtaaggccccagctttggtctgattctcgaaacccccagaaagactgtgaggggatcctttaagtctctgtgggaggaaagccagctccgttgagctaaggacggtgagtgtgccatgttgtaaccattgctctctctccttttcatgtcttcctgtcttcagctgtaagtgactcccccagattattacagagaggaaaaacctggactctgagacatagaccccagataaactgtaaactgctagaagaggtgatggctgtggccctgggctgtgcaatccaggcctccttgaatcagggctctgtgctgcaagagtatgacacagactgtgaagttttccgacagcgtttcaggcagttccagtacacagaagctgccgggcctcatgaagcattcaacaaactctgggagctttgctgtcagtggctgaagccaaagatgcgttctaaggaacaaatcctggaactgcttgtgctagagcaattcctaactattctgcccacagaaatagagacctgggtgagggaacactgcccagacaatagagaaagagttgtgtcactcattgaagacttacaaagagagcttgagataccagaaccacaggtgagaaaaaaaaatgtggggtctctgttcttaggggagcaaaaagaggtacccaggctgttgagtctgtatccaacatttggattctgatcccacagccccaagacttctccagagacttttccagtgttctcttctgctggaattagcatatgggtctgaggttctccagtgtatccatatctagaaatttcaatcacagttaccagtgcttggctctatggcgtgctcaccagctcctgccacagtataattgcctgtgacctctaagttcctacttgtgtcgcccttgtaaatgaattgcttttcaaaacagaaggaggaggagaggaaagagttaagtgcggcccacacattctaaactatgtattatttggttctttccagaatgatctgtctgtcactgagtcaagtagagtctggaaagaatgcaagggaaggcaacatagtttagtgtcaactgatacactttttctacaatatgtctgttcttcaggggaagacatcatgaagtggtcacacgccagcccctctgctttcaattactgtgttgggagaagcaggaattctgcctgaagttccagggctttgagcagtgttgtccccaatgatgtgatttttcaaaatggcaaaaaaaatgcgtttttttctctgatttgtgcaaaagtgataaaaaaaatatgcaaaagttacttagtttctacctgattagcagggtgtggttcttgctaggttcttttcatctacatgtaggtttgaaggagttgcatgtttgggagagtgtaggaagagatctgcattgtaagcgatgtgctgcccgtctctgacccattcaattccagtagcactgcatgccagcatattgccttctgttcagaactaccttttggaagcttctattcagggagggcataggtaagcacagggcaagctgaacacagagcagtcttcccataaggacgtagcaagagcttccacctggcagtcttaattaggccttggagcttgggatggggtttgctggagctgttgacttcagcccaagtagcggcttgcataggaagtcacctggtatgtgagtgcttacaatgtagccagtggggctgaaattagctgtgagtatcaaatgcatactccctgtagagactttgtacacaggaaggagcaggtggaataacttgctagtaattatttgtgttggttactattgtatattctgtaataagcacatcctagtatagtcaacacacttgttttgttggttggttggttagttgttcattttttttcttttattaaatttatctattcatgttacaacccagtatcagcactttctctcctcccattaacccttcatgtaagtcctcccctgattccccttagaaaaagtccctctctgggtgtcaaccccccactatcatcctcccacacctcccacttccccaccctgcacatcaagttgctgcaggaataggcgcatcctctcccactgaggccaggcaaggctgtccatgtaggggtgcaggatccacaggcaggcaggcaggcaacaggctcagggacagcccctgctccagttgttgggggacccatatgaagaccaagctgctcatctgttacatatgtgcaggggcctaggtccagcccctgcttgctctttggttggtgattcagtctttgttagcccctaagggtccaggttagttgactctgttggtcttcctgtagagttcctgtcctcttcagattccgcagtctttctcccaactcttccgtaagattcctgagctgcatctgtttggctgggggtttccgcatctctttccattgggtgctgggtggagcctctcaggagacagttatgctaggttcctgtctgcaagcataacaaagtatcattaatagtgtcagggatgggatgggtctcaatttggggcagtcattagtttgccattccctcagactctgctctttgtccctgcatatatatatatctggtgttgttattgttgttgggtttttttttctctctgtatacccctggctgtcctggaactcactctgtagaccaggctagcctcaaactcagaaatctgcctgcctctgcctcccaagtgctgggattaaaggtgtgcaccaccactgtccagcattcctgcatatctcatagacaggacacagtttgggccaaaggttttgtgcgtgggttgctgtctttatctctccactgggggtcctgccaggctacaggaagtggtcacttcaggatccatatccccaactgctaggaatctcagctagagtattccacttagaccctctgggcccttcccccatcccaggtctctggcacattctagggattgtccctaccccccaaccaatcttgcttctctctcccctgttccccctacatatgatctcttctccttgccccgctcccctcaccatcccctcttccaccctcttcttcctttccatttgtttcccttctgagaaagattcaactattctcctttgtgttctccttgttatttggcttctttgggtctgctaattatcctgtagtttatggctcatattcacttagcagtgagtatataccatgcatgtccttctgggtctggactatctcgctcaggatgatattttctagctccatccatttgcctgcaaaactcataatgtccttgtttttaatggctgagtagtattccattgtgtagctataccacatcttctatattctctcttcagttaaaagacatctaggttgtttccagtttctggctattacaaacagagctgctatgaacatagttgaacaactgtccttgtgggatggtggagcatctttagggcgtgtgcccaggagtggtgcaggtgggtcttgaggtagaactctccccaatcttctgagaaaccaccacattgatttccagagtggttgtacaagtcagcactcccaccggcagtggaggagtgttccccttgctccacaacctcaccagctaagctgtcctttgagtttttaaccttagcaattctgatgagtgtaaggtggactctcaatcgttttgattttcatttcccttataactaaaaaagtcaaacatttcttttttattttatttatttatttatttttggttttttgagacagggtttctctgtatagccctggctgtcctggaactcactctgtagaccaggctggcttcgaactcagaaatctgcctgcctctgcctcccaagtgctgggattaaaggtgtgtgccaccactgcccagcatcatttttatttttattttttgttactgttatatttttacagctcagtttttaccctccttctggtcaccctcccacagttcctcatcctattccccctccccccttctccacaaggatgtccccactcccatcccctaccccctacctcccaccccaccagacctccccactctctggggactccagtttctcaaggaggactagaaacatcttctctcactgaggccagaactggcagtcctctactgtgtatgtggcaggcagcagggagggggcctcatatcaggtggtgtatgctgactggttggtggctcaatgtctgagagatctcaggggtccaggttagttgacattgctggttttcctatggggtcaccctcctcaacttcttccagcctttccttaattcaaccacagaagtacttaacttcagttcattggttgagtgtaagtatctgtgtctgtctcagtcagctgcttgttggcctctcagaggacagccatgtcttaaagtacttctaggccatttgagattcctctgttgagaattctgtgtttagctctgtactccatttttttaattaggttatttggattgtctgtgtcttcttgagttctttatatatatttttatattagtcctctttcaaatatttcccattctgtaggttgccattttgtcctgatgacagtgtcctttgccttacagaagcttttcagtttcctgaagtcccatttatcaactgttgatcttagagcctgagccactggtgttctgtttggaggattgtctcctagactgatgagttcgaggctattccccatgttctgttctagtagattaagtgtgtctggttttatgttgagttctctgatccatttggacttgaattttgtgcatggtatggtgataaatatggatctatttgcattcttctatatgcagacatccagttagaccagaatcatttgttgaaaatgctctcccttttccactgtatcgttttggcttctttgtcaaagatcaagtgtccataggtgtatggatttacttctgggactttgactcaattccactgatccacctgtctgtttctataccaataccatgcagctgtatggagggaggagcaggaagaataactcgctaatgattagttgtattggttactactgaaagctggtactttgtatattctataagaagcatatcctagtatagtcaacacagcttgttttgttgtggttttggttggttagttggtggtggtagtttttctttgttttttaatgcattgcctactggaacccctgggagcattaaagctatgtgtttgcctcatggtacttgttggtgaggagtgtctgacttcgaaactagccttccttccagtgaagtcttgactttggagtgatgtgttctggcctctctctcagattgacatggatgacatgctcttggaagaactggcgccagttggaacagtacccatgccacccaacttgcacctggaggagccttcactccaggtgatggaacctgttcaggagcctccggtgccggatgcctggattccacaagctggcccccaggatctgaactacagtgctgatgctgaatgccagtcctttctggaccctggtaaggcaagggctttcttttagttaggtgtttctgtgtgagagccaaagagcttggggctttcagtttgggatagaactatgaatgccccaatggcactggctcactgacaaagaggtagagggctgagaacatgaggagggatcctctttttaggaagacctgggagtgaagcacaatgactagaatatccttgggagctggtttatagtgatggccttgcccaaggggattttcaccaaggatgtgacttgggaaagcctctcatgggagttcacagtgaggacaaagttgtccaccaaagtttgagcctatgataggagacccaaaggaacaattgcttttatggtataaaaggcccatgcaagtagaatactttacaacatactcttctctaatctttaaaaatgatctggtcagctgggcagtggtggctcacgcctttattcccagcacttgggaggcagagacaggcggatttctgagttggaagccagcctggtctatagagtgagttccaggacagccagggctacacagagaaaccttgtcttgaaaacaaaacaaaacaaaacaaacaaacaaacaaagatctggtcatttatagagggtgaaaaaagtcagtgtaataaaatcccacagatcaacttaatccagataagctctatacaaactgatgtttaaaggcaactggatctgacatagcaaggaattaggtctagtagagaaaggcagctgaaccatgtagcctgcgtgcctttgtgtttcccttccttttggggttctatcacatcattatccatgttctctgccccatctctccccttgcccccatgaaagatttggctgacgtgtgggctagaacccttattctcattggcacagcttccacatgttagcacttggactaaattgtaggatcttgagacaacaaaagacaagcagaaaatggaaatcggtgagaccaaccagagttacaaaatggaatgcctggagaacaactagcacggagctgaggcctagaattcctctttacaacagtcatatgtatgaattcagctgacactaggagaacctgtgaagagccaggacagactcgggggatgtgttgttacacaaagcatttgtatttattttcgagtagttgtattaccttcattttatattcttttaagaaatcaaatttttctgtatgaatatttaattttagaacgtggccatcatactcaattataaatccatactactcattctgagttgcatgtgatttctttcttaatattgtaggaaaataatcacagagcagcaatattcacattaccattcatgttcattttcatactttactctctaaagcacattgccattcagtgcatttttaaaaatggatataattattaatgaattaagtaaaataaaactcaaaagaaaatatcctgcttaaaattatataaaatgctttataaagtgatacaagacttattatcccattatttaaaatttaaagttttgctttttttaaaaaaatgaaggcatctcagtattgtgtatgatatattggaaattaagtagaaaatcataagagaatggctagtgagaaaataaatgtaaaaatcatataagaaatcagttgagtctaccttaaagtgcagaacatataccctgtcagtaaaaaatgacatttggggatagatagatagatagatagatagatagatagatagatatgcccagctatagtaatgataactcatatagaagtgaagccttcatgacatgatctttgccaagtggagcttagtaaagtgattcgctgaacataggatgagaatagcatccctgaagtaccttctttcataaactctgtttttttatccttcatatttcattccactatatgatttctttcacatcacattccacaattataaatcatctctgaagtttagtagattaaagaagaaaatgaagaggggtgtttgtttaaaaaaatacaattcctacaagttgggaatttcagaagttttacagtgtttctggcttggtgtctgagagctagcagaaccctcaattccttgctaaggggacctctccatatgtgtgttctcatgacaggcagcaggcttccctcatagggaagacatgtgcccgtgatgttgttagtaacctggccacataccttcccttctgcaatattctcattagaacaaagtcacagatccaacccacacttaaaggggggaagaaaaactcacttgatggaaagaagaatgtaaaatacttcaggagcttattttagaacaactattcattcacccattcgtccttgaatttaaaaattgtatccattttcaacaataatttaacaggcatttacttgtgtgtggttagctaggtttaagcacgtgatttcataaagagctgaaaagtacaaacacctgttcagtgcattgaatgtcctcgcaacctttggtgaaactcgggtgactggagctccataggtttatcattggtgtctattctcaagaaagaactacgtgtacatagtgttcattagtgctttcactaaggtttacaatcagatagctcactatgagcgtttctgttaagtctgaagacagtttggagaatactgctatattaatgataccacatttggtgatgccttaacctgagatgtggttctatttacttggacttttctcagatagtttgaacagtgtttttataggtttcaaagtacaagttttatcttgagcttattaaatttatccttaagttattttggtcttattaatcactgtattttggattgtcctttgaaaatatatagaattattttgttttgtttccttttctgtttttttatattggacatgtagcctacaaacatacttagcttgcttattatgatagattctttaggattttctgtatatataactatgtctctatggaaggtaataattttatattgtatgcttcagtctaaatgcctgttattgcttttgttgtgtagcttccctggccagagacttcagagcaatattgagtagaagtagtgagacatctttgtcttgttcctggtctcaggaaaaatgtatttgttctttcatcattactttgatattagctgtgggtctttcataaatatcatatatcaagctgagataacctttctattcccactgtgaagtttttataatttaggtagcgatgttttgaattttgtcttattaatgaattgctctttaactcactataaactaatacccttttggtatcatttttgttttaatatctatgttgtctagctgttttatgaatgctatttataaaatatcccctatcccagcatttgggaggcagaggcaggtgatctctgagttagagcccagcctggtctacagagtgagttccaggagagccagggctacacagagaaaccctgtctcaaaaaacaaaagagaaagagaaagagaaaaaaagaaagaccatacaaacaggaatacaaacctccagtcagaactctgcctgtgcattgaattttttggtccactcatacatagtcttcttaggaataaatggttggaattacatatgctgttttagtcttcaatgtctcctgactctttcattcctctctcttactgctttcttttgtgttaggtcaatgtttacagtgtaacattctatttgctttaatgaacgttcaccatctctaagttaattcctcactaggggattacagtttactattctgctttaactcatcagagttatacggaaaggaagatttagccctatataggactattacttctggtattataatcagattgttatatcaaacatgtttaagccccacaatacatgctataatattactatacatagttctaggaattttaaagaaactaaaaggataaaggaaatgtacattacagcttttgttttttaacattatcatttctgatttcttttatttctttagatggatttgagcaggcaactctagtcatttcctaggcatgtatagatttttctctcaccctcttcatatatgctgttattgacaaatagattgcctttctacatggcaccatgcttgttttcttaactcttttgagagaaaagaagcagagcctttgatatataatgcctttcctaattatatggctacttttatttgtgctactttttcatgtggctttaagttaccatcttggagcctctcacttgcataccttgctatctttaattatataactgcttttaggcaagtttgttagcagtaaattctgttttatttctcagggatatctttattgcatattcatttctgattgcatgacagatgtgttgaatgtagagctcttacttgacagttttcatttttcacacttagactgtgttaccccaccgcattttagcctcccttgcttctaatgagaactgaaaatttcacctcaaactaaattggtacaattaaatctctaactattttggggtttaatgttttactaaatttactctctagtcactttaaaacttttattacattcatttatttatatgtatgtgtataaatattcctgcacctatcacatgtatcctagaagttgaatctgagataccaggcttggcagtaagggcttttacctactgagccattatactggctccaggatggccaaggctacaaagagaaatcctgtctcaaaaaaatcaatatatatgaataatatgcatgtgaacagaaaaatatgtacatattggaatgtggactatagcccaggctgccttggaactcactatgtaatctatattggcttctaacagatagcaatcttctgcctcagattcccaggtgctgcaattacagtcatgagttgccacacctggttagtcatttttacttcatacttttaaaagtatctgttcaatttattgtccatttattgattgtattacttattgttttgttgtttctctgttttccttttttcttagttctttatatacaaactggatagtattcatctcagatgaatagcagagacttttttatttgtcttctaagctattaaattactctgttgtttccactactgttcacaagttttgttttgttttgttttacatgataggatgccattggccaattctattcttcaagatattggagtccttttcagaaatattttactgacacctatatcaggaagtatttcatactttcttctagtagtttaaaggagtcagatttaacattaaggtctttgggttttttgagatggtttccctgtgagctcttatggcccgctagtgttctcttattcaggactgactgattcttttatttattatgcttctgtatgaacttttggggggttgatttctagttctgtgaaaatgtaatttgaattttaaagattacatttactcagaaggccactttgtgcaacagtgccattttttacagttttaaattcttccaatttgtaaatgcaggaagtccctcagtcttctagtatattcctcaatttccttcatacacgttttgtacttttcattatagagatattttacttccttggttaggtttagtcctgggtacttagaaatattttatttttatttttgattatttgtgcattggagtacatgaatccagtgccgcaggaggccagaggaaggcatcgtattccccagatatcagtgccatctctccagcacctgtccctactatgttttgatggtatatttgatggcatggtttttctgattgttttttcaagttcagtagtgttttattttttttaaagccactggctcttgtctggtttgttgattttgtatcctgctgctttgctgaaattgtatcagatcttagattcttttctatctttatgtcttaaatataagaacatgcctgaaaatagagcttcatccttttctgtttgtttcacttttctttctttctcttgccttgttgctctggctaagattacaagtgctgtattttaagagtaatgagaaaggacagagcagagagctttcagtggtttggggaagtctttgccagtagccagatgattggtgtttagtgcaacactttctagattcatttgtggggtttactgtggggttctggagataataataataataatgtacatgtagctatatttgaatcctgaagcagttcagataagaccttaagatggctttccaatactgcaccataatcatacattgggaaatagaactttgcccagtgccagtgtgctatgcaagtttcatgtttcacatctaggctgtactttaattaatgattttgtcttacatttttggtcgtgagcctagcctttaacagccgagccatctctccagcctgactttttctaaaaaaattttttacatcccagttgctgtccctccctcccagttgaccctcacagagtccctccccctttccccttccccttttcctcagagaaggtggggtcccctgggtaaaccccttcatacatcaagtctctgcagggttaggcacatcctctcccactgaggacagacagggcagccctgttggggaacaggtatcacagacaggcaaaacctttagggacattttgtgctttagttagaagtcatgcagaccaagctgaacatctgctacatatgtgtggggaggcctaggtccagcctgtgtatttgcttaggttggtggctcagtctctgagagccccaagggtccaggttagttgactctgttggtcttcctgtggtattcttgtcccctccaggaccctacgtcctttccccagctcttctatgtgacttcttgagctccctccactgtttggctgtgggtctctgcatctgcttcagtcagctgctgggtggggcctctcaaaggacagttatgctaggctcctgtctgcaagcataacagagtataattaatagtgccagggattggtgcttgcccatgggatggatctcaagttgggctggttactggttggccattccttcagtctctgctctatcttcgtccctgcatttcttgcagacagaatacattttgggttgaaagttttgtgggtgggttggcgtcctcattcctccactgaggttcctgcctggctacaggagtggccccttcaggtttcatttccccactgctgtgcttttcaactaaggtcacccgcacacactccagggagccccccatcgcagatatctggcacttcctagagattctccccttcccccaccccagcagctgtacttttgagcttctgcgcactgttgaagatggtgtttttgagtttctccttttgtttgcttcagtcctcactctctgctgtgccattaccgtgtacaagagtgttctttctggtcctctgtcctatttctctgtctatgacatagctggtggcaggagggcactgatgttagttcctctctagctgtgtcaatcctatccccaggaaaagttggcaattattgggtggctctaatctaccatctcgcatggtctctgaatcagtcttgtatagctcagggtgttaatctcgtccattgtttcctctagccgcttgcttcggagctgtgaccctcagttttattttatctagtccatattacccctcacctcatctcttatctttgaaatccaaacaaagatcaaatagtgaagtgggaagtgtatttttctttttgaggcagagtctcactctggaagcaaggttggggtggaatttgcaactgacctatctcagtgtagacttacagcatgtaccatcacacccagcacagaatccatatgagttccgtctttcatttcttagtcttaaaattgaaatatatggccttttgttaaacaaggaatttctgttgctcatgtcttaatctgaaatacaatttttcttgaattagtatttgcttgtgtgtgccattttaataattctaatatctaaccatcagcccatttgtaatctcaggttgaccatttccagactatatcttactatagagtagtatatgtgaccaacaatgaggatgtagaggaagaggcagaaaaaaataagaagggtagatatggagggaaagcaagtcatagaaattatgtggttgtacttagagtgtcagacagaaacactcctggcagtgaatttgggttattttttaaatgccctatctggacttctgttgatacatgaagactactttttgctgccgccaactaagttcaataaaatggaaatgtttctaagaagggtggagtgaacttattccagtaaacaattttctaacacctatgttcacttcactcttctttgacacatgtttacactactcttctttgacatgtatgtttatagtagtcttcttgacatatgtttataccactcctctttgatacatatgtttagattggtcttctttaagcaatcaatagcagtatttcccagattttggtataccaacattctataaagctttgctccatgttttagctctagcatacataaatgttttgtcacaataaatacagaactaacttagtgcatcactccggcacacattgatccactcacctgaaagtgcagaaggatggctttctctattgctgctttgtccttatctttaagaaatgcctctttataagtgattccagatgaaggaacagtaatgaggaggaaggaggtgtgtgtccatgcaattagcctctattccttggtgaaccacattgtcatgctttttcccctttgcttccatgaccaggttatcagttaccaaagcttgacatgaacttcccattggatcatagagaagaaccatgggtaaaagacttagaggatcccaaagaaatgaaacaattacttgattccaagattggtaagtaacgattcctgtatattctggggaaggtgggaaagaatcaacggtaactgaaagtggagctcggagtcgtgctcaggagtttctatactcactactgctctccttcacttctctacccccacacaatgacagctttagtctccatttcttctcaggttttgagatgggaatagaaaatgaagaagatacttcaaaggaaaaaaaactggaaactttgtacccatttgttgtaactttagaagggaatgctctccatggtcccattttgcagaaagactatgtgcagttagaaaaccaatgggaaacatccccagaggacttacagacagacctaacaaaactcgtagatcctcagaacccaactctaggagagacacccgagagccccagcctggaagaacctctcaccccgaagcctccaaagaaaaagagtcctggggacaaacctcaccgatgtccccagtgtggcaaatgtttcgctcggaagtcacaacttacagggcaccagcgaattcattcaggagaagaacctcacaagtgccctgaatgcggaaaaaggttcctgcgtagctctgacctttacagacaccaacgacttcacacaggagaaagaccctatgaatgcactgtatgtaaaaagcgattcactaggcgctcacaccttcttgggcaccagagaacccattctgaagaagaaacatataaatgtcttgagtgtggaaaaaccttttgtcatgggtcaagtcttaaaagacatctaaaaactcatacaggtgaaaagcctcatagatgtcctaattgtgggaaaagttttagtcgcctgacggcacttactttgcaccagagaacacacacggaagagagaccttttaaatgtagttactgtgggaaaagctttagacagagaccaagccttgtcattcatttaagaatccatacaggggaaaagccatacaagtgtactcattgttctaaaagcttccggcagagagcaggccttattatgcaccaggtcacacactttagaggacttctttaagaaccgtgaagggaaacaggttctatcaacgttaacactagctcagaaacagtataggctgctgtagatgtttgtctcataagccttttgtctgaacttgtaagtgcagctttgaggggtgctatttttaaaaatacatctttcaaggtatatgagttctagagtgtccacatgtttgtgcagtttctctgaatttaatatcttctgtctttttctgttgtttaattgcagtggaaaggtttggttccaaggcaaccatatgataagcataagcacaaagcatataaacggtggcagtcgtttataggtaggaccagttaatggatgagtcctggtaacggttacagtcctaccacacttgttttcctgtgtcattatgaaagcagccagtagatagatgtgccccaagtggcaagaaatgagacagtgaattttgtcaacacattaaaattttgtttcagggggactagggtgaagaggatgtcattggcctaatgaacaggcttgtttccaattacagttttatgcttagagaagttgggatcttaagtttgggattttgtggagtttgctggtctgcttagttggctatctgtggtgatggtgattagagtgtggtgactagagtggggtgttctctttataactgtatgctaggtctagcagaagtaacttacagttgatgttgtacaagtagactctgactgtatttagatggactgaagaacaagtctgcatggattttcatcctgcttcaggattctctctggtttatttcaatgcttttgaaattttatccgttctccaagttggtgtttttctaagtatgtgtcatagaatactttgttctgcaagatgttctacaaataattttggggattgcttctagctgtttgtccttcctagactcatgatactcatcagcatatgagcccctgggaaggtcttagcttagaaaggaggctcctcttgtagctcaatgcgttccaaacttatttgaccctagaacatttttcatgtacacatactagtaacttgcagtagtattctgctagtatcccttgggacacactgccttaaaccagtatgtctatagctatcagtgtagtcctgtcactctaaacctagttatttctagtttcaatgattttatgaaaaaatttgaaaatacacttattttgtattatatacacatcatttcaaggacgttaaaaatcactaagtcacaaaatttgtgagttacttagtgatttgtagcttctgtgttttaattatacttagacacacacaacattttaagaggtgaagctcactaattcacataatttatgaattatacagtgattcttaaccttttcgcattttactttataatctcacacacaagcacacacacacacacacacacacacacacacagagttggtacttatataagtgttctcatgtaatcatagtaacaactcagatctcacagtaaggcagaaaatcctcattgagcttagtccttgttattagatacaagaaatgggacagtcaagtatattccctttctgaagctacacagtcatctttaaagtagaactaagggagttcttgggagtaatctataagtatttggcgggtatgtattttgtgcctaatttgtcctgtcctagtcttaatggaagatagtaacaaaacataattcatatgtaaggctcataaagagtttatcatatctctacttaaacaagagttgggaaacaaatggagaacaatgcaagagagagcttgtgactaagtgccaaatcatataaagtgccagagccaggatgtgtcttttttcttggcatccaggtccctgtatgatgctgctaataattctgggattaaaattacaccccagtaacatgggaggagtctgaatgtagagattaaaaatacagaatgtaatggcttctctttctctcttgtggaattgcattcaaaccagaacagtgccttagaatggatgtgcccaactgctctgtatttatacacggttttaataaagtggaaatgtatata

SEQ ID NO: 461 - DNA, 58987 bp, mus musculus
cgcccccgcccccgcgcgtgctccctcctccctccctcccaccctcttgcgcccctccccgtgcgcccctcccgcgccctacatccaccgcccggccgagggggctcagtcctgtgctgccgctgtcgccgctgcgctttggtctcggagctggcagcggccgccggtgccgcctagacagctgcgcgggtgagcatccccagacagtaagcccgctttccctccgcgagtgtgtgtgtgtgtgtgtgtgtgtgcgcgcgcgtgtgtgtgcgtgtgtgtgtgtgtgtgtgtgtgtgtgtgtgcgtgtgcgtgtgtgtgtgtgtgtgtgtgcgcacgcctccggcgtccccggggagccgcagctcgtgctccgtggccgctactccggggctgcgcggacctgctgggcttgggtacctgcggcctccggcctccgctgcctcgcccacgttgggggctgaggaacctggggctccaaggtcccttagggtgcgtgcctaagcctcctccccagggctttcgctcccctgggggccgggatgcaggggggcggctttgggtgtttcctctgcaaggatggagggtgggagtaaaaagagggggcttttggttttctcacccaggatggcgggcagtgggggttgggcgaggtgggaacacctttggtttttgtttttggttttttttttttctttttctttttaaaggatagctaacagcagttgagaagagcaggggatgatgatgacgatggggggggggcttcattggtttttacattaaggatggcgcctgttgggcaggggaggaaggtgaaacctgccttggttcttggagatgttgagggaactgctgtgctccctttggggatgctggggaggaggcagtgggaggactggagtgcaaggagaatggtgatggagggagaaggctggtcgtggttctgctctctgagggggaatggcagtgatatgggggatgggggtgggagaggggactggatttcagcttcagcatggaggcaagtggaaggttctagcacttaggttgagccttggttgagccttggcaaagtgggttaggtagactgctgggtgtgacctttcaatttcagaaagcttaaaattcccactagatgcagttctgggctcctgggaagaggtttctgcttctcaagttcccattgcttagtcttccacaactggtagaggtttgaatgagaaaggccaagggaaacagtgaatgtgctgtgtattttctgcatttgggcctttcaagtttcttgggttcattctgattacaacgacacctccccccccccccccgccatacacacacacacacaaacacacacacacacacaactagggtagcacattgggaacaggagacaagaaagtgtatgaatgtgatttcagatttggttttgggatttcctgaagggcaagagttctgtcgtagaaatgcagcaagagtggaacacatgtctttgctggaagtcctctgttctcttcatttaaatgatgccatcgggactatctgagcctcttttgatttgaatttggactagatccagttttcctaattggagctatcattttgtaattgcttgtaattctccatgttatcaaatgtattgcgagtttagagaatactgggaatatttttgttatcttgattaaggccgtttaaatataaatataatgttccttggaaatgagaatgtttacagagtagcacaagtttaaattatgggccacgtggaattggataaggagttctcatccttgcccatccccaggaacaggctactccccattcctcacatttgaaaaggattggggttggtaattttgtctttggaaatgcgtgcccatattttcttaagaatatgcattaaaaagcaatgggccttaaatgtgctaggaatataatgcttccctgtttccgttacataaggttccaatctagtctaccttcactcttttaaaacatttatttaccatttttaagggcaaatagaatctttatgcaacagggaatttgttagataggccaaggtttgtacaatgcactacagagtaagtgcacattttactactaccgtatagaatctgtaaccatatatggcttctgaaattctaggcttccattccatgatttaatctttttggagaaggaaaacatttttaaagcaagtctagattgggggatgaaattttgaatgtgcagattggtaaaatacctcttatatgagttctttggagatgatttaatatatagtaaattaatggatcacctcaataagatactgactttgtttattgcaaatgttaatacataagtgggtctacaggattaagaaaaatgtatttgcttatgctgttgtatactattctacatttctgtggtgtgtattctgccccagtgcaacagtgagacagaaccgattttcacaatctaagtttagcctggtgttttttgtctgaggaataatgctgaaggtggtgaaaaggaacagtatgttggtgggaaaatgggccttaagttgctctctaaacaaaaggagcaaagggagtcttttacttggctttttgagaacctgttgtaagatgggaggaaaaaaagatgaagaactttcagaaacgaacaggacaatgaagtaattgttttaaatcttagagagttcactctgttatcttttttttaaaagtaacttgtcaattgaacttttgcgtgagaaactcaccaccctcgcaccttcggtttgaagaattatttattcatttgctgtagtcttggagatggaacccagggcctcctgtgtggagcaggcgcctttatcatagggctatgtccctagcccaagtttagccattaaaaacaaataatttgttgaaggcacggcagctaatctcctgaggctttgccctgttttcctaatctcttcctcctggttctcctcttccctcacccctcctttgactcccaccccctagtgccagaaacattggcttttataaccttgtgggagttgaacaaatgttcctgcttgcttgaactttagtcgttatctcgttggctgctttccttaacttttgtctgccctttttttttttttttttttttttttgttaactgaactatccagttgtttggatttgggataaaagggagaatattgtaattattttttcttaagagatttttttttcttttagctcctgttgaacagagcaggaaaaaaaaaggtttctccctgcccccccttgtctctctgcctctgcccccctctctgcttccacccctctgccaggacagtgcgtaattaagcaaaatatatgaccattcctttctccaacaaacatttacagagtcactgtggtggtggtggtggggctcttgtacccagatcctgagtatgtaagaaatggctcctgttgtttctgatttgattaagaaaagaaaagtgtagacagttaatctgttgtaaataattaaaagatgcctagtctcttagatagccacagagcaactgtgaagacaataaacattcttcaggcctacaaacagtgaaataatttctttgtggtgactttgcttgggacatactttttcatttggggaatacaaatagattcggattcaactagtcttcttgaaagtatttgcaaaattgacatctttattaagcctttatagactttgttgtctgaagactacatagcagtcacatgattttgaatatcataagtaatttgagcgatttaaagtatatgggaaaatatgtgtaggttatatgtgaatactgtatcattttacatggacgacttgaccatctgtgccttttgttatctataggtaggttctgcaaccagtctccaactctcaatcttcttgcctctgccttcttattgccactgctcccatctttctcctttttctttagttaatataattgtatgtatttatggggtacaacatagaccactgatacatatatatgcaatatgtgaaggtattttctatagattaaatgcaatttacaggattcatagatgtttaaattcacctttctcattttcttttcttgagacaggttctcactgtgtagctgtggctgacctggagctcactctgtagatcggctggcccaaacacacagagatccacctgactctgcctctaagtgctaggattaaagacatggctaaatttatctttccattattgtatagattattggaacgtggatgagcagcctcccttcctgtaatttagatttaaaacattttctgatggcaaattgaggccccattgatcaattttgatttatagttagacatgggtgatggagtccagaagaggtctagtatttaattctagcttgataagcatttgatctttctcaggataccctctgagatcttggaggatccttctgtttgtggaatgtgctagaatagtagttttcatccccagggaatttgccacacagggttcaccggacaatgcccagtagatcttttttttttcttttttttttgctagatgcacttcctggaatctagtcactagaggccagggatgttgcttaaatatcctagaacctacagggcagcaaccccagcatagatgtgtccagcctgaagtctcagtaatgccgatgctgatgtaatttcctctgctaacacaggaacacataattccaggagaggaaaggacaatagcagtgtgctcatgtgaccctgtagagtacttggctgagctcatttgattagacttcaaagtggctagttcctgcccaccaaactgaataattagaataacagcttgtgtttatggccctctgttccaggtacttgcatacattacatatttctcttctttggtaaaggaggaaccaggttcagagaggggatataagttgccttgggtctcactgctggttagcccttggaagtgaagaaaaaaatcttctgaaatttattgtctcccttgtggtgggcatcattcaaaaatattaaccagcacaatttttaaatgctattcaagttcattagtatatgtagactttcttatttgcaagttctttataataaaaatagagtatggtattggaaaaataaaaattgctgtatgtcctaagtaccattgagcttgcttgacattaattgaagccagggatgataaatttggccaggcttggaaagagggcagtggagaacagggaacagggaactaactttaattatttctaccttgtttcaggaagtatgctagtttggttgacacagcctacctagtttgatcctcttacttagttctacagagtcgtgcatgcttcctagtttgagtttggggccaggcctggggttgcacccctttaatcctagcacttatgagacagaggtaggcagaacttggagtttcaggctagccttgttagggctatatagagaaaccttgtcatgaaaacaataaaaacacaaagcacaacaaccaaaaagagtttgcagaccgaagagttgataagagacagagttggaatttgagttgaggttccatggctaagccgctgtgctgtccctgccaggaaggctggtgttgagctgaccagggagagggagggggaaggggagggggaggggcagagggagagagagacagggagagggagagagagagagagacagggagagagagagagagagacagggagagggagagagagagggagagagacagggagagggagagagacagagagagacagagagagacagagacagagacagaaacaaaaagacagagagtcagtcacttggtcctatgttgccaatggattttgctgtactggcattgagaataaggaggtaaatatatgttctctcttcaactgatgagaattgaattcaattgcggatttttgtttcttctccaaaggagctgcagtgtttagtttggagaactttattctctttacttgcctgaaattttaaggaagagaatcacaaacctgggcattatctactttggcatccagccaggcactttcccttctttacaggactcactaatgacagcatctagttttctcttttttatataatttgaacactcatacttgctatgggagttgtttctataataaatactagatttgtacttgtgttttccatttggggtgttttgttttgagagccaaatatttatcttaacttttgatgtgttttgttttagagcacaaaaataggagagattttaaagaaccagcccaataacaatcatattttgtctggaaagcagtttgtgtgtgtgtgagtgagtgagtgtgagagagagagagagacagagagagagagagagagagacagagagagagtcagagaaagagagagacagggaaaggaggggaggagggaaagagggcagaaaagggtcctcgagtttcacttaatttattttaagttggaaaggaattttaaccatgattctccagggtgagagtgctgggggaaaaaagagctgttatttagataagatgcatgttttgatttctatataggactgtcagccatagattgtgattataataatgttctgattctgaccacagcagtcagccaagtgctaatcacccactgcgtgcctggttttgctcccacctccctgattgtgattcagtttagtctttgctgtgtggggtatggaaacgggccttgtgcatgctaggctagtgcactgctacagacctacattccctagactcaccccactaagttcggatagatgggagatctagtaaaacttgtaagactacagaatcctttctgtaacttagatctttcaatgataagattagtacttctcggggctggtgagatggctcagtgggtaagagcacccgactgctcttccgaaggtcaggagttcaaatcccagcaaccacatggtggctcacaaccatccgtaacaagatctgactccctcttctggagtgtctgaagacagctacagtgtacttacatataatcaataaataaaatcttaaaaaaaaagattagtacttctctgttatacagaaaggccttgagaagaaaatgagcagcatatatgatctaccatctagaccagtggttctcaacctgcctaatgctgtggccctttaatgcagttcctcatgttgtggggaaccccaaccataaaattatttccgtgctaccataactgtaagtttcctattgcaatgtaaatgatctgatttgcaagcctcacaagggttgttattcacagattgacaactgcctgatctagaagtttgtgacaactgtttatgaatctttaaaatgcagtcaatttttcatggtggactcaagtctattccaaagttgccaatttaaactcctctcaggttttctaaactctcaaaagactgggttcctgctgcacagctagctcgtcacaagcacactgcaggtgaagggggaagctgctgggagctggccttgtcatctggcctgctcctgtccactagatacagaagggaagaaggactcgcccatgttcctcttctatctgcctgattagtaaggatttcaatagcagcaattcacaccttccttttacaggtgaggaaaatgaggctcagttaatgacaaaattctggcttggattcttggtttttttctaaattgaattgaacttttggtggcctggccctcaatatgtcaggttttggggcaggtgacatagctttttttctttttttaaaaaaagatttattttctatatgtctatgagtacactgttgctgtcttcaccagagagggcctcagatcccattaaagatggtcgtgaaccaacatgtggttgctgggatctgaactcaggacctctggaagagcagtcggggctctttactgctgagccatcatctctccagctgtagtgagatagcttcatggtaaaggactctctatttaaactcaaggtcctgaattcagtctctgctctggggtcgtgattgtagtctcagtgtctagaaggagaacccaaggggatcctgaagggctcactggtcaataagtctagcctgcctggctagactcaggcacatcaagtatgccagttttttttttaaagatttatttatttatttattatatgtaagtacactgtagctgtcttcagacactccagaagagggagtcagatctcgttatggatggttgtgagccaccatgtggttgctgggatttgaactccggaccttcggaagagcagtcgggtgctcttacccactgagccatctcaccagcccaagtatgccagtttaagtgtgacagtgaaagacagctttaagactctttggaagctcacaattaaggcatctccatgaaaatgtttttgtttgttttgtttttataaaatgagatgtctattctaattgtgggatatttgaaattttatgactgtttaagatctaagtaggaaattaagttatagtagattctgacactgtagtcattaatggatacatgtacacactttatttaatctgacactcaaaaaatgttcccgagggtggggctggaaagagggctcggtggataagaatatttgctgctcttgcagaggacctgggattggttccaagcaccaatatggtcactcataattctctgtaattgcagtccctgggaattagatgccctcttctggcctcttcaggcataaggcacttgtgcagtatatatccattcatgtgagacagtcatatatatgaaataaaaattaatcttcctcctatagggttgcagaccccttcatttccttgggtactttctctagctccttcattggggactctgtgttccatccaatggatgtctgtgagcatccacttctgtatttgtcaggcactggcagagcctctcaggatacagctatatcagggtcctgtcagcaaaatcctgttggcatctgcaatagtgtctgggtttggtggttgtttatgggatggatccccgggtggggcagtctctggatggtccttccttcagtctcagctccgaactttgtaactccttccatgggtaaccatatatataggtggaacaacaatatgaactaaccagtacccccagagctcatgtctctagttgcatatgtagcagaggatagcctagtcggccatcaatgggaagagaggccccttggtcttgcgaagattatatgcccagtacaggggaatgccagggcctggagtgggtgggttgaggagcagagggagtggggagggtataggggatttccggagaggaaactaggaaaggggatagcatttgaaatgtaaatgaagaaaatatctaataaaaatgtacttgctaaaaaaaattaatcgtattaaaaataagtaagttcttcggtctagaaagatggttcagcagttaagagcacttgcagttttctcagcagatctggttcaattcccagcaccgatgtcaggcagctggcttataaccacctctatttctcatttcctgggattcaaacccttcaaaaaatagatagtctgggatctgtgggcacctagaatcaaattcatatgtacatacaccaccccctactcgcagagacacattgagaggggaagaggagagacagagagagggagagagggacagagggagggagagaggaagagagggagggagggagggagggagggagagagagagagagagagagagagagagagagagagagagagagagaatgaatgttaaaaactagttctttagggttctttgcttttctcctggcggaagacatttttttcctgtagctattggggcctcttctgtatgccccactgcacatccttttaccctcagggtgacttgtcagcccatctcactgtgcccacttccctttcctcaggatcattcttgtggcacatttgccagccactacttccgcctttctcttatccatatttgccactgttgtacatatatactagatagactgggctgggtccatttctcctctttggatgattttttagggtagtggtaaggtgagaagatgtagtgtcaccagatatagacgtcctagtgacagagtaaaccaaaaaatgtgtgtgtgtgtgtgtgtgtgtgtgtgtgtgtatgtcaatgtggaaatgcaaagcaatttttctttatagctagggtaccagctataaagggtgtgtaatgatgcatgtgtgcatgtggatacactgctggggaatgaatggaacaaaggagaaaattgtccctttgactaggggtgtattttcaagtagcctttgctctggcttatcactgtgcctgcaagtgaatactgtatatcacaagccagtgatcagcaacttgtaggttttgaaagtgcagtgagtctgtcatctgagagtggattttccttccaatttaagctattgagatatactgtcttttgaactaggatatatatatataaaatatacagacgggggagtcatgagaactttttaaaaatgcagtggaacctaaataaaagggcagcaatcaaaataaatcatcatgttttcactgcttgtcaaagttatgttttatttgcccacttaatatatggcatatatattctaagatacacatgttcccaacatattctaataaaaggaatttgtaatatccatgaagttgttttttttttttttgacagcgtttcactgtgaagcacaggctggctttggcagtcgctacagtccttttgcctcagcttctctgttgtttttaagttgagcataagctacctggagccacatggttgtcagtgtagtttttcttcaaaagtggtagctgggaatacagaaggtttgttggaagaattaccttgctgaggaagtataaaactaactgtgcttatgggttgtccttccctcggcttttgagtgtgcttaaggctgttggctcctgttcagtgctcacacaatgtacaatgcacaatttgttaggaagactttaaggactgatcggcttatcgacgaactgagttcgctgcttctctgcagcgttcctgtttgtggagctggtagctggcatctgcctgcaagtgctggggagggggtgctagcgtgaattttgctccaggtttgccagaaacctggagagagggggagggaggaaaatagggagaggagcatgagttataaagttcatgattttgaatgaaaaaaatgtcaacaatatgtactatatattgtataatatatataatatacgtatatgtaattatatatgtgtgtgtgtgtgtgtgtgtgtgagagagagagagagagagagagagagagagagagagagagagagagaacaagaaccctgatgctagaccaagccccttctatgccacaagagattcagactctttgagaagaactgagaagttttccaatgtagcaaatacatcacactaaggaaagaaactataatgggtgtgttggtacacgcctgtagtcccagcacttgggaggtgggggcaggagggtcataggtttgaggccagattgggatacacaatctcaccaaaaccaaatgtagaaagggagacaagaaatcaagcccatacatgaaaaggaggcagtgcacaggtttctacttatatttgtacataaagcagccagactgcttaaatgtctgctttatgaagtatcatttctacatgacaaacggtagccatttaagaactctaatttgattagttgtgacaaacatatatacccacgaaactaccattatagttagggtatgtattccccccccacccccattttctcttatggcccttgcacctactgatgatatgcatttgtgcaagaacccctttccaaactagttttataaatttgtagatcctcctctataaaaccaaaccaaacctggatttgtagccaagatgcagtctttctgtatttaaagcaaagtagcattacagaggaaccctaggtgtggctattctgaaacattttcctggtcacctcagtaaatgacttagcatgttagtttcattacatatttggactgaaggcaaattatatccaagcgagaagcaattgtgttaactagagccatgtacattcttacattgaaaagtcaaatgctcaggaacaggaaaagtgggctggggctggagctcagtgggagagctagcactttatattaacaaggctcccagttcaacccccagcactgccaaacagaaacaaacgaaaaatgcaggaaatgaaactattgaaaatttgcctcaaatttaatggtgaaacaaaaaaagaaaaagaaaaaaatgtttgtttatatagttatgttactaaatgataggtatattttctgagaaacttgtcaggagatttttttttttttaacaaacatgagaatatacttgtgcaaacctaaatggtgtggcctactatccccctacagtgtatggtaccgcctattgttaataactaataactaataactttaatagctaatagccatggagcattttatactgaatattataggcaatggaaacaaaaaggtaggtacttgtttgtctaaacagagaaggtacagcaggggccagggaagtaggtagcttagttggtgacgtacttgctgtataacatgaagattggagcttgactaaccaacacacacacacacacacacacacacacacacacacacacacacattaaaagagtcgagtatatggagcacatacttgcaattccagcatgagggcctagggaagaggtaagacaggatagtgtttagggcttgcacacacactttagagtacagagaaattcagtcggaggattttttttcttttttagctcagtgataatcagggttggaatcatataatgtcattgatggagaagtgatgtggctcatggtagtaacatctgtatctccaggtacccacagagacacagtcggttaatatgaataacccatgaaccttccaacagatttgggactttctgtgcatagattatatacccctgtctacatatttatgtgtagaatgggcttttagtatatttagttgttgattctcatctgtactattgaattaagtgaaaaattctttggggaagttaggggctactgtagccagctgcaatccatccctttctcttttactgtcagaagaattcaaaagtcaggaagtgttttgctgtcattctattgatagttgtgaccctggtctgtgcccgctcccctgccactcctgttttgccctgtggctgccctctatgtcttccttcctggttttctctttatgtgtctttcctgtctcctcatgctccttcttctgcgctgcctctgctgtctcttaaaaaagccatttcgtaaatgtcttcagatagagtgctcagcaaacaggaattggagcgagcatctttgggacagtgtttccgacttttcatttcgtgatccaataaaaccttgacactcctttcaagtttggagccacactagaggttggggagtcgtgaaaggctggtatttagagaaccaaaacaatgtatttcctgggctactttatacaaaagtcttcgaacaatgaatcagtaaaactaaagaaagggtttatgatattcctgtgatggttcctttaacaatgcttaaatagttaacggtcaattagtgttcttcagagtgtactgaaaagatattatctacccccaacatctgtcaaagcctacaaaatgcatggcacaaagcaggaaccctacccctagaaagtgtgtacgtgcgtatgacctatgtgtgtccttctgtaaatgttaaaccatattccttacagtacctaaggtaatataaatgctcggtacccattgctaccatatttgggatagttacaagagaaaactgtatatacactacatgcatgcaatattctctcctgaactttccccatgcaaagttgattgaatctgtggatgtgcaacctgtggatgtggaaggttggttttacctggaacgattggggaagataacgacactggttaaaggtcaggcatgtgatggcatcttctagtccccttgatggttactctcttgcttcttgccatctctagtttctccttcccttctttatccttagtgtggttattttgagattatcttttaaagaagaaggagggctcctgcatgacacaaagattggccagcagatcacaaccatcagcacattgtacttttatataaatttcttacactcagaactttattgctgtcgtagtttcttcaggataaaatggtaggcaaggttttctgacagggaatttggaaacagacattgtgttaccttgtaaatttggttatcaaccctgccatgtttcagacccacattcattctctttatttgtttgtcattgttcctgtagcagatagtggacagcacaaaggctacaaaggctacgaaggagctgagtacctcagaaaggaaaaccagcaaacgcttagtcagtgcttcatctcaaacacaaacacatgggtggagaccagtaaaaatcaatctccaggcaaggaatgggcgctataattgaatatgctgttagcaacacagcaaggatgtggtagaaagagtattgaactgggtggggcagtatagggagtggggagagcgaggaatttagaacgctaacctgaggatcatttgatttttctgggaaggttattcctccactgaggcttcgctttataaaaagacaatctactggattgtctaagccaagtgtggatatttcagagaaagctacattctcttttgtctaaatgagatgcacaaggctaaaatatccttaaatgcttcagtactgggacatttcatatttcagattagggattcttatgtgatgaaatctacacaaatattacagaatctaggagaaagtaaccccaaatctgatataccagtagtttaatatttcagggaaggtgctgggtgtggcagtacatgcttttttttctttcagaactaaggaggtagaggttggttggcagatctacctctggtctacataatgaattccaggacagtcaaggctacatagacagaccctgtcaaaaaaaattttttttcagagaatctataggtatagaattactatttgtttcctaattactatttgttgtatagtatatctatttatatgatatcattgtactgattatagctacacaccagtgcttctctgtgtgggtccttggacccggagcaaagagcatcatcacctagattctaggtcctagaaccttgttagaaattcaagttcatgagctctacccaagctggctgaatcaggagtgctggggacggggctctgcctcctgtgtcagggaaagggtctacattaggtaatctgatatccactactatttgattactatgtgctatctgaagttgggacagtgattttcaacttggtctacatctaggattcaccacgagtaacttcgtcggatgcgctctatcgttctttattgctataagagactatccaagactgagtggcttaaaaagagcagaagtttaatttctcatcattctggaggctgagtagtccataatgaaggtggcagcagatttattgtctgctgaggactgctttgcacttacagcatggtgccttgatgcctctggaatgaagggatgatgttttcatcagatgaaggacagtggaaggcctagaggtgaactctgtcagcccttctgtaagggacccgaatctgactcaccaaggtttaatcctccataatcaagccacttccctgcgtcttaatgttgtcttgttgtttatgtttagaaatgaacctcagagaatatggaaatattcacattcttgcaccaaggaagaccaggagagccgatggaggaaagaggaaggggagttcctggcttagttaaagcactgggaaagtgggctacctggcacgggcaccacatgaggggaaaggcagaaaggctagcagcctcaacactgcagtggaaccttttttgtaccgtccttagttttatccaagagggaggaacattggcgctccaatcccttaaagggtctacctagtaataagtgtcacactcactggccattaagttccaccacctgaattttggagggggcacattcaaaccataacactacccatacatcactagtctctctggctcccagtgtagccagttttggtttagaggggagtaacacctgtggttccttatcagagtagaactctaaaggtgatgaggtagccagagctggggctgcgaagagcaggccagggtctcagtgaaaggaattgtgtttgatggtaaagaccttggctcttagatcatggcagaggaaggttattttagagaaagggtataaaacatgtgagatgataaatatatcatgattgttttgacagctacatgaagaagagattttgcccagcatttaaaagtctgatgaggagctagagagtggttaccagcactaggtgatcttgcagaacctgggtttaattcctagcacatacatgggggctcacaaccgcctgcaactgcagtccccagagttctgacatgctcttcccgtcagtatagctctaggttcacaggtggttcagaggcacgcctgcagacaaaatacagagaaacataacatttttaaaagtcggatgacaagggctggagaaatggctcaacagttaagagcactgagtactcttctggaggtggtggctcacaaccatctagatctgacgccctcttctggtgtgtctgaagacaactacagggtacttacatataataaatgaataaataaataaataaatcttttttaaaaagttggatgatgtaatcagtgtgcttaacagacagcttggattgtggagatggtaagaaagaaaaatgtgaacatttgtttgtgaagcatgggaagggtctagtggtagtcgtggttgagtatccaggaggaccagtgctctggtacagctgtcagaattgtcacatgggttctatacagtcctctgtccttcatggctttcatttagctctaagttggggagtggtctacagagagttatataaaaaaatagaaattatacatgcctaaaaagctacccatagtcatcatgacagagtgggaaaatgctgctttttttttttttaagtgaaagaatgcttggagttgtgggaaagttgtaaacttggcaatgactaattcaggcctctctcagtcaattaagcgaatttttattttatcatttgttttacttgggagccactgtaatggtcattgaaagaacatctatcgtcttattttgaaaacacaacaaacatatcgtcaaacattagggcagaggacaagaatgtcaaggtttcaccttttgactttagcaaatatctgtcactccatttttcttgctgcattcgacgacgtgtgcctttgtgcacattctttggccagtgcctaataggtctagtttcctatcttctattttaatggctcttggaatttgtaaatattattcatattttaacattgcaataaaagtggacaaatatattttcttattctgtcttttggccagaggtccctgaaacttgtgtgaagccatgggtgtggaaggagcttcctcatctttagtcttggaatccggaatggcaagagggttgttttcatccctccacagtttgctggtttagaggaaagacacatctctagactgcattgaaaacctattaacacaggttcccacttattccagtggaaagcttaaaaatactcattcctctaactttgggaaatctgtgcactttttagtttttgaatgaaatcaaatccgtagaaaaatctggactgattgcagccttaaatatgcagcatatagagcagatgcctttaaagaagagaactggttttcccaaagctgtatatggtgatagaattatctctaagttgtgaagagtacttaaataaatgtggaaggattaaggagatagttcagtggataaagttcttgccacactagcatcttgactggagttcggatccctagaccccatgtaaaaaacctaggcagggttacaagtgtgtaatcccagtgctagggagagtggagacaggagggtccctggacatgctgactagcctatgtagccaattagtgagctctgagttcagtgagagtcactgtctcaaagattagagagtgactttcatgtgtattctcacaagtgagcacacctcctcacaccccaaaactaaaacaaatactcagtgaaacggcatgcgttgtaaaattggaacaatacagaggagataaacatggccatacacaatgatgattagcaaatttatgaagtgttccaaattttggggcagggttgggtagtcagggtttctagacaggatctctttgtatagtcctggctgtcctgaaactagctctgcagatcgcatcagcctcaaactcatagagatctgcctgcctctgcctcccgagtgctgggattaaaggcatggataaatacataaatatagaaaattgtatgtaattattttttagagtataagagcatgttatcagatatactatatacctaatcttctttaaataacaaaacttgggctgtggtacatttatatgactgaaacatactttaaaagttgctttgcttattatattaatgcttactgaataactggttatgttgcaggtcttatgttgaaattattgaaataaggcatctcttaaatggatcatttattcttttgtttgtttgtttgtttattttatgtgagtacactgttgctctcttcagacacaccagaagagggcatcagatcccattacagatggtcatgagccaccatgtggttgctgggaattggactcaggaccttgggaagaacagtcagtgctcttaaccactgagccatctctctagcccgaatcatttattcttaataaattattttcagtttttctagagggagccagcagacatttcagctgtatttattattgcactttatggcatcattgaaagtatgttttgaatggcacatatgccactgtttcagactcccatattaacacaagtagggaaatagataacaggagggtgaacgagaagtttgagcctgctggttaccatcacaaatacttctaattaaggggatacttgggttcatgcctttttgatttcttaggtggaagagaatctcctgaagaacatgattaagggatggttgccatgacaatcatatccaaagcatctgagacagtgaatccatggagatcatccattttgattgattcaactggtcatttaagttcatttcaacagacatcatctctgcattttattttatttttttccacgtaattcacaaaattgattagcaacttgaggatccttgaagcttgactgaaagtaatgatagagtcatcagtgtctatgaccacaatacttttgttaaaccccattgtcttaaacatcattaaaatgatgtgtcaggctcattaatgacatttctaatttgagttactagtttatcagaataggataagattagcatgatttatttgaaagcatataccctaaaatattccagtctgctttagattactttggtattatcacatttacccagtgtttggctgtcctcctgggtttttaaaaaaatgtttttgcacaatattgttggcacgatattatacattatgtctgatcaaagccacagttatattctacatatgggaaatggcacacaggcaatacaacccaaaatgatgctaagtggaacacactagcacaggaaaaaaaagtgaaatgaagatgcagatgcagttcaagtcccactgtaaagtttctcctggtcactgatgaggaaactctgaattatggaagggaaaatagctccttcgggctcagttggaccccagtgtgtgagctttgagttctcagcttgaacctttctctcttctgccctctggagggtgtcagagaacattagatacgatgcaaggacttctgaaatgagtagccaggatcctggtctgctaatagaagtcttcagcatcttcgaactggtagcctcttcctacccagcaagaagggtataggtggtgagcaggcagagaaggcgtttgtaaagccaagatcttaggagggaagctacctgacttttcaagtagagaaccaaattccttctgagtagaacccagtataaattgcatctgtctccaggaataatcacttctagaaggggaagatgtactagtatttggaagctagagtgtgaggagatgaagtttgaaattaaaattggttgagtctgatgaatatatttggtatcaactatctgcgggagtgtttatagttatccacattgatagcattttaactgcttgtctgctgtaagaagtggttgtgtagctaatattctgcgagtaacagctatgtatgccctgtacatttgattctttgcctttgtgggttggttactattaggaagttcaggagggagaggttgggcagctaatgtaaggtggagccagtgtttcgccccaccctgtgtgagtctggcagcctgtgtgtaaaccagctgtaacacgctgtgttctttcacagctgcatgaaagggtgtggcaccttctgtgagcagcaagttccatatgagcagctgtgagtgggagagcgagacttttgtatctgtatgccatgcaacctacctagaaataggaaagaagggctttgtgttggccacgagccatttaaagtcctctagcacgaacaaaaatgtgacatgaaatcaataacaatgatgttgtagtattagataatatttcctcctgtgttggtgggaaggggagcaaaagatagttctttgaggatgcttctaaacaattcttttttccgctgacacagtttgatgtggccaaaaccaaaaaagtcctcttcaaaaagaagactcaaaagttatttattttttaatttctgaaatactttgatctcttacttttttatatttacatcttttctttatttttttttacatcccaacctcagctacccctctctcctctcctcccattccctctccccacctcccctctgccttccttatccattcttcctccatttctcttcagaaaatggcaggcctcccatggctatcaaccagacatggtatatttagttgcaataggactcggcactttctttcctattaatgctggacaaggcaaccgagtaggcagaacggatccctcaaggatgcagaagaggcagagccagcccctgctcccactgttgagagtcccacaagaacaccaagctacacaaccataacatcaatgcagaggacctaggtcagacccatgcaggctccctgattatttcagtctctgtgagccccatatgaacccaggttgaagaaccctgtcctttttagccaacagtttgcccatttggacttcagaatagttgtctttatctcagaaagtcattgttaaggtttcctaaacagatgaatctgttagtgtgtaaaatgaactacaccagctcccgtctagcacacacacacacttcaatctgtagtcagtgcctgtttgataaccagcctggaagcggttgtggaggtacaggagggattccaagcctcgttgtaagcttggtttatgtttgtcctattcccattgaaactccctgacagcctgttccgggtgtgggaacaaaacagttggcagccgattgtggtgacacatacctgtgatgccaacagtgggggaggtggaggcagggatcctcagtttgaagctggcatggatcacatggtgagatcctttctcaagtaaacgaaacccaaacagggacctctttggggagctgtcattttaccaggttccctttacaagtgataaaaggtagaaatggggatgtgtatgggctcatggggcagttgcctgtgtgttcggaggacactgttgtgcatttgtgtcatggatagcagcagccatgggacacctgtttcctagtaccacagctccatccatgcagggaagagcctgcaaactaacctgcatcctaatcctgttgtgggtgggagataacctcatttccatggcaacagctaactattactctggtgacttgtggtctacactctggatggatcagagcccccctgtggcagaatattctaaagatgctaaaagagaaagggagaaaggttcaactaataaatctattctaaatgactgaatcatttgttttgattaccagagtgattgccaaatgttaatttaaaactgaaataggccatgagctcacttccctaacaatgctgagagtttgagctaatacagcttgataatgagggagccagatccactgccagggctaatgttatatgataaacagacatttggagaagtatgcagaacatcttggctggtctccgttagctcttcgggttgtaaatacaaaggagaatgtgttgctatgagtcttttcaaaggaaaataatttttttaattgatgactttacttctaaaaggtaattttgctattttttttcttcaatttaggcaactggtagctgttcttagctgtgcccagtccttctggaacacatcctgtgtgaggtgagagttattcattgctatggattcttatgctgatctctgattttccaattttgagcattgtacaatgcgttttatttctttgagaagttgaagaagatttatcttaatgggcccgaccagtatcactgcttaccctgactgtcagctctctggggagtgccttttctagcaaaaagctcatttgctttgaacttggtagcataaaagtaaaaagtggcaggtgctgtcgtggggagcagagaagctgcgtgggatgaccactgctctgagtagaaggggactcctcatggtgactggacatcaagtccgaagacacttcctgtcctgggtgaaaggtgtcaggccactgtcaaacctggtggtaggaacaccagagtgtttcttctgggtcacaatagcctgagccaatgtgtttttgtttttttttaatttgccttcaagtttagaagaagccatgctataatggtgcatgtaaccacactgcctggacattcatctgctgtactcattggctagacatcctctgcttccttcaactggggggctgctttatgccctgtgataatccaggcttccttatttcccctcgagagacaggacatccatctgtaaaaataactagagacatgtaagagaggtctactttaggtacaatgtagaaatgactgcttccttttgtcccccggtttctgtatttattcaagggacatgatacttgggagcactgtacttgtcaaggttgccagtttcatacacaaggaggtgccattgctgtgggcaccttctctacttaggtaaacctgctcaattcttttgaatcaatcattacagaaacacacagggctacactgctgagtcttatgtttttcctttaatccactgagccccattgtgtaccaaggcaggagtgttatgacaaaagtcaggtactttggatctgatgtagggaagccctagataattttctcttcatcaggtaaggagactgaacattgctctgtaaaatgttacccacttacgctctgattcttgagcctacaacttttgcttcctctgtaataagcgggtatgaacaagtaggtgatactgttggagcaacagctgtgcctaggaccaaaagcccccaaaagagaaaaaaatggaagttctgtatttcacaccctatttttaaagttatttagggtcaaattaaaccattcaggaaaatggagtttgcaatttcctcaggaggatggtagaaattttaaaacgatgtgatacagcattcatcttccacaaagtttataattgtaggaattgatattattctatttggcttgcctccagtttataaaattatttggaacacagttgagcacaaaataaaaaacaaaagacttattttatgtgtcttattttgtctgcatatgtgtctgtacagtccctgaggaaaccagaagggggcactagattccctgtaactggacttacaatctcttgtgagctgccgcgtgggtgctgatcaaacctggctcctttagaaaagcagctagcacccttaaccactaagccatctttccagccctcacaacataattgttagcagacacatgagctgggtaaaataggactactctgatttgtactgtagaaatgataatattgttaatggattgaatacattttcatatttaggaaatatttgtgtaactgccatatggttattttcattattgatttggcaggttgtttttttaaatattcaccaaataaagttctgaaagatagtagtcataatgatttgatgtgtgccatggatattgatgtgatctctctctcttggaatccaagtagtcagcatacgagtccgcacagatggattacgcagacttaaaagagtttagaactcttgaatctagagccatgggctcaaactggtaagctggatctggcacacagaggtgttcttttaaaatgctagtgagttgccagccttgaaaaatcgagagatttcacactcttaaacatccacatttcccatgtcttgaaatacagaagatttggcaccacaaaccctgtgttcccattcggctataataggctgcagccaacttgctgctgttcttttgcagagagcacaggctgcgagagccttgccacagcctccaaccttccctgcggtcttcttgacacaaagggtgggggcctgttgccattactagaacactgtgctcacgtaggcacttggcttttcagtgtcaattgaagataagattgggtgtgaagttcagattaccctgtctggcggatcacttggtttatttttctgggctgagccatgttcattttaagggcgtgcttaagattcatcttaagttggcaggtgaaccctaataggggagggatacttactgatgctacctgagtaagaagaggaatatctgagcagtatcttcttacaaaggcttgcttggggtcagtctttctcagatatacctcacttcctttcactaccctgtaacagggtagcttaaaaatgcaactagttttaatacagcataccacatgtggaggataaagaaaagttgttgagataaagaaagcttgcttgagattttattctgatatattttctagtaaaatattattcatgttaagcccaagaattatgaattatggacaagaactttatatttaattatcagagtacacatttatgctgctcttaggatccattgaacataagactgcagaaaatcggctaattatcaaatccctaagtgagcaataatcatgtaagttgtaataagctgaaagagtcagaaaagaagaagatggtcttcttttctctaactctaccgtgaaaaaggtaattataaccaaaaggaaactgtgcccagaaaatttgccacatggataaaaggtaattttggcattgtatactgaaattattcaagttgttgagtttcgatggttgcttagtaatgcaaaagaatatagctagcaaaaacgtatcatagtgtaggctgcaaaattttatgtatatgtgtatgtgtatgtgtatgtgtatgtgtatatgtatatgtatatgtatagtggttataaccatgcaaggtgatatggatgtatgtacaagaaccagagggcacatggatgagtaagtactactttatttgagatttcatgatgcttattcattttaacataagctcgtactctaaggctgagaatctgttgcttttaactactttacacatcacgaaatattcctgtttatcacaaggtaagtaaataaccatgaactataataccatttggtcttggcctatacttaaatgtggcattccaacggtataggtctttcttgtgtattttgtacccactcagattcctgtttgtcattcttctcctgtgttcttggtgacccccatgacaaaggacatgtattttgttttggggcttcttgtagatgtgggctgatgcttcatgtgtaaaggtccagtgtaccctggggaagggtcttaattatgttctcacaggagggcagtatcagcccatcatctctaggcctttgcagaagcctacaaaaattactttcagagtaatggtcttttctcagtgccccttcccttcatctctctttcagatgtacttgtgtctcttctaattaggtcaggtacttcatgtctgtttttctttcttgacatggttttcctctggctttggcagcacatattttccccatatgtcattgcctctagagcttcatgctgcagtcatttttcaaggggaatggagagcacattgctggagggggggtaagtcttgcctcccttgcttgccctttacttgaatgagcaactcatatttcttttgggtctagttctgtttggttttggagtcttcacagtccgttatgtttggactaaaagatacttaagtaaaaataatggtaagtcacagatatgtctggcagaggtgcagcacatttgttaaggttactggtttatttatctcccctatctctatggcaactcaatctgagtctgggatttaatggacttaactttgaccttctgtaacatctcttaacttttcccagccctctactgaaaaggaattcattttcacttgaggaaagaaatacacgtcacttacagaaagagtcctatttgggctctcaaaggtggtctctgtaaaggctttgggttttttcagcttaaaattgtattgaaaaaaaagagtttcatgtgaataagtatccacagtgtgtgtgtgtgtgtgtgtgtgtgtgtgtgtgtgtgtgtgtgtgccatgagtttttttggtgccctcaaaaaccaatcagatctgccccaagaactagagttacagacttcaggttgctatgtggatgctgggaactgaactcaggtcctcaagatcagccagtgctttgaacagcggagtcatctcttacgcttcccagaacctttaagtttttatagtcttcagtcttcagagtatacatcacacttaacaacacacatatgtataacaacacacatacgtatgtggcattactggtgtacaaagaacagtgttccttttggtgagctaaagtactgttttgtcattgtgagtctttgtgaacatataagagagtttattgtaaggatattaaatcaaagagaacattaattacactttttttttttttggtttttcgagacagggtttctctgtatagccctggctgtcctggaactcactttgtagaccaggctggcctcgaactcagagatccacctgcctctgcctcccgagtgctgggattaaaggcgtgcaccaccacgcccggctttaattacacatttttaatatttattttaaaaatgatctcttatccatcatagaattagaaatttacatgcccacaaatgatcagactatgtctcagagtttaaattgttaaacagcaccatagtagtgcataagaaagatttagtttgaccagtatttccgtagaagtcagctttggatcccgacattcaaatccagcatttcatcagtacctgactcatgtgcataaagacagagtatctgtctgaggaagttagagccaagccatgttggacctaagttggtttaaatgttcacataacactttttcagtctcttctgtatggttgcaagacatttacagagacattccagtttcaggaaatgcaataattttttccaaatcctctttacattattattacgtcagttcagtataggacattcaagattttttttctcatgacactgttttaacctgcttcctaccaacgtagaccataaccttgtcagtacatctcaatagctgtaagcaaagtttctgtcttattgattacctatgttggcagactatctctgatgtaggttagatgtttcaaggcatgcatcatggaaatgcaataatttatccatgaagtcatagtgtattactgtaaatctagtgtatagtgtattagtctacttatgaaaagtgtatttgtaagtcgtgtcgccttctctaagaacaaactcatggttgaatttcccttaatattaataagacttgtaacaaaggatgtggcaagggaggtcacctgtgtccttttgaccttactctgcaagcatccagtacaactgaagtccaatacgaattggtaaaataagaaaccttttgtgagatatcatcaagtctccatagacatggaggttgttttatgatcttgtctctcatcaccttttctattaataggtccaagacttgagaagcagtaacagatgctcacttgtgagtgatccacacttgtgcggcgaatgctgcgtacactttagtttctagaatggaaaccttgactcacatatctaagaaaatgtattaggtcaagttcataagtacatcatataaattttgttctgaccaccatgagaagaatgactgaggtcacagcttttaggcagatcacagattaaggctggaagcccccagcaacactaagaatgaacagtatagctgccgtcatcattatcattattagcctatctacttttgtcacatgttgaaagcccaatgtggtgcactgataattgttccaagtgctctgcttaagacagaactaagaatgaagccaatttacagagaaatggatgaattctatagaatggctttggaagagtggccccatcctcttgtcctgtcagccagataatcttcacaccccatagaccatctctcactgctgatggcaaattattggattagtggtttcttactagactgttcttaacctgaaatgaaaagctaaggtacatacgagtttggtgttaatttgtgtacttcgttgaatttgtgagcatcttttaaaccatgagagttgtatgtgtgatataatgatttctatacattaagattctgaaaaaataattcactgaatttcctagaaccagtagcaatttgacattgacatttacatagacaattgttaggagattcataactaattttggctttacaatttttgtgtgtgtgtgtgtaagtgtgatggctattcttagttgtggtattttgcccgtgtgtatgtctttgtacctgtgtctacagaggccagaagagggcattagattccctgagactggagttacagtcaggtgtgaggagccatgtagatgctgggacttgaactcaggtcttgtgcaagaacagtcagtgctcttaactgctgagccatctctccatcttccccaacaatagcgtcctttgcttcttttaatgagtcaactacagactaaatggagatgacatttattttggtggtggctaagaagagatggtaacttgaatgtgaattacgctcaattttcagagactggggattttatttctaccaataagtatacagacacatataccattctctttgcccaccacatttcatgatcacattatttgtactagtaagtcttggaagactggcctaaggaaatgcagctaggggttcttttcatatgaataataccagacaattgggatggaggagagtaacacaaaatgttagtcttaggtcctaccataccattagatagcaaggcaagaagtcacaagtaggtagttgtttagttagtggcttcactttttactatgaagtctaagctccatgtatttaataagtactaagagtacaaaaaaaagtaatttcagcctgatggcttttgcattatagtccatagaactctggaattttccgaagtgtttcagaagttgtaccaatattttacttacatttaaatttttcattatactatttttaaaatcttaagccagcaaacacttgtaactgttttgtagtacattttagcattctgcaggaactcttactgattgactttaaagtaagtaaaggttattaatgtcaacttaaaataaaatttgactagaacttatcagtcatccatcaatgtcagtgtagcatttctgttgggagactaaagacaaaaggtcttcactaaggccattacactaaagccattggtgttaaggtattggcctgtgagagctgatgttacatttgggtttccagttacagtgagcacttacccatctgttatatttaggtgtttctagtgcctccaggcatctgggaatggatgagtatacactttaaattggaaacagccataaagggggatatacagttaagaagttggaggctgatgggtcatccttcagaagggactatgaagggattaggaaactttattaaacgtctgaaaatgcatgtttgtaacatcgatgttcagtaggagagttttaaggattctcttctgagtgtagcagtaaaaccttcaaatgagtttggcagagtcctttcctttggaggtagtggcacttgctctgcctctttccattccagatggtattgctctctctgcccatagtcttaaataccttttggaggctactgtctgcttgtgtagacttgtgatcaagttttcacatttttccataaccatattttccttccccattcttttttttttttaagacaaatttcatagcccagtcttgctttcatcttactattcagttaagggttaaagatgaccttgaacttctggttttacctgcctagtgctgggttcacagatgtgtgccaatactcaagttttatgccctgctagggttttaatccaggatcatttacatgggaggcaagtactctaccaactgcatccagagagaaatatacccctaaacctccaccgacgtttgattatgaacattttcaaaactgaatttttccagtgacctgtatgcttctcctctgtagtctacctgtaacaacatgttgttctactggtttatatcctatatctatgcaggccagtgtatttttttaacctggaaatgtatttcagtgaaaagctagcagatttcttcagcagttaacttcatgtattttatatgctcaaagtctagctttttgaacactgcacaattgtggctaacttggcatagcatgtcacgaaggatgtaaaataaatttttcaactgcactttcaaaagtaatagtatttctgtaattctggcatagagttgggggaaaaaacccactggctcattttaaaacttataccctttctatgaccaaggctctgctgacttctcatcaaatcaggatatacttacaaattttattttcaccagttagaagccaaataagttcttacagagttgggatcgcccttaaaagagttgatgttatctaacgttggtcttttccatcttctctgttacatttggaaggcaggagaacagctagctgaagtctaaattggtctgtgttggattcaatcccaagccctgatcttaaagtcaaagtgttaagtgcaaattattaaaacaacactcgatccaccaagtagagcatgtggggctgggcacgaaaggttgcagggtgtgactttttgtcccagcttatgcagaaaactctccctctggtcttctaaagctgcttcagtcctttcattctgtcccccagattgggtcccaacacacccttggccatggggctgtgagtggacatgtttccttttggaagcactcaccagcactcttgaggtagccaccaggaaggcccttaaaagcagttttgctcactcctgcagggactaatcctctgcagtccactttggttttcagctgctgttgcttggcttgggaaatggacttctgttgtgtcaggagagaatgactctgaaagacttatatataaagacctatataataaacttgaccaactgcttcgtacagacacttgaccctttagctgcctataaaatctcattggcatggtgggataatgtgcactttggtcttgagagagcctattaggttgcaaagtttttgattcatctaccactgacttaccctttgatctcaacatgtgattgacttgtccgatgatggcttcataaccacccataataaaactgatttattatatatactataagagttgagttttaagctatatctcgtttctgttataggtcagatgtatgaaagatttcattagaatttaggtatgctcattaagctttcagatcagatttattttaccaataaaagtcaggaatatttcatattctgtagttcatatatacagtaccaccaattcagtgatatttccataaatgaggtgagattaatgatattaactatgatattaactataaggcatatgtttaaaatattgaaaactcaattattctgcaagaatttggctagtagggaggtggaacggtctctggatttatgcatggaacaggtgacagtacttgagcttctattcttagtttgccctcatccccttcacttaaggcaaggtacttagtctaaggttttggtttgtccatgtgtagcatctgtaatgctggtccactaaaaggggacctggtttacatttactagcgtttgaggatagaaggtggcacagaagttcagattgcggcgtagtgagtatctgtttgtgtgcctaatggcaatcttgacaaattactaatgactacatttagaaagttacagctctggagggaattgatatttgatattgttgttctgtgtgttctaagttaccatcataacagtaggaaaataaaccccatcctggctgtgttacagagggattaatcacttcttcaagtcgttgctaaagctctagccctttaaacaagagaacagaagtgttccttcttttattgactcttccaccaaataaaagccttacaactaagtttagttatacttcttcatgtgttgaagtctgttcaagttattttcattgtaaagaatgaaggatgaaccatgtcaattaaagtggctaaaaataccctatgcaagtatgtagagagagtgagtgcttttgatttgtacatcaaagcaaagaaccaaattatgtgagcttgccttttatacatttgttccaactactagtgtctttacaaagactcagatgttatctcagcacaagaggattgaaatagttcaactccgtgtgaaattgaaaaacctatattactattttctaaatccaatgtatttaaaattttgtgctaaggtgagacaggggcttctagtcacagagattcttggtcttttcatagtggtctgcctcaaagctttatgagctatgacatgagagtcacgtgaaaaatggggatatctacatagaacaaagcctgatttatttatgtatcagtattagatatatgctattttgaccgcataacattcactaaaattctttaggaaaggcaggacagctattgatatctccatttcattgatgaagaacacattaattttctggtaaacagctcagtagtccaaccatcatatttgtcgagaaatggatcccaagtgtggtgtcccttctctaggtacaacacactaaagccagaaaatagatacccattgcttttaattttgttatattaaaaacttaaaatgaatttaagttcaatattgttatctcagtgattggactaacattttaactgaggtttttgtttgttttttgagacagagtctaggagattgtctaagcttgcctgttacttgctgtatagattaggctatcctggaaattgtggttgtaatactccctcctctggcttgcaagcattagaattataggtgtgtaccatcaatactaggagtcaccgatcacctctggctcttacagtctttccatctcttcttcctcatagatccctgaaccttaaggctaaggtgtttggttttaaaaaaattccatttggttacactgatttatcaacatcaatccttctcacagcttttttaaaaaaatgctcaatgtgaaattgggagttatggggctggtaatatttaatttgtgtagctgcagaagtggcttaatcagtgacaaataatcaaggacctttcattacctcttttggttacttctatgacctttaaaaagcaagtacctgtttcagaaacgattgacctgtgaggctttgggcagcaaggaaggtcctcttggctttgaagtagtaacaactacagactgaactgaaaaaatttctgatgtagatataattgaaaattctatgacaggcttacataattaatagggctgtggttctgttttcccagcatgcagttttaaggtcagacctgtgactcagagctgtgcactttcttggtggtatgcatcagtggtacatctccagtctcatcatccagaagggctttgcccagctcaagttgctcccctcataatccctagttgggtggctacctttccttttttaaatagataaagaagacaacattaacacttgatcatcaagtactttaatgtttttcagcataaagacttagtgaacatagtgaactcccttgaaggagaagtaggtcctatattgccactaatacctcttggtgtggttctgtacgagagcgtgtgatatgctcatggtaagtataagctttttgctaacttggatgttttaaagttatttaaaataaaaggcaaggtcctttgacttgctgtaaaaaaaaatgcacacttggaatcaaaatctacttcctctctggacagcttattagctaaaggttatctagcacggttggcatgagatttctagatggcatcttctctttgtgcacagaaataacctgccatctcatgaggctttgggtgctacccgatccttttgagagcttacatccatttgcttttctctcttcctttctctgtaatcaaaattcccatctctttagtgcgactgagtcttcttgacttgctacctttttcttcttttaagaacatgtttttataccattgtttatcatgagaaaacactagaaatgaatatctggaaacagtggagttgcctactcagttgtgctatatccatgtggttgcatactatatacgtgttagaagatggaagctcattttgtattggcatggacacttacctaaatataaatagaaatcgcaacaaaataaacagagaaagcaaggtaaagaactgaatatataataaaatatccttagacttaaaaacattaattaagatatataatttctctctcttgccttcactcctccccatgttgacaccccaaactccctctcaaattcatggtctctttctgattaatttgtgttgttatgaaggagtgaaaaggataaagaatacttagctacctgcttcctagatctccattatctattgaaacttcagaagacagtggaggctgaggtaggaggagctcaaagttaaggccagcctgggatacatgatgtgaactacgtctcaaacataccagtgggcatggattcacaggggaagtggatcgatggtgacaggcaatgggaggatagcttttcactatatattcttgtattttttgttatttttgagataggctcttactatgtatggctgtcctggaactcactctgtagaccaggctgacctcaaacagagatctatctgtctctgcctcctaagtgctaggattaaaggtctataccaccatgcctttttctccttttaacaaataatatgtttaaggactagtgaaatggcttaacaggtaaaggggcttgcttccaagcctggccacctgagttcaattcctagaactgctgtagagagaagcaactccctcaagttgtcttttgagctctgaatatgtacacacagcccactaaataaataaatgtaagaaaatgtaaaagcacatatttaaaaatccttacacaaaaacatgctcatagtagcattacttactgtattcaaaaagtagagatgttcccagtgtgtcagctaacccacggatgaccaatatattgtacatctatacactggaatatcattttgctatggtataaagtattaactgatgttataacatcatccttaaaatattatgctaatgaaataaaagtagtgaaagagatcagccatggaataccagttgtcttagttgctgtgatgaaacaccatgaacaaaaacaacttggggaggaaatggtctatttggcttatacttctataggcaatgctcattatagaaggaagtcaggacaggaactcaaacagggcaggaacctagatgcaggagatgatgcagaagccatggagaagtgctgcttactgacttactcatcatggcttaattagtctgctttcttatagaacccaggataaccaggttggggtgacccacaatgggctgggccctgccttatcaatcactaattaagaaaataccctagagtcagatcttgtggatgcattttcttaatttgagttccctcccctcagatgactctagcttgtgtcatgttaatataaatttctagttagccaggacactacacattgtatgatcccatttctataacatgccctgaaggggcaactctatatggagacagaaagtacattgtgaggagttggtagggagaaagaagagtgattgctaagaccaggcttctttgggagtggcaaccatgttctggagttagatagtatggatggttatataactatacgcatatgttagacacattgaagtatgtgtattaaacatgtgggctattcctgtcgtgtattttgtttcagtagataaagaccaacttggtgaagtctggaacttggaagcttttgggtttttttctttttttgtttctctctctctctctctctctctctctctctctctctctctctctctcttctgtcctggaactcactttgtagaccagactggcctggaactcagaaatccgcctgcctctgcctcctaagtgctgagattaaagacgtgtgcgggaacttggaagctttaacaatgattgtgaacatgtaaaaccatgaacagctttcttgagttctctacgtaagaaatcttgtcattctgaaatattttttctggtaacaccagaagacttggtgccttttggctacgtttaccaccattttaccaacgatcttttcatttggtagaggaatactgttaagccaaatgaattcctgattgctagaagtattggtaaccccaggctctgccactagagaggtgacaggagtttgcagaggagtctgggaagacatgagagcactatctcctccaagctgaccccacagccatctgctcctcctgtcttattacttcccaggagctgtacattgctcctgtctcttttcatgtgttctcttggggtgagttgagtcacggggtttaaggaaaggaggaaaatggctttaggagtcttggttgatctctgtatgcctgacaatatagcttttcttcccatagtcaccttctttcctaggtactggctcattgtggatttctgtctctagagagccagttgctaccattccatctgtcttggccagaggttggttagaaaattcttcttcttgccttttagcttagagttcctctcagtttaggcatgtcaggatgactttggtgtgtgtttgatcatgtgtagggcaaccactgcctatttctaacaagtgagactttacatgtttgccatactttcccaagctgtgatccaacactggcaactttatttcacttgaatttctgagtctgtcctatacatggcataattaaacagctctttgctatacattctcctgacattcattgaaaaaatggcttatagaatgcagttgtagtctgcattccggatctggatattagatatgagtagcctctttttgttggtgatgctgagagatcaatttaagtgctgagatgcatgtgaagcaaagtgaatccgccttacttattcatactcagaagtcgtgttgaaaagtctgtaaactctggtcaagaaaggccttctcatccactttctttgtaggaaggacataagaaagacccatagtcacaagacaaggcaagtaccctccatctaccttgagaattcagagagctttgttgtcacttggtctctcttgtttgttcagaaactattcttactcatgtttggctattcagtccttgcctttggattttctggtgccagcctacattcctctgagtcctgaggactttgaactttgctccaaactctccagttattctcaggcccatggtctttaaaaccaggctcttggccaagatcccaagctcttatctcctttccacatacctcctgtgaactggtgaacttaataaattctacttgcaggaagctggggtttgggacaactacattttttgcagtgttgttatataaacagtatatagtgattgctgtgtgtcagtcattgtcctgagttacaaatatgctttattattcataagaatagtatcacaaggtcccattattatttccattttatagatgagcaagttaaatcacagagaagttaaatgaaattttcttatgtcatacaatcagaaagtgttaaatgtagactttccatctagacattatgactccagagtccattcctccagccaatacattatttttacctgaactttataaaatagatatacccatattaaatttggagaaaaatcacgattacttttctttaagatgatgatgttaattgttgaaccaatctcatgtaaaagtaagccttaaatttcttttatgggaaggctttgaaaagttctgttcgattcaaaacactacttgaaagtccttgaatgcagtagaataatgagctgctactctgtctcatttttcatacctcaagtaatctggctttatgtacaagaggtgcttacttccactatttgttcttttttatttttccactgcttgaaaataaataggaatggagctggtgaggtgatttctgagttctgagcacttgatattcttgcagaagacttgcttttcattcctagcaccctcttatggttctcaactgcctgtaacgctagttctagggctttggagagatgttctgacctccacaagtgccagccatgcaatggtagacacacatacatgcaagaaaaacatgtacatacatacgtacgtacatacatacatacatacatacacacacacactaaagctttagagaacaagatgggctgaagttaaggttaatatgacagtctttccaagaatatgtcttttactagcttctgacacactagacctagttaagatcctttttgagttatgctaacagactgttcccagggccttgcccgtgtgtaagcctgtgctctcctactgtgtgctatctgcagccctactacactcctttctgggaggcccgtttgctcatccttgtgttctcatcattgtgttcagtgtgcttgctgactgccatagagaacatattgctcaaccctaggagatcagcaactattcactctctttctgaagtgtcagctgtcctggtggatcccctgttcctgttctacccttcaacctagtcttccttacagcttggtgtcaactgccactttgaagttagccagagtttatagtcttgttgactagactcttagtgtcacatgagagcatcccctatgttttatttccagctcacataattgtccccaatctcagggttagtgaaccaagttagtctctgttgataattatcaaagacgaggaaccacaatcatcattcatcctaaacctcattcccaggctttgtgctataatgaataaaggccccttgttggaatcagttccactgtatatgaggaacagtgtctcgagctggaaataattttcagcttgactataaaatactctatgcaaatgaaatgccacagactaggcccatgatgtattctggtccttccagaatctctgttctcaacatatatagattggttgtcaggaaagacaggttacccattggggccctattctgttggtagaccacacactaagatcaccaggtcagttttcacaaaatagtgcctggcctggcacagcagaatagctatttccacagaaagttgttcttgtttgccctcaacatgagtcactgtgggctgccactctcttggatgtgcctgtaagtactcttgggtggagtctagattgagacatttgtggggcaaacagagacagatagaagccaagtgagctttagccctctgatttttttttcagtttgccacgaatccagattgactccactaccaagatagttccctccagcatctaacacagtagagacttcctgagtagcatccaggcacttcttgggctttttctttctgtcgttccatcacattttacactccatcacattttccgattctcttttgagcaaaccccacttaaccactcatgagtttattcaaccaccaaacttcagttcaagagctatgctctggttacagtttgagaagaggaatgtaaaatagtgtaaaacagtcaccatagtcctttggtaaaaaaagaagacagcttataagtctctagtctgaatatacacacaaggaaggagggcttgtgaagaactatggactctttctaatcaaggcagtcaatcaaagttgtcagcactaaggataaagatataaggggaaggattgtagctcaataatagagtgcttgcccagcatgttcaaggccctggattccagctccactaccaaagaaagactaaaggcatgggtactttatttggcttcttcttcttcccttttaggatagctgggtaaatgatagaataggaccatggaatgcttagccctctaacatctctccggggcttgaaaggcctgtaacaggtggacttggtgagtgccaggactggggatgattgaaagggtgttttgaatcatggcacatggcaacagagaaataaaacagatcacaagtggctggtcgaaatagactaggagagaattttaacacctaaaatatgacaaagatttatcgctaccagtagcatctccaattcataagacatttattttcccttgatctgagagtctatatttacattatattttttcttctaaaagttttcttatttcctcgttccagttttctctttctcagtgttacattaatggtgacttctggtcagagtctagtctcatggaaaagatctattggatatggttgttatagtatctgtatcttggtgtgggtctttaaaaacgtgggacagaatagactttagggacgagagactttaaaattgttattaatcatggaatgacatttttaaaaatcaaaggagagagaccatggcatatgctttcttcataatccctgtgtgagtattataaaagaaaccctgggccatggtaaattaccttcaatacacttatgtggcattttcagtttgccttgctattatagtcttctctttgtgtatgttatgccatttgtagggagtcttcccctttccatagccatcgtgtcttttctctgagattcagagaccttgtgggcaagcagaactctgtgctttcatttgactcttgtgttataaaatggcacttgtgtgatcccagagtgttccttcattttgctctttcatgggtatgctgggaattgtgacatttaagaagtgacattgcaaaattgaacatgtcagttggcaatagggctcttccagccttaaagattgccaagaactcgagatggctgaagttgctctggacttatttctggcaagagtacacagggcaaaaaatactctggacaggtcaacattgaatcacatcgtatcatagaacatgacgagatgctttaatcttgtggttagactcactcaggagaagtgctggtgcaggaacgtatcctgaccaaattatgctgagagaaactcacaggctattaatttattagtagtagtcaagaataaaataacgcataaatgttcaagatgaaaccaccaagactccaatcttggtttgaaataaggctctcgagtttggccatgactagtggcatttaattgtttgagtaagttttcagtaacttggaaaatgtcttgagtcaaaagaaaatggagtaagatggaaggctgaccgcaagtcacaccttgaaggaggaggagctcctgagatatacatgggccaaatggctcactgaatttgctctttgactcagaagtgtgatcctcccagtggcggtggagagataagagtctaggattagattgcagcaggataattctcacaagtgggattccagtgtgatcttacactcagtctttcttgacttgaaaagctagatgcccttaaagtgtgtttgttgttgcggtcttcgagaagtgttactgtggaggactggatgaagtgctcctcttccatattttcctgctcacccagaatctcaactgcagggaccttgttgaccgtaccccctcctctgcaaccagtaagccccatctttcctattctataatatcccttctacctagtctttcctttctgtccccattgtcagtacctcatggtcatttagtcctgtaatgtctgctcaaacgcagtactcttcacggcctttaggctcttctctgatagctccccttttctctgcctatatcatacactcagatcactctcttcctgtgggtcatttgaaaagtaagcctatgtgctctggctttcctgcctgtagtcttggctgcattaccgccttaccactctacttaacagccttctcctaaccagacttgctcctgcttctttcgtggacctcgtattcctctcagaacatgacccacatgctaccttttttcttttcttttttttaattaggtattttcctcatttacatttccaatgctatcccaaaagccccccccccataccctcccccccactcccctacccacccactccccctttttggccctggcgttcccctgtactggggcatataaagtttgcaagtccaatgggcctctctttgcagtgatggccgactaggccatttttttgatacatatgcagctagagtcaagagctccgggatactggttagttcataatgttattccacctatagggttgcagatccctttagctccttgggtactttctctagctcctccattgggggccctgtgatccacccaatagctgactgtgagcatccacttctgtgtttgctaggccccggcctagtctcacaagagacagctatatctgagtcctttcaataaaatcttgctagtgtgtgcaatggtgtcagtgttttaccttttttcttgattggcctcttccccttctttgtccagtacattcttcactattcaggacgaagtcatggcctagattctgtgatctctatcaagtgttttctggtcctatcttgacacagtttctgccagtgataaatattgctaacattatctatctttcctgtaatatcatgctctgtcttccatggaaattatttgtatatttatccaggtaacacttcacagtaaggattatactttatttttcctgtctagaaaatcagtttggagcaggtagtagtagggtatttgtttaacaagtggttttcatataagagaggtgaatggatagggtcatgtaatcatggctagatctcaatgagaagctagaatctctccatgaattgttagaagacacagatgagtagataaactgatgtaaatggcctcacaaggatcacatgctagaggagactgaagagatttgatgcctagcactcaataaaaagtcatcctgatatggctagcacaggataggtgccaaagagaattgttcactgactgctagccaacctccccaacagtgtaaatagtagaacttggtaaacagtacagtggttatcgaagagattgttatatatcgtactgttgatgtataacaacattaatgcaaatgccagtgaagttaatgactgcttgggtgtctgctaagtagccattaagctgtctaaaccattaacccttgttactgagaaatcactttttcctcatggaaagggggattttttaaagtttaaattttatttctcttttatccacaatttaaattagttctttgagaatttcatagaatatatcttgatcatattcacctttatctctaaaatcttccgagatacaactcctttgaccctgtgttgtctgttttttttttaacccatcaagtagagtttgtgtggcccatctactcttagttgtatccactgaagcatggccaaccttccaggggtcacatcctctcccagcagttatcagttgtcaatagctactcagctagtgcttggatttggtacccacccttccctctctatcctgggattttgtctggctagaacctgtgaagattttgtacatggtatcttgatttctgtgaattcctatgagcaaatgccctgatgtagctggaaaacactatttccttgtcacccatggttcttacaatctttctttttcctcttccacaaagaactataaaccttgggaaagggaatgtggtgtagatgtctcatttaggactgaacgttcttcagtattagcctctatactttgaccggttatgggatttcactgttaatcatcatctactacaaaaagaagattctctgatgagggttgagagatggactaattcctggctataatgataattcattagaagtcagtttaatactatgcccatattgcagagtaatagtagtatgttgtctcctatggtctatgacctgtctagccataggttcttagtcccaatagtggtcccagatgtgggcttcatcttgtgggttgagacttaaatataatcataaagtagttggttactcccataacaatcatgcccctcttgccccactaggccgatcttagcagtccagttgttattgtagcttgcatggttcatagctgggtaagacaacgattgctcttctcttctgatagtgtgcactgtgaaagctacccagtagggatgaagcttccaggtgagtaccagcttgatttctcaaggttctaagactccagtatgtagtatcttctgcaagagggcgttgacatcaagttctgtaaggtaaccaaacacatcatcaaaaaataccctgtatttggtgaaaggtcaaattttgtgagagttgatattaacatttggagccccagtgtccaagcgggtggtagtcttgcctcctaaaagtctcttaggaaagccgaggtacatggttgggctttgttgcaagtgggataagcgcaccattaggctgagcactcacaccacactggcttgtcctcattgactagtgatcatgaagtagctcttatctttatatattctcttctatttgaggcaaaatagacccaagtgtatttgccagcttcatgaagccagatgtccataatctgtatttgctttacaaaatgagccaacacctaaatgaactgccatagtggctataaaacctacatcccagtgtcaaacttaaaactagaactgatgtcctatgagacagcgttagctacacaaagcttatcattcacagccctgtaaagaggaggcgtttaaaaatacacagaccctaagaatgtctcactaaaatctaaagcaagatttgtaaaggttaaacatctaataaagtaagaacagttcccttaggtgaagagtgtacattgattttaagggtgtggtatcgtaactagtcagttacaattttatcatcctgaacaaggaaatgtccaggaaggtgtggaagagagcacaatgtcacgtatcttattttcctaggcttgttttttttatacttaatgtcctgaattttattcttaagccagttccagataagcaagactaagtaagcagaaatttcagttatctttttgagaaacttttccttgaaagcttgaaggcaaaaataattggaaaactcatttacccatctaggcacatcacatttgcctgctctgtacttcacaaacattctggagcctacacagtcagacaagatagtggttgctacatgaaactcaagaagaacgaagaccaaagtgtggacactgtgccccttcttagatttgggaacaaaacacccatggaaggagttacagagacaaagtttggagctgagacaaaaggatggaccatctagagactgctatatccagggatccatcccataatcagcctctaaacgctgacaccattgcatacactagcaagattttgctgataggaccctgatatggctgtctctagtgagactatgccggggcctagcaaacacagaagtggatgctcatagtcagctattggatggatcacagtacccccattggaggagctagagaaagtacccaaggagctaaagggatctgcaaccctatagatggaacaacattatgaactaaccagtaccccggagctcttgactctagctgcatatgtatcaaaagatggcctagccggccatcactggaaagagaggcccattggacttgcaaactttatatgccccagtacaggggaacgctagggccaaaaactgggagtgggtgggagggtatggggaacttttgggatagcattggaaatgtaaatgaggaaaatacctaataaaaaaattttaaaaaagatagtggttgctaagtatctagcccagggcctgtccctcagtgagcgcctgatcccttcctggagttcataaccaaagccattttttagattctagatgggactgtgttttggaggattaattaacacatttggcttgtcttaatatattcctcaaacacatagcttttgagtgcttcctgggagctcagttgattctaaatgagaccataacacagatccgaggaaagaatgagaaaaacatacaagccaagaagtcactctgatgcctgcttttagaagggctgtagaactgaaggaacatcatcagatgggaaaactagcagggagagggtggtagcaagacgcacccattagaactgcgtggttagagactttctcttagagtgtcttggagtgaagacaacgtgaggagaggaacagctgggggaagcgttgggcagagaggtacagaggacagcaaggaagccagtgaggttgtagccagggcagagaaaaggtcctttgaggcttttcttagaaccggttcacaatctccagtgtccagccaatgatgtcacgtggagctactatatgtatgatgattgatatctttattcatgtttttatcattgtctgtagcagcaaagattgacagtccctattgtagatgtaggaatggataccattctgttctgtttgatgctggagttagagtgccatggttgctccgtgttttagtgatctgctatttgccggtacatatccaggaagacattaaatgtctataatgccttaaggctctcactgtaatgttttcctttaattacactggtagcaaaagtccatctcctattgttactttcatcattagcaggacaaatatgcattatttataggtccaaaggcaggctcctgtggcatataaagtaaattaataaggatggctcagcattaagctatgtcagagctgagtccaattttattccggtccagggatgactttctatgtggcctttctggctctgaagctaatttggatgctgagtagccccacaggtatttatatgtagcgtttggtatttttactgggccctattcttctcccttggatcacctaaaatggttaagaattttctagtgggattaaggttgtgatctcaggggaggggtgggacatctgctcttggttatttttgtgtgagctgcttccccttaaatgtatgttcacaaatgagccaaagcgttatcatctggggttgagggaagacaggtctgggtgccgctcctgaacttggcctctgagccatggcttctcaaagacactcaggtaaaaacctccctgttatttctcttatctagaggacagttgtttcaggccaatgaatctgtcattggtctagaagataatttgggatggggtgattttagtgctgtgtaaatggtaagtaaatcctggctgctgtctgtttcgttcttgttctgttttaatgatgagatgaaagtgttctccctcaagtaaacttagatgctaaatttattgattagtattgttttataccttattttacatttcaggatgtcttgggaaacttagatataatgtgatatgaggaatgaagtttgattttgttgtttggtctgggttgttaggaaattttggggtcattcatctctacagtacttgaagtctaacgtaaggcatttagggaaagggaaattgagtatggagagggaaggaggattatatttgtaactaaagtatccataaatgacttaagatgtcttccttttttccaaacaatattcttaatttttctaaagaatcagttatgtgtctttttgtcatggaaaacatagtatttgttattcttagctgaaaatgtttcctgtcccttaaaaaccatgagtgagggtttcctcgtgttttatagcctggcattagggatcctttcggccctaaacaagatgcctatgagataggggctggaggctggaagcccagtgctgtgaaactattgcactgtctgtgtcactgcctaaagccaagagtggagctgtttttctgctgccctcggctcctctgcttggcgctgggggagacagatgggcagaaaccaaacacttgctcctgtctcccaaatttcaggttatgggacaaagttactactgatggtagtctttttatttatttatttttatttttttatgtttggaagtttgatgtttgaaacttgggattgcctgttgatattattgacaatagaaatagcttttgaagaaattcctttttcagtatgtccaagcacatgtagagcggtggagttgcccacttaagtaatacacactccttgcattgtttctgtgtttaaaagctgtttgatgatttttctataaccctcagagattgttttaccaatatggattggtaccacatgtctgaggtggtgattatctgccaacccatcagctggaccagtttccctaatgggccttgactccacatcaactggtagattagttacaattggattatctaaaaatattacctaagctcttaggtgataacaaaaacaataatgataatgataataataaaataacaaaaattgttagaacagttttaatacttattatatgatttttataaattaagaactaacagtgtgctttgtggtaagttcattggtccatagaagcagagaagaactactttcatagaggagagagaagccctcacagaaggaaactcagtgttgttctgaaatgggctttggttgagcaacaggaaggctcaggtctttggatttgaactcattttttcgtagccatccacacaaacgggacattttaagggcaaaggtgtatactttcagcattaaacattttttgtctgaaaaaaccccatcaatttaatttctgttactctttggcttttcaagtcaaggtccatgaatagagtgtagagagaattcagattattttttattatcctgcagttactagttctcttcacaggccaacgaactatctcatacacctgctaccccctccctttttttgtttttcgacacaggttttactgtgtagccctggatgtcctggaactcactcttgtggaccaggctggcctggaattgagagatacacctgcctctgcctgccaagtgcccactgcccctccctccttttaatgctaaaaatggaaactaagagttgggagaagaggagaggaattgaagagaagtgccttcttaaaatcccagacagacagagtggtattagttcacagctttgtccgatggaagaataaacgcagatatggtttcatttaataatcacatatgcagcccttcttacactagacatgaactaaaatggtgttatctgtgcatcagtgactcaaaagagctttaattttttttaacaaattgtggcattctagagacattgccagtaacattggatcattgtgttcattttatatttttaagcaataataatgataataataataataaaaaactcttgctgaattttctacaaaattttcagctctgactcataagttccatttccccgagactatttaggtgtttattcccaaatgtctgacaacacccccaggtgtgtgttagcgtgtctgtcacacaagtgtcctattcatcagctgagcttctatttgttgaatgttctgaggagtgcactatgtccttttctctggaagccaacatttattgctatggcaccgatgtgttgcactgagcaatgagctggcttttgttttccctctgggtggtgttcagtgtttgcttggttagagcagtcaggcaaagcacacagagaaagaagggtgcctagatagagcacccactttcttctgaaaagttcatttgaaccacttggtttgagggacaaatgaatattattagcaagaaagactttagaaagtatatgaaaccccaaacaagactttatgacatacaaatcttctttaacaggtgtacactaagaaaagtgcttgagttagtgaatatgcagttgctctttgtttctaagtattagttggatatgtatatgattcagtgtgaagctaggtcatttttctcttgtgtgtatacacatctgtgtgagactgcttaagtgtgtgtgtacatgtatgtacatgtgtgtatatgtgtatatgtccccatacgtgcatatgtgtgcttatagaaaggccagtagtcagtgttgggtgttttcggttgtttatttttggaggcagggtctctcactgaacgtggagttcagcttggctggctggctaggacaagattcaggctcacaccagtccaccttccttttttatgtgggttctggggagccaaagtcaggtcctcatgttcacacaagcattcaactgagagatccacccctccactctctaaattctgtttttgagatactgatgtttctataagcaccttttggcatgctggatataaattaagttcgttcattctctctctctctctctctctctctctctctctctctctctgtctctctctctctctctctctctctggagggggaagcatacttattaaatgaacaatgatgtttcctgagaaaagtcaggctgacaccatagaatggctaggtaacatttgatcacctagctagattttaactgtattaagctaagcatccagaattactttccttaaacatatttgtaccaaagatatcttagaaaaatcagatgacagttcacatgacagagaggtattgtttagatgtggggaccttaggataacgggaggtgaattttaaaatcaggacatagtattttgtttttaaactcaggacctagtatcaggttcatttacctgtaaacgtaggaaagaatttggttcatgaaagagaaaaaaaaagttctcccgaaaggaaagccagtattgcctagaaatagaggctcagatcattggaccagaatccattccgagcgcctgtccacacactgaagttttagaaggtcagtggggatgaccgtttcccatctgcctgccagtagggcacagtgaataatttctatatataaggtcctgaactaggttcctgggcttccattatggtggcagagacatcacttccatgtacaaatgaaggctacgctgagattaaaattcattaaagaaggtgccctcagacacagtgtctccagaagaagcaataagggaagcggcagtgtcagtgcatgtagcagtatttccatttcatggtagatgacctttccaagttaaaaaccattgtaggtcaaagcaaaggtgtctagaaatttgtggggtgtaaaaggttgaacatttcatgtacttaaaaattgctaaaggagtagatttctttcttaagggagaaatgctgaagagcatgacactcagcaagagtagagagcccaccaaggaggttggttccttcttctctctgctgatttctaatgaaggcgaggggtaaaccaccagcttctcctctcccatatgactccatcttccttggcacccaccacttagaacatgtattctcctttaggaacctttgtgccaatactgttgtttgtccttagcacctgatgttaattcctgtgaatgtttttgtcttgaaaaagtacctatattttatgtgaggttttggtgcagtgactatctcaccagaagcaatatattactccagttttgtatgtagtaaagcatatgctataaggctttgcaatcgttttgtaccaaataatcatatagttagaaaaaatgagaggttggataatttaggttgcccaaagtttcacttagatttttttgctaaataaagttaatgtatttaacattactacatactttaagtatttccaaattgtttgtgcatttgaggaggaatccaacattcctagacgtgcctattttatcttgattaatagttgtttccacacatagaaatgacttgagtcaactgttaaaaatcagtcctaaaatagtccctttgaaatccatcttctccagctgcatacagagtctggcctcaagtatattgtggtggggaatctgaggtgatcctcatttctcctgcttttaaaatagaaaaatatagccaggtggtggtggcacacacctttaatcccagtactctggagacagaggccagcctattctacagacaagttccaaggcagctaaggttataaatcctgtcttaacaacaaaacaacaaaaaacaagcaagcaaacaaacaaaaaaatcctaaaaagatggacagccaaaagccaaaacttaaaagcactgagatttgaggacaattttgctagtaccattaacttggagttggctcatttcatgtgtctttggcgtgctttagaaacctgtgttaaaggaatgaacaggaggtgtgtattttcattgatggatatttctaatacactttggtataggcatgtctataccaacctgcagactacatgcatcccaggatagctataagtgtgactctgcacatttgtgcatcaaagcaccatgtcacattgtcaaaaggctggaaccttgctcttaggcttggcaggtatctgtctggtactctgaatcgtaatgtaaactagccttttcttaaaaacctctagataccagctcatgcctgtaaaaatctcaacatgtaggaggtctaagtagaaggtttactacaagttcatgaccagtcttggctacagcattagactttgtctaaaagcaaagtcaagacaaaaccactagatacctataaatgaaatttgctgtgttttctagcattttatttctttttgtgtgacccagcacctattttaaccataaagggagtgcccagcaataccaaaaggtaggactccttttaggtgggaatcagtacagttcttaaatagaaaaatatttagaatccattacggcttttctagacattaagagagtgatagtaaacaagaaatagacaactcagtaagggagaatgtttgcttttcaaatatggatgatggaattgctgggctgcacaaattctgtttccttgccattggcacttagagtcactgatcatttgagttccttgtacttagtcttttgttttatttagtttatggtttaaaagattaaaggattaaaaccagggactcatgcatgttaaacagagatcctgcccttttatccccagccttttaaaacttagaaaaaaaatcacaaggtggcggtttgattcagttgcaaaggctagctttgaattccctctatagagcagataggccttgaacctccatccttctgtataatccccctgaggagcagggattacaggtctgtaccaccggactgacctggcccctacctggctggcatctaaagaatcagttgggttttcaaatgaggtcttagaaagaaagcccatctttgttgatgtacacaaccattgtacaatttccacatggcagaagaaaacaaatgggagagaccagttcaaacagatggaaaggggtttcccacaggcagtcatggccacgggtacttgtgcctgtaagccacaagaagttggaacagatgcctcaaagttacttggtaactcaagaaaatcgactgggcttccttgtgtgtgtgtagtttgtgtttacctctatacacaagggaacatggctggggattttagagaaaagcccaagcaagagcgattctctcattttccctattgacttgacagcgatacaactgtgccaagcaaaggtcgttatacaaaaatgtccctcatttacttcttgtgtcacttctctgacatgaggggcctgggtagtggatgtgtcagtggactttgtgtttgttccatggccccaccttcccttgcggagagagactggcataagagactgacagtccaagtgagagttcaccagcctcagcccaagcgcgttcccagacaaagggtgtggtttccttagctcactctgctatttggttgcctatggcagcagaatccaaacaacttggacatgtggttgcatttaaaaaaaaaaaaaaaacctgggaatagaacccaaagcaggagtttggggccattcagttggtggaagagctgcggtgagtacagacaggcaactgctcatttctctccccattctttctctaaagtacatgcaggatgaatagtttcagttcaaatggtttcagttcttgtgtttctaacacaaattaaataattgctgtctatttgcttatgcaaattccttttctaatgggagaagaaaaattagcatatgtgtgaagaaattgggaactaatagaaacccttcctggtggcaggattctctagaaaaaaaaatggtttggcaaagggactggcagcagaagaccttagcagggctgtgggagtctgtaggcttgttacttacagctgtctggggccacagctgggatgctggtggggagcgaaaggagtttgatcatatgagggaggaggaggttcttggaatggcgactttagccctttgcaaaagtcagttttccagattatacttaaaactttttttttttttttttttttttgctgtttagagcagcagatatgacaaaaggtaatacttgcatagctaggccagccctcactgtctggatctgagagagatttgattttgatgtgtcacaaaactctacttcactgtgacaaatccttcataattgcagaatgagcctgttggccaaacttcagccaccaagaaaatatctgggacaaaactgtctgggctctttccaaggactgaagctgcttctgtccacttaaacatttgaaacaagttcatgagggctgcatgggtgcctgggggtaatgacttagctgttaagtttctgttcggatgactagaactgtatagacaggaaggaagtgagaccacccgaacatatttgcccccaccctaaaaggtgacagaatatgaggtcaaaactggcagggaggcttctggctggctgtgtggtgggcccctgctgtgccccattcttttgaagtgtcggtgcaaggcagtagaacatggcatagaccagtggatgcacgcagtacacctgccctgcccaatagtctttttttcctgctccaccttaccctcccattcccctttccattcttggttacttttcaaccctggatgaatctcccagaatccctctgtgtggtgaccttagcctaaggtctggcccacttgtcctctgagtcagcagcgtgatttctgacatgtccctagggaattactggcccctttacatgtgatacttagagttcaaatcagaggccttttcttcctgggagccatagtgaagtatctgttgctgtgacacttggtaattagccaggcttaaatggaagctggaccctgaggactcagggttttcctagctacttgacaacagtgccctgggacctccagggctgtctatggcagagtgtccttgtgtttcccttactcatttgtcctgcttgcttgtccctacaggtccctccagctataaggtgggcaccatgtcggagaagttcgactgtcactactgcagggaccccttgcaggggaagaagtacgtgcagaaggatggccgtcactgctgcctgaagtgctttgacaagttctgcgccaacacctgcgtggactgccgcaagcccataagcgctgatgccaaggtaactgttgttgctgatggggaaacgggaccggctgggtgggcttcaggtgtattcctgcagccttgccagcaacgctgccaatttgaattctcatcacagcagccttaagtacttgaggcaggtgcttctgatgtccctagcttaaaaaaatctataatatggacattggactcgatggcctgctaaggcactgccagctctttcatagtataggtttaatggcctttagccgaaaagcttagcaatagaagtgtttaattttggatttcttattttataatacttctacatatttaatgaagggtactaaaatgatactcaagtctaaacacaaaattcatttacatttcatatatacatagcctgaaggtgattttatatagagtttttgtctttcaaattaaatataattctatcatttttcccctttccctttttttcctccatcctaatttgggcatcctccagttcccgcatgctttctctcaagttcacagcctctggcctcctttccctttactgtctgtggaatgtcatttctgtgctctagctgacgggactggaagggtcttacttttcccagggacacagaataaactgtgtgttgtgctttgacactgtgaccgtgacctggcccacgagatcagatgtgtccttttctccttgtgagatctgtctgttaacccgtttacgcttgagattccggagccttttggatttcaggcttgggctgggggctctcccccctcctcttatgtactttgggaactgtgaggctttcgtcttcactccagtgctactcttcctgttactcctaaaagcactcagcacagggcatccccacatggagggggctgacattggcgtgagtagttacctggccctggagaacctggtctctgatggtaaggctactgccactggccccagtgcccctcacagtggccaccctgctctgcttgatgtccaggaggtgcattataagaatcgctactggcacgacaactgcttccgctgtgccaagtgccttcaccccttggccagtgagacctttgtgtccaaggatggcaagatcctgtgcaacaagtgcgctactcgggaggactcccccaggtgcaaagggtgcttcaaggccattgtggcaggtactggccccctcccaccctgaaggcagacatgctgtgtgcttgcttgtcatggtggggctaactttgctgtgagctgctttgagattttagcatatatatgtacacatatacatacgtgtatgtatgcgtacatatatatgctcgcacacacgcacacactcggagactaacgagcactggagagaacagtctgtggccagagaatgaagtgagaagtatgtagcatttcctcctttgggcgtagtaagtgatccatgcatgcttcttcctcaggcgtttttgggttaggcagacccgtagtgaaacttattaagtcattgcaatggtggaagtggggcgtggggcttcaggtacctctcctaaatggtcctgccaggatccccacctgtgacagagcccggggttggcatgactgcaagtagcactcagataggatgaggccactgactgcagggccctgcatcccctcacctctgggggtgggctggggagctgagtggatgcagccccctgcagagcctggcagtggggctatcacattgtttccccctgcaggagaccagaacgtggagtacaagggcaccgtctggcataaagactgcttcacctgcagcaactgcaagcaagtcattgggaccggaagcttcttcccgaaaggggaggacttctactgtgtgacttgccatgagaccaagttcgccaaacattgcgtgaagtgcaacaaggtatgttgtggtaggtttgcatcaagtgctgtttccctggaggttggcagtttgcagagcacttgcacacacattatctcattccatcttcatgatagccctgtgacgtaggaattattgtgcccattttacagacgaggagccgaggcttagaaagcagtgccacagctgattgtctgtgtctctctattctgagccggcagccctggctctggaggcctgtggcctccactttattcctttccaaagaggcgcaccttgtctaggccttggtctcctcatctgtaaattggggataataatagcaccttcctcccatggctgtagtgctaatgaaatgagatactgtatcccgaagcatccagcacagtgcctggttgttgaatctgaatcccggtgctacactccctggtctaggccatcacatctggaggaatcacttaccaggatcagccctggcatgccgagtgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtcc

SEQ ID NO: 462 - DNA, 58908 bp, mus musculus
tacatccaccgcccggccgagggggctcagtcctgtgctgccgctgtcgccgctgcgctttggtctcggagctggcagcggccgccggtgccgcctagacagctgcgcgggtgagcatccccagacagtaagcccgctttccctccgcgagtgtgtgtgtgtgtgtgtgtgtgtgcgcgcgcgtgtgtgtgcgtgtgtgtgtgtgtgtgtgtgtgtgtgtgtgcgtgtgcgtgtgtgtgtgtgtgtgtgtgcgcacgcctccggcgtccccggggagccgcagctcgtgctccgtggccgctactccggggctgcgcggacctgctgggcttgggtacctgcggcctccggcctccgctgcctcgcccacgttgggggctgaggaacctggggctccaaggtcccttagggtgcgtgcctaagcctcctccccagggctttcgctcccctgggggccgggatgcaggggggcggctttgggtgtttcctctgcaaggatggagggtgggagtaaaaagagggggcttttggttttctcacccaggatggcgggcagtgggggttgggcgaggtgggaacacctttggtttttgtttttggttttttttttttctttttctttttaaaggatagctaacagcagttgagaagagcaggggatgatgatgacgatggggggggggcttcattggtttttacattaaggatggcgcctgttgggcaggggaggaaggtgaaacctgccttggttcttggagatgttgagggaactgctgtgctccctttggggatgctggggaggaggcagtgggaggactggagtgcaaggagaatggtgatggagggagaaggctggtcgtggttctgctctctgagggggaatggcagtgatatgggggatgggggtgggagaggggactggatttcagcttcagcatggaggcaagtggaaggttctagcacttaggttgagccttggttgagccttggcaaagtgggttaggtagactgctgggtgtgacctttcaatttcagaaagcttaaaattcccactagatgcagttctgggctcctgggaagaggtttctgcttctcaagttcccattgcttagtcttccacaactggtagaggtttgaatgagaaaggccaagggaaacagtgaatgtgctgtgtattttctgcatttgggcctttcaagtttcttgggttcattctgattacaacgacacctccccccccccccccgccatacacacacacacacaaacacacacacacacacaactagggtagcacattgggaacaggagacaagaaagtgtatgaatgtgatttcagatttggttttgggatttcctgaagggcaagagttctgtcgtagaaatgcagcaagagtggaacacatgtctttgctggaagtcctctgttctcttcatttaaatgatgccatcgggactatctgagcctcttttgatttgaatttggactagatccagttttcctaattggagctatcattttgtaattgcttgtaattctccatgttatcaaatgtattgcgagtttagagaatactgggaatatttttgttatcttgattaaggccgtttaaatataaatataatgttccttggaaatgagaatgtttacagagtagcacaagtttaaattatgggccacgtggaattggataaggagttctcatccttgcccatccccaggaacaggctactccccattcctcacatttgaaaaggattggggttggtaattttgtctttggaaatgcgtgcccatattttcttaagaatatgcattaaaaagcaatgggccttaaatgtgctaggaatataatgcttccctgtttccgttacataaggttccaatctagtctaccttcactcttttaaaacatttatttaccatttttaagggcaaatagaatctttatgcaacagggaatttgttagataggccaaggtttgtacaatgcactacagagtaagtgcacattttactactaccgtatagaatctgtaaccatatatggcttctgaaattctaggcttccattccatgatttaatctttttggagaaggaaaacatttttaaagcaagtctagattgggggatgaaattttgaatgtgcagattggtaaaatacctcttatatgagttctttggagatgatttaatatatagtaaattaatggatcacctcaataagatactgactttgtttattgcaaatgttaatacataagtgggtctacaggattaagaaaaatgtatttgcttatgctgttgtatactattctacatttctgtggtgtgtattctgccccagtgcaacagtgagacagaaccgattttcacaatctaagtttagcctggtgttttttgtctgaggaataatgctgaaggtggtgaaaaggaacagtatgttggtgggaaaatgggccttaagttgctctctaaacaaaaggagcaaagggagtcttttacttggctttttgagaacctgttgtaagatgggaggaaaaaaagatgaagaactttcagaaacgaacaggacaatgaagtaattgttttaaatcttagagagttcactctgttatcttttttttaaaagtaacttgtcaattgaacttttgcgtgagaaactcaccaccctcgcaccttcggtttgaagaattatttattcatttgctgtagtcttggagatggaacccagggcctcctgtgtggagcaggcgcctttatcatagggctatgtccctagcccaagtttagccattaaaaacaaataatttgttgaaggcacggcagctaatctcctgaggctttgccctgttttcctaatctcttcctcctggttctcctcttccctcacccctcctttgactcccaccccctagtgccagaaacattggcttttataaccttgtgggagttgaacaaatgttcctgcttgcttgaactttagtcgttatctcgttggctgctttccttaacttttgtctgccctttttttttttttttttttttttttgttaactgaactatccagttgtttggatttgggataaaagggagaatattgtaattattttttcttaagagatttttttttcttttagctcctgttgaacagagcaggaaaaaaaaaggtttctccctgcccccccttgtctctctgcctctgcccccctctctgcttccacccctctgccaggacagtgcgtaattaagcaaaatatatgaccattcctttctccaacaaacatttacagagtcactgtggtggtggtggtggggctcttgtacccagatcctgagtatgtaagaaatggctcctgttgtttctgatttgattaagaaaagaaaagtgtagacagttaatctgttgtaaataattaaaagatgcctagtctcttagatagccacagagcaactgtgaagacaataaacattcttcaggcctacaaacagtgaaataatttctttgtggtgactttgcttgggacatactttttcatttggggaatacaaatagattcggattcaactagtcttcttgaaagtatttgcaaaattgacatctttattaagcctttatagactttgttgtctgaagactacatagcagtcacatgattttgaatatcataagtaatttgagcgatttaaagtatatgggaaaatatgtgtaggttatatgtgaatactgtatcattttacatggacgacttgaccatctgtgccttttgttatctataggtaggttctgcaaccagtctccaactctcaatcttcttgcctctgccttcttattgccactgctcccatctttctcctttttctttagttaatataattgtatgtatttatggggtacaacatagaccactgatacatatatatgcaatatgtgaaggtattttctatagattaaatgcaatttacaggattcatagatgtttaaattcacctttctcattttcttttcttgagacaggttctcactgtgtagctgtggctgacctggagctcactctgtagatcggctggcccaaacacacagagatccacctgactctgcctctaagtgctaggattaaagacatggctaaatttatctttccattattgtatagattattggaacgtggatgagcagcctcccttcctgtaatttagatttaaaacattttctgatggcaaattgaggccccattgatcaattttgatttatagttagacatgggtgatggagtccagaagaggtctagtatttaattctagcttgataagcatttgatctttctcaggataccctctgagatcttggaggatccttctgtttgtggaatgtgctagaatagtagttttcatccccagggaatttgccacacagggttcaccggacaatgcccagtagatcttttttttttcttttttttttgctagatgcacttcctggaatctagtcactagaggccagggatgttgcttaaatatcctagaacctacagggcagcaaccccagcatagatgtgtccagcctgaagtctcagtaatgccgatgctgatgtaatttcctctgctaacacaggaacacataattccaggagaggaaaggacaatagcagtgtgctcatgtgaccctgtagagtacttggctgagctcatttgattagacttcaaagtggctagttcctgcccaccaaactgaataattagaataacagcttgtgtttatggccctctgttccaggtacttgcatacattacatatttctcttctttggtaaaggaggaaccaggttcagagaggggatataagttgccttgggtctcactgctggttagcccttggaagtgaagaaaaaaatcttctgaaatttattgtctcccttgtggtgggcatcattcaaaaatattaaccagcacaatttttaaatgctattcaagttcattagtatatgtagactttcttatttgcaagttctttataataaaaatagagtatggtattggaaaaataaaaattgctgtatgtcctaagtaccattgagcttgcttgacattaattgaagccagggatgataaatttggccaggcttggaaagagggcagtggagaacagggaacagggaactaactttaattatttctaccttgtttcaggaagtatgctagtttggttgacacagcctacctagtttgatcctcttacttagttctacagagtcgtgcatgcttcctagtttgagtttggggccaggcctggggttgcacccctttaatcctagcacttatgagacagaggtaggcagaacttggagtttcaggctagccttgttagggctatatagagaaaccttgtcatgaaaacaataaaaacacaaagcacaacaaccaaaaagagtttgcagaccgaagagttgataagagacagagttggaatttgagttgaggttccatggctaagccgctgtgctgtccctgccaggaaggctggtgttgagctgaccagggagagggagggggaaggggagggggaggggcagagggagagagagacagggagagggagagagagagagagacagggagagagagagagagagacagggagagggagagagagagggagagagacagggagagggagagagacagagagagacagagagagacagagacagagacagaaacaaaaagacagagagtcagtcacttggtcctatgttgccaatggattttgctgtactggcattgagaataaggaggtaaatatatgttctctcttcaactgatgagaattgaattcaattgcggatttttgtttcttctccaaaggagctgcagtgtttagtttggagaactttattctctttacttgcctgaaattttaaggaagagaatcacaaacctgggcattatctactttggcatccagccaggcactttcccttctttacaggactcactaatgacagcatctagttttctcttttttatataatttgaacactcatacttgctatgggagttgtttctataataaatactagatttgtacttgtgttttccatttggggtgttttgttttgagagccaaatatttatcttaacttttgatgtgttttgttttagagcacaaaaataggagagattttaaagaaccagcccaataacaatcatattttgtctggaaagcagtttgtgtgtgtgtgagtgagtgagtgtgagagagagagagagacagagagagagagagagagagacagagagagagtcagagaaagagagagacagggaaaggaggggaggagggaaagagggcagaaaagggtcctcgagtttcacttaatttattttaagttggaaaggaattttaaccatgattctccagggtgagagtgctgggggaaaaaagagctgttatttagataagatgcatgttttgatttctatataggactgtcagccatagattgtgattataataatgttctgattctgaccacagcagtcagccaagtgctaatcacccactgcgtgcctggttttgctcccacctccctgattgtgattcagtttagtctttgctgtgtggggtatggaaacgggccttgtgcatgctaggctagtgcactgctacagacctacattccctagactcaccccactaagttcggatagatgggagatctagtaaaacttgtaagactacagaatcctttctgtaacttagatctttcaatgataagattagtacttctcggggctggtgagatggctcagtgggtaagagcacccgactgctcttccgaaggtcaggagttcaaatcccagcaaccacatggtggctcacaaccatccgtaacaagatctgactccctcttctggagtgtctgaagacagctacagtgtacttacatataatcaataaataaaatcttaaaaaaaaagattagtacttctctgttatacagaaaggccttgagaagaaaatgagcagcatatatgatctaccatctagaccagtggttctcaacctgcctaatgctgtggccctttaatgcagttcctcatgttgtggggaaccccaaccataaaattatttccgtgctaccataactgtaagtttcctattgcaatgtaaatgatctgatttgcaagcctcacaagggttgttattcacagattgacaactgcctgatctagaagtttgtgacaactgtttatgaatctttaaaatgcagtcaatttttcatggtggactcaagtctattccaaagttgccaatttaaactcctctcaggttttctaaactctcaaaagactgggttcctgctgcacagctagctcgtcacaagcacactgcaggtgaagggggaagctgctgggagctggccttgtcatctggcctgctcctgtccactagatacagaagggaagaaggactcgcccatgttcctcttctatctgcctgattagtaaggatttcaatagcagcaattcacaccttccttttacaggtgaggaaaatgaggctcagttaatgacaaaattctggcttggattcttggtttttttctaaattgaattgaacttttggtggcctggccctcaatatgtcaggttttggggcaggtgacatagctttttttctttttttaaaaaaagatttattttctatatgtctatgagtacactgttgctgtcttcaccagagagggcctcagatcccattaaagatggtcgtgaaccaacatgtggttgctgggatctgaactcaggacctctggaagagcagtcggggctctttactgctgagccatcatctctccagctgtagtgagatagcttcatggtaaaggactctctatttaaactcaaggtcctgaattcagtctctgctctggggtcgtgattgtagtctcagtgtctagaaggagaacccaaggggatcctgaagggctcactggtcaataagtctagcctgcctggctagactcaggcacatcaagtatgccagttttttttttaaagatttatttatttatttattatatgtaagtacactgtagctgtcttcagacactccagaagagggagtcagatctcgttatggatggttgtgagccaccatgtggttgctgggatttgaactccggaccttcggaagagcagtcgggtgctcttacccactgagccatctcaccagcccaagtatgccagtttaagtgtgacagtgaaagacagctttaagactctttggaagctcacaattaaggcatctccatgaaaatgtttttgtttgttttgtttttataaaatgagatgtctattctaattgtgggatatttgaaattttatgactgtttaagatctaagtaggaaattaagttatagtagattctgacactgtagtcattaatggatacatgtacacactttatttaatctgacactcaaaaaatgttcccgagggtggggctggaaagagggctcggtggataagaatatttgctgctcttgcagaggacctgggattggttccaagcaccaatatggtcactcataattctctgtaattgcagtccctgggaattagatgccctcttctggcctcttcaggcataaggcacttgtgcagtatatatccattcatgtgagacagtcatatatatgaaataaaaattaatcttcctcctatagggttgcagaccccttcatttccttgggtactttctctagctccttcattggggactctgtgttccatccaatggatgtctgtgagcatccacttctgtatttgtcaggcactggcagagcctctcaggatacagctatatcagggtcctgtcagcaaaatcctgttggcatctgcaatagtgtctgggtttggtggttgtttatgggatggatccccgggtggggcagtctctggatggtccttccttcagtctcagctccgaactttgtaactccttccatgggtaaccatatatataggtggaacaacaatatgaactaaccagtacccccagagctcatgtctctagttgcatatgtagcagaggatagcctagtcggccatcaatgggaagagaggccccttggtcttgcgaagattatatgcccagtacaggggaatgccagggcctggagtgggtgggttgaggagcagagggagtggggagggtataggggatttccggagaggaaactaggaaaggggatagcatttgaaatgtaaatgaagaaaatatctaataaaaatgtacttgctaaaaaaaattaatcgtattaaaaataagtaagttcttcggtctagaaagatggttcagcagttaagagcacttgcagttttctcagcagatctggttcaattcccagcaccgatgtcaggcagctggcttataaccacctctatttctcatttcctgggattcaaacccttcaaaaaatagatagtctgggatctgtgggcacctagaatcaaattcatatgtacatacaccaccccctactcgcagagacacattgagaggggaagaggagagacagagagagggagagagggacagagggagggagagaggaagagagggagggagggagggagggagggagagagagagagagagagagagagagagagagagagagagagagagaatgaatgttaaaaactagttctttagggttctttgcttttctcctggcggaagacatttttttcctgtagctattggggcctcttctgtatgccccactgcacatccttttaccctcagggtgacttgtcagcccatctcactgtgcccacttccctttcctcaggatcattcttgtggcacatttgccagccactacttccgcctttctcttatccatatttgccactgttgtacatatatactagatagactgggctgggtccatttctcctctttggatgattttttagggtagtggtaaggtgagaagatgtagtgtcaccagatatagacgtcctagtgacagagtaaaccaaaaaatgtgtgtgtgtgtgtgtgtgtgtgtgtgtgtgtatgtcaatgtggaaatgcaaagcaatttttctttatagctagggtaccagctataaagggtgtgtaatgatgcatgtgtgcatgtggatacactgctggggaatgaatggaacaaaggagaaaattgtccctttgactaggggtgtattttcaagtagcctttgctctggcttatcactgtgcctgcaagtgaatactgtatatcacaagccagtgatcagcaacttgtaggttttgaaagtgcagtgagtctgtcatctgagagtggattttccttccaatttaagctattgagatatactgtcttttgaactaggatatatatatataaaatatacagacgggggagtcatgagaactttttaaaaatgcagtggaacctaaataaaagggcagcaatcaaaataaatcatcatgttttcactgcttgtcaaagttatgttttatttgcccacttaatatatggcatatatattctaagatacacatgttcccaacatattctaataaaaggaatttgtaatatccatgaagttgttttttttttttttgacagcgtttcactgtgaagcacaggctggctttggcagtcgctacagtccttttgcctcagcttctctgttgtttttaagttgagcataagctacctggagccacatggttgtcagtgtagtttttcttcaaaagtggtagctgggaatacagaaggtttgttggaagaattaccttgctgaggaagtataaaactaactgtgcttatgggttgtccttccctcggcttttgagtgtgcttaaggctgttggctcctgttcagtgctcacacaatgtacaatgcacaatttgttaggaagactttaaggactgatcggcttatcgacgaactgagttcgctgcttctctgcagcgttcctgtttgtggagctggtagctggcatctgcctgcaagtgctggggagggggtgctagcgtgaattttgctccaggtttgccagaaacctggagagagggggagggaggaaaatagggagaggagcatgagttataaagttcatgattttgaatgaaaaaaatgtcaacaatatgtactatatattgtataatatatataatatacgtatatgtaattatatatgtgtgtgtgtgtgtgtgtgtgtgagagagagagagagagagagagagagagagagagagagagagagagaacaagaaccctgatgctagaccaagccccttctatgccacaagagattcagactctttgagaagaactgagaagttttccaatgtagcaaatacatcacactaaggaaagaaactataatgggtgtgttggtacacgcctgtagtcccagcacttgggaggtgggggcaggagggtcataggtttgaggccagattgggatacacaatctcaccaaaaccaaatgtagaaagggagacaagaaatcaagcccatacatgaaaaggaggcagtgcacaggtttctacttatatttgtacataaagcagccagactgcttaaatgtctgctttatgaagtatcatttctacatgacaaacggtagccatttaagaactctaatttgattagttgtgacaaacatatatacccacgaaactaccattatagttagggtatgtattccccccccacccccattttctcttatggcccttgcacctactgatgatatgcatttgtgcaagaacccctttccaaactagttttataaatttgtagatcctcctctataaaaccaaaccaaacctggatttgtagccaagatgcagtctttctgtatttaaagcaaagtagcattacagaggaaccctaggtgtggctattctgaaacattttcctggtcacctcagtaaatgacttagcatgttagtttcattacatatttggactgaaggcaaattatatccaagcgagaagcaattgtgttaactagagccatgtacattcttacattgaaaagtcaaatgctcaggaacaggaaaagtgggctggggctggagctcagtgggagagctagcactttatattaacaaggctcccagttcaacccccagcactgccaaacagaaacaaacgaaaaatgcaggaaatgaaactattgaaaatttgcctcaaatttaatggtgaaacaaaaaaagaaaaagaaaaaaatgtttgtttatatagttatgttactaaatgataggtatattttctgagaaacttgtcaggagatttttttttttttaacaaacatgagaatatacttgtgcaaacctaaatggtgtggcctactatccccctacagtgtatggtaccgcctattgttaataactaataactaataactttaatagctaatagccatggagcattttatactgaatattataggcaatggaaacaaaaaggtaggtacttgtttgtctaaacagagaaggtacagcaggggccagggaagtaggtagcttagttggtgacgtacttgctgtataacatgaagattggagcttgactaaccaacacacacacacacacacacacacacacacacacacacacacacattaaaagagtcgagtatatggagcacatacttgcaattccagcatgagggcctagggaagaggtaagacaggatagtgtttagggcttgcacacacactttagagtacagagaaattcagtcggaggattttttttcttttttagctcagtgataatcagggttggaatcatataatgtcattgatggagaagtgatgtggctcatggtagtaacatctgtatctccaggtacccacagagacacagtcggttaatatgaataacccatgaaccttccaacagatttgggactttctgtgcatagattatatacccctgtctacatatttatgtgtagaatgggcttttagtatatttagttgttgattctcatctgtactattgaattaagtgaaaaattctttggggaagttaggggctactgtagccagctgcaatccatccctttctcttttactgtcagaagaattcaaaagtcaggaagtgttttgctgtcattctattgatagttgtgaccctggtctgtgcccgctcccctgccactcctgttttgccctgtggctgccctctatgtcttccttcctggttttctctttatgtgtctttcctgtctcctcatgctccttcttctgcgctgcctctgctgtctcttaaaaaagccatttcgtaaatgtcttcagatagagtgctcagcaaacaggaattggagcgagcatctttgggacagtgtttccgacttttcatttcgtgatccaataaaaccttgacactcctttcaagtttggagccacactagaggttggggagtcgtgaaaggctggtatttagagaaccaaaacaatgtatttcctgggctactttatacaaaagtcttcgaacaatgaatcagtaaaactaaagaaagggtttatgatattcctgtgatggttcctttaacaatgcttaaatagttaacggtcaattagtgttcttcagagtgtactgaaaagatattatctacccccaacatctgtcaaagcctacaaaatgcatggcacaaagcaggaaccctacccctagaaagtgtgtacgtgcgtatgacctatgtgtgtccttctgtaaatgttaaaccatattccttacagtacctaaggtaatataaatgctcggtacccattgctaccatatttgggatagttacaagagaaaactgtatatacactacatgcatgcaatattctctcctgaactttccccatgcaaagttgattgaatctgtggatgtgcaacctgtggatgtggaaggttggttttacctggaacgattggggaagataacgacactggttaaaggtcaggcatgtgatggcatcttctagtccccttgatggttactctcttgcttcttgccatctctagtttctccttcccttctttatccttagtgtggttattttgagattatcttttaaagaagaaggagggctcctgcatgacacaaagattggccagcagatcacaaccatcagcacattgtacttttatataaatttcttacactcagaactttattgctgtcgtagtttcttcaggataaaatggtaggcaaggttttctgacagggaatttggaaacagacattgtgttaccttgtaaatttggttatcaaccctgccatgtttcagacccacattcattctctttatttgtttgtcattgttcctgtagcagatagtggacagcacaaaggctacaaaggctacgaaggagctgagtacctcagaaaggaaaaccagcaaacgcttagtcagtgcttcatctcaaacacaaacacatgggtggagaccagtaaaaatcaatctccaggcaaggaatgggcgctataattgaatatgctgttagcaacacagcaaggatgtggtagaaagagtattgaactgggtggggcagtatagggagtggggagagcgaggaatttagaacgctaacctgaggatcatttgatttttctgggaaggttattcctccactgaggcttcgctttataaaaagacaatctactggattgtctaagccaagtgtggatatttcagagaaagctacattctcttttgtctaaatgagatgcacaaggctaaaatatccttaaatgcttcagtactgggacatttcatatttcagattagggattcttatgtgatgaaatctacacaaatattacagaatctaggagaaagtaaccccaaatctgatataccagtagtttaatatttcagggaaggtgctgggtgtggcagtacatgcttttttttctttcagaactaaggaggtagaggttggttggcagatctacctctggtctacataatgaattccaggacagtcaaggctacatagacagaccctgtcaaaaaaaattttttttcagagaatctataggtatagaattactatttgtttcctaattactatttgttgtatagtatatctatttatatgatatcattgtactgattatagctacacaccagtgcttctctgtgtgggtccttggacccggagcaaagagcatcatcacctagattctaggtcctagaaccttgttagaaattcaagttcatgagctctacccaagctggctgaatcaggagtgctggggacggggctctgcctcctgtgtcagggaaagggtctacattaggtaatctgatatccactactatttgattactatgtgctatctgaagttgggacagtgattttcaacttggtctacatctaggattcaccacgagtaacttcgtcggatgcgctctatcgttctttattgctataagagactatccaagactgagtggcttaaaaagagcagaagtttaatttctcatcattctggaggctgagtagtccataatgaaggtggcagcagatttattgtctgctgaggactgctttgcacttacagcatggtgccttgatgcctctggaatgaagggatgatgttttcatcagatgaaggacagtggaaggcctagaggtgaactctgtcagcccttctgtaagggacccgaatctgactcaccaaggtttaatcctccataatcaagccacttccctgcgtcttaatgttgtcttgttgtttatgtttagaaatgaacctcagagaatatggaaatattcacattcttgcaccaaggaagaccaggagagccgatggaggaaagaggaaggggagttcctggcttagttaaagcactgggaaagtgggctacctggcacgggcaccacatgaggggaaaggcagaaaggctagcagcctcaacactgcagtggaaccttttttgtaccgtccttagttttatccaagagggaggaacattggcgctccaatcccttaaagggtctacctagtaataagtgtcacactcactggccattaagttccaccacctgaattttggagggggcacattcaaaccataacactacccatacatcactagtctctctggctcccagtgtagccagttttggtttagaggggagtaacacctgtggttccttatcagagtagaactctaaaggtgatgaggtagccagagctggggctgcgaagagcaggccagggtctcagtgaaaggaattgtgtttgatggtaaagaccttggctcttagatcatggcagaggaaggttattttagagaaagggtataaaacatgtgagatgataaatatatcatgattgttttgacagctacatgaagaagagattttgcccagcatttaaaagtctgatgaggagctagagagtggttaccagcactaggtgatcttgcagaacctgggtttaattcctagcacatacatgggggctcacaaccgcctgcaactgcagtccccagagttctgacatgctcttcccgtcagtatagctctaggttcacaggtggttcagaggcacgcctgcagacaaaatacagagaaacataacatttttaaaagtcggatgacaagggctggagaaatggctcaacagttaagagcactgagtactcttctggaggtggtggctcacaaccatctagatctgacgccctcttctggtgtgtctgaagacaactacagggtacttacatataataaatgaataaataaataaataaatcttttttaaaaagttggatgatgtaatcagtgtgcttaacagacagcttggattgtggagatggtaagaaagaaaaatgtgaacatttgtttgtgaagcatgggaagggtctagtggtagtcgtggttgagtatccaggaggaccagtgctctggtacagctgtcagaattgtcacatgggttctatacagtcctctgtccttcatggctttcatttagctctaagttggggagtggtctacagagagttatataaaaaaatagaaattatacatgcctaaaaagctacccatagtcatcatgacagagtgggaaaatgctgctttttttttttttaagtgaaagaatgcttggagttgtgggaaagttgtaaacttggcaatgactaattcaggcctctctcagtcaattaagcgaatttttattttatcatttgttttacttgggagccactgtaatggtcattgaaagaacatctatcgtcttattttgaaaacacaacaaacatatcgtcaaacattagggcagaggacaagaatgtcaaggtttcaccttttgactttagcaaatatctgtcactccatttttcttgctgcattcgacgacgtgtgcctttgtgcacattctttggccagtgcctaataggtctagtttcctatcttctattttaatggctcttggaatttgtaaatattattcatattttaacattgcaataaaagtggacaaatatattttcttattctgtcttttggccagaggtccctgaaacttgtgtgaagccatgggtgtggaaggagcttcctcatctttagtcttggaatccggaatggcaagagggttgttttcatccctccacagtttgctggtttagaggaaagacacatctctagactgcattgaaaacctattaacacaggttcccacttattccagtggaaagcttaaaaatactcattcctctaactttgggaaatctgtgcactttttagtttttgaatgaaatcaaatccgtagaaaaatctggactgattgcagccttaaatatgcagcatatagagcagatgcctttaaagaagagaactggttttcccaaagctgtatatggtgatagaattatctctaagttgtgaagagtacttaaataaatgtggaaggattaaggagatagttcagtggataaagttcttgccacactagcatcttgactggagttcggatccctagaccccatgtaaaaaacctaggcagggttacaagtgtgtaatcccagtgctagggagagtggagacaggagggtccctggacatgctgactagcctatgtagccaattagtgagctctgagttcagtgagagtcactgtctcaaagattagagagtgactttcatgtgtattctcacaagtgagcacacctcctcacaccccaaaactaaaacaaatactcagtgaaacggcatgcgttgtaaaattggaacaatacagaggagataaacatggccatacacaatgatgattagcaaatttatgaagtgttccaaattttggggcagggttgggtagtcagggtttctagacaggatctctttgtatagtcctggctgtcctgaaactagctctgcagatcgcatcagcctcaaactcatagagatctgcctgcctctgcctcccgagtgctgggattaaaggcatggataaatacataaatatagaaaattgtatgtaattattttttagagtataagagcatgttatcagatatactatatacctaatcttctttaaataacaaaacttgggctgtggtacatttatatgactgaaacatactttaaaagttgctttgcttattatattaatgcttactgaataactggttatgttgcaggtcttatgttgaaattattgaaataaggcatctcttaaatggatcatttattcttttgtttgtttgtttgtttattttatgtgagtacactgttgctctcttcagacacaccagaagagggcatcagatcccattacagatggtcatgagccaccatgtggttgctgggaattggactcaggaccttgggaagaacagtcagtgctcttaaccactgagccatctctctagcccgaatcatttattcttaataaattattttcagtttttctagagggagccagcagacatttcagctgtatttattattgcactttatggcatcattgaaagtatgttttgaatggcacatatgccactgtttcagactcccatattaacacaagtagggaaatagataacaggagggtgaacgagaagtttgagcctgctggttaccatcacaaatacttctaattaaggggatacttgggttcatgcctttttgatttcttaggtggaagagaatctcctgaagaacatgattaagggatggttgccatgacaatcatatccaaagcatctgagacagtgaatccatggagatcatccattttgattgattcaactggtcatttaagttcatttcaacagacatcatctctgcattttattttatttttttccacgtaattcacaaaattgattagcaacttgaggatccttgaagcttgactgaaagtaatgatagagtcatcagtgtctatgaccacaatacttttgttaaaccccattgtcttaaacatcattaaaatgatgtgtcaggctcattaatgacatttctaatttgagttactagtttatcagaataggataagattagcatgatttatttgaaagcatataccctaaaatattccagtctgctttagattactttggtattatcacatttacccagtgtttggctgtcctcctgggtttttaaaaaaatgtttttgcacaatattgttggcacgatattatacattatgtctgatcaaagccacagttatattctacatatgggaaatggcacacaggcaatacaacccaaaatgatgctaagtggaacacactagcacaggaaaaaaaagtgaaatgaagatgcagatgcagttcaagtcccactgtaaagtttctcctggtcactgatgaggaaactctgaattatggaagggaaaatagctccttcgggctcagttggaccccagtgtgtgagctttgagttctcagcttgaacctttctctcttctgccctctggagggtgtcagagaacattagatacgatgcaaggacttctgaaatgagtagccaggatcctggtctgctaatagaagtcttcagcatcttcgaactggtagcctcttcctacccagcaagaagggtataggtggtgagcaggcagagaaggcgtttgtaaagccaagatcttaggagggaagctacctgacttttcaagtagagaaccaaattccttctgagtagaacccagtataaattgcatctgtctccaggaataatcacttctagaaggggaagatgtactagtatttggaagctagagtgtgaggagatgaagtttgaaattaaaattggttgagtctgatgaatatatttggtatcaactatctgcgggagtgtttatagttatccacattgatagcattttaactgcttgtctgctgtaagaagtggttgtgtagctaatattctgcgagtaacagctatgtatgccctgtacatttgattctttgcctttgtgggttggttactattaggaagttcaggagggagaggttgggcagctaatgtaaggtggagccagtgtttcgccccaccctgtgtgagtctggcagcctgtgtgtaaaccagctgtaacacgctgtgttctttcacagctgcatgaaagggtgtggcaccttctgtgagcagcaagttccatatgagcagctgtgagtgggagagcgagacttttgtatctgtatgccatgcaacctacctagaaataggaaagaagggctttgtgttggccacgagccatttaaagtcctctagcacgaacaaaaatgtgacatgaaatcaataacaatgatgttgtagtattagataatatttcctcctgtgttggtgggaaggggagcaaaagatagttctttgaggatgcttctaaacaattcttttttccgctgacacagtttgatgtggccaaaaccaaaaaagtcctcttcaaaaagaagactcaaaagttatttattttttaatttctgaaatactttgatctcttacttttttatatttacatcttttctttatttttttttacatcccaacctcagctacccctctctcctctcctcccattccctctccccacctcccctctgccttccttatccattcttcctccatttctcttcagaaaatggcaggcctcccatggctatcaaccagacatggtatatttagttgcaataggactcggcactttctttcctattaatgctggacaaggcaaccgagtaggcagaacggatccctcaaggatgcagaagaggcagagccagcccctgctcccactgttgagagtcccacaagaacaccaagctacacaaccataacatcaatgcagaggacctaggtcagacccatgcaggctccctgattatttcagtctctgtgagccccatatgaacccaggttgaagaaccctgtcctttttagccaacagtttgcccatttggacttcagaatagttgtctttatctcagaaagtcattgttaaggtttcctaaacagatgaatctgttagtgtgtaaaatgaactacaccagctcccgtctagcacacacacacacttcaatctgtagtcagtgcctgtttgataaccagcctggaagcggttgtggaggtacaggagggattccaagcctcgttgtaagcttggtttatgtttgtcctattcccattgaaactccctgacagcctgttccgggtgtgggaacaaaacagttggcagccgattgtggtgacacatacctgtgatgccaacagtgggggaggtggaggcagggatcctcagtttgaagctggcatggatcacatggtgagatcctttctcaagtaaacgaaacccaaacagggacctctttggggagctgtcattttaccaggttccctttacaagtgataaaaggtagaaatggggatgtgtatgggctcatggggcagttgcctgtgtgttcggaggacactgttgtgcatttgtgtcatggatagcagcagccatgggacacctgtttcctagtaccacagctccatccatgcagggaagagcctgcaaactaacctgcatcctaatcctgttgtgggtgggagataacctcatttccatggcaacagctaactattactctggtgacttgtggtctacactctggatggatcagagcccccctgtggcagaatattctaaagatgctaaaagagaaagggagaaaggttcaactaataaatctattctaaatgactgaatcatttgttttgattaccagagtgattgccaaatgttaatttaaaactgaaataggccatgagctcacttccctaacaatgctgagagtttgagctaatacagcttgataatgagggagccagatccactgccagggctaatgttatatgataaacagacatttggagaagtatgcagaacatcttggctggtctccgttagctcttcgggttgtaaatacaaaggagaatgtgttgctatgagtcttttcaaaggaaaataatttttttaattgatgactttacttctaaaaggtaattttgctattttttttcttcaatttaggcaactggtagctgttcttagctgtgcccagtccttctggaacacatcctgtgtgaggtgagagttattcattgctatggattcttatgctgatctctgattttccaattttgagcattgtacaatgcgttttatttctttgagaagttgaagaagatttatcttaatgggcccgaccagtatcactgcttaccctgactgtcagctctctggggagtgccttttctagcaaaaagctcatttgctttgaacttggtagcataaaagtaaaaagtggcaggtgctgtcgtggggagcagagaagctgcgtgggatgaccactgctctgagtagaaggggactcctcatggtgactggacatcaagtccgaagacacttcctgtcctgggtgaaaggtgtcaggccactgtcaaacctggtggtaggaacaccagagtgtttcttctgggtcacaatagcctgagccaatgtgtttttgtttttttttaatttgccttcaagtttagaagaagccatgctataatggtgcatgtaaccacactgcctggacattcatctgctgtactcattggctagacatcctctgcttccttcaactggggggctgctttatgccctgtgataatccaggcttccttatttcccctcgagagacaggacatccatctgtaaaaataactagagacatgtaagagaggtctactttaggtacaatgtagaaatgactgcttccttttgtcccccggtttctgtatttattcaagggacatgatacttgggagcactgtacttgtcaaggttgccagtttcatacacaaggaggtgccattgctgtgggcaccttctctacttaggtaaacctgctcaattcttttgaatcaatcattacagaaacacacagggctacactgctgagtcttatgtttttcctttaatccactgagccccattgtgtaccaaggcaggagtgttatgacaaaagtcaggtactttggatctgatgtagggaagccctagataattttctcttcatcaggtaaggagactgaacattgctctgtaaaatgttacccacttacgctctgattcttgagcctacaacttttgcttcctctgtaataagcgggtatgaacaagtaggtgatactgttggagcaacagctgtgcctaggaccaaaagcccccaaaagagaaaaaaatggaagttctgtatttcacaccctatttttaaagttatttagggtcaaattaaaccattcaggaaaatggagtttgcaatttcctcaggaggatggtagaaattttaaaacgatgtgatacagcattcatcttccacaaagtttataattgtaggaattgatattattctatttggcttgcctccagtttataaaattatttggaacacagttgagcacaaaataaaaaacaaaagacttattttatgtgtcttattttgtctgcatatgtgtctgtacagtccctgaggaaaccagaagggggcactagattccctgtaactggacttacaatctcttgtgagctgccgcgtgggtgctgatcaaacctggctcctttagaaaagcagctagcacccttaaccactaagccatctttccagccctcacaacataattgttagcagacacatgagctgggtaaaataggactactctgatttgtactgtagaaatgataatattgttaatggattgaatacattttcatatttaggaaatatttgtgtaactgccatatggttattttcattattgatttggcaggttgtttttttaaatattcaccaaataaagttctgaaagatagtagtcataatgatttgatgtgtgccatggatattgatgtgatctctctctcttggaatccaagtagtcagcatacgagtccgcacagatggattacgcagacttaaaagagtttagaactcttgaatctagagccatgggctcaaactggtaagctggatctggcacacagaggtgttcttttaaaatgctagtgagttgccagccttgaaaaatcgagagatttcacactcttaaacatccacatttcccatgtcttgaaatacagaagatttggcaccacaaaccctgtgttcccattcggctataataggctgcagccaacttgctgctgttcttttgcagagagcacaggctgcgagagccttgccacagcctccaaccttccctgcggtcttcttgacacaaagggtgggggcctgttgccattactagaacactgtgctcacgtaggcacttggcttttcagtgtcaattgaagataagattgggtgtgaagttcagattaccctgtctggcggatcacttggtttatttttctgggctgagccatgttcattttaagggcgtgcttaagattcatcttaagttggcaggtgaaccctaataggggagggatacttactgatgctacctgagtaagaagaggaatatctgagcagtatcttcttacaaaggcttgcttggggtcagtctttctcagatatacctcacttcctttcactaccctgtaacagggtagcttaaaaatgcaactagttttaatacagcataccacatgtggaggataaagaaaagttgttgagataaagaaagcttgcttgagattttattctgatatattttctagtaaaatattattcatgttaagcccaagaattatgaattatggacaagaactttatatttaattatcagagtacacatttatgctgctcttaggatccattgaacataagactgcagaaaatcggctaattatcaaatccctaagtgagcaataatcatgtaagttgtaataagctgaaagagtcagaaaagaagaagatggtcttcttttctctaactctaccgtgaaaaaggtaattataaccaaaaggaaactgtgcccagaaaatttgccacatggataaaaggtaattttggcattgtatactgaaattattcaagttgttgagtttcgatggttgcttagtaatgcaaaagaatatagctagcaaaaacgtatcatagtgtaggctgcaaaattttatgtatatgtgtatgtgtatgtgtatgtgtatgtgtatatgtatatgtatatgtatagtggttataaccatgcaaggtgatatggatgtatgtacaagaaccagagggcacatggatgagtaagtactactttatttgagatttcatgatgcttattcattttaacataagctcgtactctaaggctgagaatctgttgcttttaactactttacacatcacgaaatattcctgtttatcacaaggtaagtaaataaccatgaactataataccatttggtcttggcctatacttaaatgtggcattccaacggtataggtctttcttgtgtattttgtacccactcagattcctgtttgtcattcttctcctgtgttcttggtgacccccatgacaaaggacatgtattttgttttggggcttcttgtagatgtgggctgatgcttcatgtgtaaaggtccagtgtaccctggggaagggtcttaattatgttctcacaggagggcagtatcagcccatcatctctaggcctttgcagaagcctacaaaaattactttcagagtaatggtcttttctcagtgccccttcccttcatctctctttcagatgtacttgtgtctcttctaattaggtcaggtacttcatgtctgtttttctttcttgacatggttttcctctggctttggcagcacatattttccccatatgtcattgcctctagagcttcatgctgcagtcatttttcaaggggaatggagagcacattgctggagggggggtaagtcttgcctcccttgcttgccctttacttgaatgagcaactcatatttcttttgggtctagttctgtttggttttggagtcttcacagtccgttatgtttggactaaaagatacttaagtaaaaataatggtaagtcacagatatgtctggcagaggtgcagcacatttgttaaggttactggtttatttatctcccctatctctatggcaactcaatctgagtctgggatttaatggacttaactttgaccttctgtaacatctcttaacttttcccagccctctactgaaaaggaattcattttcacttgaggaaagaaatacacgtcacttacagaaagagtcctatttgggctctcaaaggtggtctctgtaaaggctttgggttttttcagcttaaaattgtattgaaaaaaaagagtttcatgtgaataagtatccacagtgtgtgtgtgtgtgtgtgtgtgtgtgtgtgtgtgtgtgtgtgtgccatgagtttttttggtgccctcaaaaaccaatcagatctgccccaagaactagagttacagacttcaggttgctatgtggatgctgggaactgaactcaggtcctcaagatcagccagtgctttgaacagcggagtcatctcttacgcttcccagaacctttaagtttttatagtcttcagtcttcagagtatacatcacacttaacaacacacatatgtataacaacacacatacgtatgtggcattactggtgtacaaagaacagtgttccttttggtgagctaaagtactgttttgtcattgtgagtctttgtgaacatataagagagtttattgtaaggatattaaatcaaagagaacattaattacactttttttttttttggtttttcgagacagggtttctctgtatagccctggctgtcctggaactcactttgtagaccaggctggcctcgaactcagagatccacctgcctctgcctcccgagtgctgggattaaaggcgtgcaccaccacgcccggctttaattacacatttttaatatttattttaaaaatgatctcttatccatcatagaattagaaatttacatgcccacaaatgatcagactatgtctcagagtttaaattgttaaacagcaccatagtagtgcataagaaagatttagtttgaccagtatttccgtagaagtcagctttggatcccgacattcaaatccagcatttcatcagtacctgactcatgtgcataaagacagagtatctgtctgaggaagttagagccaagccatgttggacctaagttggtttaaatgttcacataacactttttcagtctcttctgtatggttgcaagacatttacagagacattccagtttcaggaaatgcaataattttttccaaatcctctttacattattattacgtcagttcagtataggacattcaagattttttttctcatgacactgttttaacctgcttcctaccaacgtagaccataaccttgtcagtacatctcaatagctgtaagcaaagtttctgtcttattgattacctatgttggcagactatctctgatgtaggttagatgtttcaaggcatgcatcatggaaatgcaataatttatccatgaagtcatagtgtattactgtaaatctagtgtatagtgtattagtctacttatgaaaagtgtatttgtaagtcgtgtcgccttctctaagaacaaactcatggttgaatttcccttaatattaataagacttgtaacaaaggatgtggcaagggaggtcacctgtgtccttttgaccttactctgcaagcatccagtacaactgaagtccaatacgaattggtaaaataagaaaccttttgtgagatatcatcaagtctccatagacatggaggttgttttatgatcttgtctctcatcaccttttctattaataggtccaagacttgagaagcagtaacagatgctcacttgtgagtgatccacacttgtgcggcgaatgctgcgtacactttagtttctagaatggaaaccttgactcacatatctaagaaaatgtattaggtcaagttcataagtacatcatataaattttgttctgaccaccatgagaagaatgactgaggtcacagcttttaggcagatcacagattaaggctggaagcccccagcaacactaagaatgaacagtatagctgccgtcatcattatcattattagcctatctacttttgtcacatgttgaaagcccaatgtggtgcactgataattgttccaagtgctctgcttaagacagaactaagaatgaagccaatttacagagaaatggatgaattctatagaatggctttggaagagtggccccatcctcttgtcctgtcagccagataatcttcacaccccatagaccatctctcactgctgatggcaaattattggattagtggtttcttactagactgttcttaacctgaaatgaaaagctaaggtacatacgagtttggtgttaatttgtgtacttcgttgaatttgtgagcatcttttaaaccatgagagttgtatgtgtgatataatgatttctatacattaagattctgaaaaaataattcactgaatttcctagaaccagtagcaatttgacattgacatttacatagacaattgttaggagattcataactaattttggctttacaatttttgtgtgtgtgtgtgtaagtgtgatggctattcttagttgtggtattttgcccgtgtgtatgtctttgtacctgtgtctacagaggccagaagagggcattagattccctgagactggagttacagtcaggtgtgaggagccatgtagatgctgggacttgaactcaggtcttgtgcaagaacagtcagtgctcttaactgctgagccatctctccatcttccccaacaatagcgtcctttgcttcttttaatgagtcaactacagactaaatggagatgacatttattttggtggtggctaagaagagatggtaacttgaatgtgaattacgctcaattttcagagactggggattttatttctaccaataagtatacagacacatataccattctctttgcccaccacatttcatgatcacattatttgtactagtaagtcttggaagactggcctaaggaaatgcagctaggggttcttttcatatgaataataccagacaattgggatggaggagagtaacacaaaatgttagtcttaggtcctaccataccattagatagcaaggcaagaagtcacaagtaggtagttgtttagttagtggcttcactttttactatgaagtctaagctccatgtatttaataagtactaagagtacaaaaaaaagtaatttcagcctgatggcttttgcattatagtccatagaactctggaattttccgaagtgtttcagaagttgtaccaatattttacttacatttaaatttttcattatactatttttaaaatcttaagccagcaaacacttgtaactgttttgtagtacattttagcattctgcaggaactcttactgattgactttaaagtaagtaaaggttattaatgtcaacttaaaataaaatttgactagaacttatcagtcatccatcaatgtcagtgtagcatttctgttgggagactaaagacaaaaggtcttcactaaggccattacactaaagccattggtgttaaggtattggcctgtgagagctgatgttacatttgggtttccagttacagtgagcacttacccatctgttatatttaggtgtttctagtgcctccaggcatctgggaatggatgagtatacactttaaattggaaacagccataaagggggatatacagttaagaagttggaggctgatgggtcatccttcagaagggactatgaagggattaggaaactttattaaacgtctgaaaatgcatgtttgtaacatcgatgttcagtaggagagttttaaggattctcttctgagtgtagcagtaaaaccttcaaatgagtttggcagagtcctttcctttggaggtagtggcacttgctctgcctctttccattccagatggtattgctctctctgcccatagtcttaaataccttttggaggctactgtctgcttgtgtagacttgtgatcaagttttcacatttttccataaccatattttccttccccattcttttttttttttaagacaaatttcatagcccagtcttgctttcatcttactattcagttaagggttaaagatgaccttgaacttctggttttacctgcctagtgctgggttcacagatgtgtgccaatactcaagttttatgccctgctagggttttaatccaggatcatttacatgggaggcaagtactctaccaactgcatccagagagaaatatacccctaaacctccaccgacgtttgattatgaacattttcaaaactgaatttttccagtgacctgtatgcttctcctctgtagtctacctgtaacaacatgttgttctactggtttatatcctatatctatgcaggccagtgtatttttttaacctggaaatgtatttcagtgaaaagctagcagatttcttcagcagttaacttcatgtattttatatgctcaaagtctagctttttgaacactgcacaattgtggctaacttggcatagcatgtcacgaaggatgtaaaataaatttttcaactgcactttcaaaagtaatagtatttctgtaattctggcatagagttgggggaaaaaacccactggctcattttaaaacttataccctttctatgaccaaggctctgctgacttctcatcaaatcaggatatacttacaaattttattttcaccagttagaagccaaataagttcttacagagttgggatcgcccttaaaagagttgatgttatctaacgttggtcttttccatcttctctgttacatttggaaggcaggagaacagctagctgaagtctaaattggtctgtgttggattcaatcccaagccctgatcttaaagtcaaagtgttaagtgcaaattattaaaacaacactcgatccaccaagtagagcatgtggggctgggcacgaaaggttgcagggtgtgactttttgtcccagcttatgcagaaaactctccctctggtcttctaaagctgcttcagtcctttcattctgtcccccagattgggtcccaacacacccttggccatggggctgtgagtggacatgtttccttttggaagcactcaccagcactcttgaggtagccaccaggaaggcccttaaaagcagttttgctcactcctgcagggactaatcctctgcagtccactttggttttcagctgctgttgcttggcttgggaaatggacttctgttgtgtcaggagagaatgactctgaaagacttatatataaagacctatataataaacttgaccaactgcttcgtacagacacttgaccctttagctgcctataaaatctcattggcatggtgggataatgtgcactttggtcttgagagagcctattaggttgcaaagtttttgattcatctaccactgacttaccctttgatctcaacatgtgattgacttgtccgatgatggcttcataaccacccataataaaactgatttattatatatactataagagttgagttttaagctatatctcgtttctgttataggtcagatgtatgaaagatttcattagaatttaggtatgctcattaagctttcagatcagatttattttaccaataaaagtcaggaatatttcatattctgtagttcatatatacagtaccaccaattcagtgatatttccataaatgaggtgagattaatgatattaactatgatattaactataaggcatatgtttaaaatattgaaaactcaattattctgcaagaatttggctagtagggaggtggaacggtctctggatttatgcatggaacaggtgacagtacttgagcttctattcttagtttgccctcatccccttcacttaaggcaaggtacttagtctaaggttttggtttgtccatgtgtagcatctgtaatgctggtccactaaaaggggacctggtttacatttactagcgtttgaggatagaaggtggcacagaagttcagattgcggcgtagtgagtatctgtttgtgtgcctaatggcaatcttgacaaattactaatgactacatttagaaagttacagctctggagggaattgatatttgatattgttgttctgtgtgttctaagttaccatcataacagtaggaaaataaaccccatcctggctgtgttacagagggattaatcacttcttcaagtcgttgctaaagctctagccctttaaacaagagaacagaagtgttccttcttttattgactcttccaccaaataaaagccttacaactaagtttagttatacttcttcatgtgttgaagtctgttcaagttattttcattgtaaagaatgaaggatgaaccatgtcaattaaagtggctaaaaataccctatgcaagtatgtagagagagtgagtgcttttgatttgtacatcaaagcaaagaaccaaattatgtgagcttgccttttatacatttgttccaactactagtgtctttacaaagactcagatgttatctcagcacaagaggattgaaatagttcaactccgtgtgaaattgaaaaacctatattactattttctaaatccaatgtatttaaaattttgtgctaaggtgagacaggggcttctagtcacagagattcttggtcttttcatagtggtctgcctcaaagctttatgagctatgacatgagagtcacgtgaaaaatggggatatctacatagaacaaagcctgatttatttatgtatcagtattagatatatgctattttgaccgcataacattcactaaaattctttaggaaaggcaggacagctattgatatctccatttcattgatgaagaacacattaattttctggtaaacagctcagtagtccaaccatcatatttgtcgagaaatggatcccaagtgtggtgtcccttctctaggtacaacacactaaagccagaaaatagatacccattgcttttaattttgttatattaaaaacttaaaatgaatttaagttcaatattgttatctcagtgattggactaacattttaactgaggtttttgtttgttttttgagacagagtctaggagattgtctaagcttgcctgttacttgctgtatagattaggctatcctggaaattgtggttgtaatactccctcctctggcttgcaagcattagaattataggtgtgtaccatcaatactaggagtcaccgatcacctctggctcttacagtctttccatctcttcttcctcatagatccctgaaccttaaggctaaggtgtttggttttaaaaaaattccatttggttacactgatttatcaacatcaatccttctcacagcttttttaaaaaaatgctcaatgtgaaattgggagttatggggctggtaatatttaatttgtgtagctgcagaagtggcttaatcagtgacaaataatcaaggacctttcattacctcttttggttacttctatgacctttaaaaagcaagtacctgtttcagaaacgattgacctgtgaggctttgggcagcaaggaaggtcctcttggctttgaagtagtaacaactacagactgaactgaaaaaatttctgatgtagatataattgaaaattctatgacaggcttacataattaatagggctgtggttctgttttcccagcatgcagttttaaggtcagacctgtgactcagagctgtgcactttcttggtggtatgcatcagtggtacatctccagtctcatcatccagaagggctttgcccagctcaagttgctcccctcataatccctagttgggtggctacctttccttttttaaatagataaagaagacaacattaacacttgatcatcaagtactttaatgtttttcagcataaagacttagtgaacatagtgaactcccttgaaggagaagtaggtcctatattgccactaatacctcttggtgtggttctgtacgagagcgtgtgatatgctcatggtaagtataagctttttgctaacttggatgttttaaagttatttaaaataaaaggcaaggtcctttgacttgctgtaaaaaaaaatgcacacttggaatcaaaatctacttcctctctggacagcttattagctaaaggttatctagcacggttggcatgagatttctagatggcatcttctctttgtgcacagaaataacctgccatctcatgaggctttgggtgctacccgatccttttgagagcttacatccatttgcttttctctcttcctttctctgtaatcaaaattcccatctctttagtgcgactgagtcttcttgacttgctacctttttcttcttttaagaacatgtttttataccattgtttatcatgagaaaacactagaaatgaatatctggaaacagtggagttgcctactcagttgtgctatatccatgtggttgcatactatatacgtgttagaagatggaagctcattttgtattggcatggacacttacctaaatataaatagaaatcgcaacaaaataaacagagaaagcaaggtaaagaactgaatatataataaaatatccttagacttaaaaacattaattaagatatataatttctctctcttgccttcactcctccccatgttgacaccccaaactccctctcaaattcatggtctctttctgattaatttgtgttgttatgaaggagtgaaaaggataaagaatacttagctacctgcttcctagatctccattatctattgaaacttcagaagacagtggaggctgaggtaggaggagctcaaagttaaggccagcctgggatacatgatgtgaactacgtctcaaacataccagtgggcatggattcacaggggaagtggatcgatggtgacaggcaatgggaggatagcttttcactatatattcttgtattttttgttatttttgagataggctcttactatgtatggctgtcctggaactcactctgtagaccaggctgacctcaaacagagatctatctgtctctgcctcctaagtgctaggattaaaggtctataccaccatgcctttttctccttttaacaaataatatgtttaaggactagtgaaatggcttaacaggtaaaggggcttgcttccaagcctggccacctgagttcaattcctagaactgctgtagagagaagcaactccctcaagttgtcttttgagctctgaatatgtacacacagcccactaaataaataaatgtaagaaaatgtaaaagcacatatttaaaaatccttacacaaaaacatgctcatagtagcattacttactgtattcaaaaagtagagatgttcccagtgtgtcagctaacccacggatgaccaatatattgtacatctatacactggaatatcattttgctatggtataaagtattaactgatgttataacatcatccttaaaatattatgctaatgaaataaaagtagtgaaagagatcagccatggaataccagttgtcttagttgctgtgatgaaacaccatgaacaaaaacaacttggggaggaaatggtctatttggcttatacttctataggcaatgctcattatagaaggaagtcaggacaggaactcaaacagggcaggaacctagatgcaggagatgatgcagaagccatggagaagtgctgcttactgacttactcatcatggcttaattagtctgctttcttatagaacccaggataaccaggttggggtgacccacaatgggctgggccctgccttatcaatcactaattaagaaaataccctagagtcagatcttgtggatgcattttcttaatttgagttccctcccctcagatgactctagcttgtgtcatgttaatataaatttctagttagccaggacactacacattgtatgatcccatttctataacatgccctgaaggggcaactctatatggagacagaaagtacattgtgaggagttggtagggagaaagaagagtgattgctaagaccaggcttctttgggagtggcaaccatgttctggagttagatagtatggatggttatataactatacgcatatgttagacacattgaagtatgtgtattaaacatgtgggctattcctgtcgtgtattttgtttcagtagataaagaccaacttggtgaagtctggaacttggaagcttttgggtttttttctttttttgtttctctctctctctctctctctctctctctctctctctctctctctctcttctgtcctggaactcactttgtagaccagactggcctggaactcagaaatccgcctgcctctgcctcctaagtgctgagattaaagacgtgtgcgggaacttggaagctttaacaatgattgtgaacatgtaaaaccatgaacagctttcttgagttctctacgtaagaaatcttgtcattctgaaatattttttctggtaacaccagaagacttggtgccttttggctacgtttaccaccattttaccaacgatcttttcatttggtagaggaatactgttaagccaaatgaattcctgattgctagaagtattggtaaccccaggctctgccactagagaggtgacaggagtttgcagaggagtctgggaagacatgagagcactatctcctccaagctgaccccacagccatctgctcctcctgtcttattacttcccaggagctgtacattgctcctgtctcttttcatgtgttctcttggggtgagttgagtcacggggtttaaggaaaggaggaaaatggctttaggagtcttggttgatctctgtatgcctgacaatatagcttttcttcccatagtcaccttctttcctaggtactggctcattgtggatttctgtctctagagagccagttgctaccattccatctgtcttggccagaggttggttagaaaattcttcttcttgccttttagcttagagttcctctcagtttaggcatgtcaggatgactttggtgtgtgtttgatcatgtgtagggcaaccactgcctatttctaacaagtgagactttacatgtttgccatactttcccaagctgtgatccaacactggcaactttatttcacttgaatttctgagtctgtcctatacatggcataattaaacagctctttgctatacattctcctgacattcattgaaaaaatggcttatagaatgcagttgtagtctgcattccggatctggatattagatatgagtagcctctttttgttggtgatgctgagagatcaatttaagtgctgagatgcatgtgaagcaaagtgaatccgccttacttattcatactcagaagtcgtgttgaaaagtctgtaaactctggtcaagaaaggccttctcatccactttctttgtaggaaggacataagaaagacccatagtcacaagacaaggcaagtaccctccatctaccttgagaattcagagagctttgttgtcacttggtctctcttgtttgttcagaaactattcttactcatgtttggctattcagtccttgcctttggattttctggtgccagcctacattcctctgagtcctgaggactttgaactttgctccaaactctccagttattctcaggcccatggtctttaaaaccaggctcttggccaagatcccaagctcttatctcctttccacatacctcctgtgaactggtgaacttaataaattctacttgcaggaagctggggtttgggacaactacattttttgcagtgttgttatataaacagtatatagtgattgctgtgtgtcagtcattgtcctgagttacaaatatgctttattattcataagaatagtatcacaaggtcccattattatttccattttatagatgagcaagttaaatcacagagaagttaaatgaaattttcttatgtcatacaatcagaaagtgttaaatgtagactttccatctagacattatgactccagagtccattcctccagccaatacattatttttacctgaactttataaaatagatatacccatattaaatttggagaaaaatcacgattacttttctttaagatgatgatgttaattgttgaaccaatctcatgtaaaagtaagccttaaatttcttttatgggaaggctttgaaaagttctgttcgattcaaaacactacttgaaagtccttgaatgcagtagaataatgagctgctactctgtctcatttttcatacctcaagtaatctggctttatgtacaagaggtgcttacttccactatttgttcttttttatttttccactgcttgaaaataaataggaatggagctggtgaggtgatttctgagttctgagcacttgatattcttgcagaagacttgcttttcattcctagcaccctcttatggttctcaactgcctgtaacgctagttctagggctttggagagatgttctgacctccacaagtgccagccatgcaatggtagacacacatacatgcaagaaaaacatgtacatacatacgtacgtacatacatacatacatacatacacacacacactaaagctttagagaacaagatgggctgaagttaaggttaatatgacagtctttccaagaatatgtcttttactagcttctgacacactagacctagttaagatcctttttgagttatgctaacagactgttcccagggccttgcccgtgtgtaagcctgtgctctcctactgtgtgctatctgcagccctactacactcctttctgggaggcccgtttgctcatccttgtgttctcatcattgtgttcagtgtgcttgctgactgccatagagaacatattgctcaaccctaggagatcagcaactattcactctctttctgaagtgtcagctgtcctggtggatcccctgttcctgttctacccttcaacctagtcttccttacagcttggtgtcaactgccactttgaagttagccagagtttatagtcttgttgactagactcttagtgtcacatgagagcatcccctatgttttatttccagctcacataattgtccccaatctcagggttagtgaaccaagttagtctctgttgataattatcaaagacgaggaaccacaatcatcattcatcctaaacctcattcccaggctttgtgctataatgaataaaggccccttgttggaatcagttccactgtatatgaggaacagtgtctcgagctggaaataattttcagcttgactataaaatactctatgcaaatgaaatgccacagactaggcccatgatgtattctggtccttccagaatctctgttctcaacatatatagattggttgtcaggaaagacaggttacccattggggccctattctgttggtagaccacacactaagatcaccaggtcagttttcacaaaatagtgcctggcctggcacagcagaatagctatttccacagaaagttgttcttgtttgccctcaacatgagtcactgtgggctgccactctcttggatgtgcctgtaagtactcttgggtggagtctagattgagacatttgtggggcaaacagagacagatagaagccaagtgagctttagccctctgatttttttttcagtttgccacgaatccagattgactccactaccaagatagttccctccagcatctaacacagtagagacttcctgagtagcatccaggcacttcttgggctttttctttctgtcgttccatcacattttacactccatcacattttccgattctcttttgagcaaaccccacttaaccactcatgagtttattcaaccaccaaacttcagttcaagagctatgctctggttacagtttgagaagaggaatgtaaaatagtgtaaaacagtcaccatagtcctttggtaaaaaaagaagacagcttataagtctctagtctgaatatacacacaaggaaggagggcttgtgaagaactatggactctttctaatcaaggcagtcaatcaaagttgtcagcactaaggataaagatataaggggaaggattgtagctcaataatagagtgcttgcccagcatgttcaaggccctggattccagctccactaccaaagaaagactaaaggcatgggtactttatttggcttcttcttcttcccttttaggatagctgggtaaatgatagaataggaccatggaatgcttagccctctaacatctctccggggcttgaaaggcctgtaacaggtggacttggtgagtgccaggactggggatgattgaaagggtgttttgaatcatggcacatggcaacagagaaataaaacagatcacaagtggctggtcgaaatagactaggagagaattttaacacctaaaatatgacaaagatttatcgctaccagtagcatctccaattcataagacatttattttcccttgatctgagagtctatatttacattatattttttcttctaaaagttttcttatttcctcgttccagttttctctttctcagtgttacattaatggtgacttctggtcagagtctagtctcatggaaaagatctattggatatggttgttatagtatctgtatcttggtgtgggtctttaaaaacgtgggacagaatagactttagggacgagagactttaaaattgttattaatcatggaatgacatttttaaaaatcaaaggagagagaccatggcatatgctttcttcataatccctgtgtgagtattataaaagaaaccctgggccatggtaaattaccttcaatacacttatgtggcattttcagtttgccttgctattatagtcttctctttgtgtatgttatgccatttgtagggagtcttcccctttccatagccatcgtgtcttttctctgagattcagagaccttgtgggcaagcagaactctgtgctttcatttgactcttgtgttataaaatggcacttgtgtgatcccagagtgttccttcattttgctctttcatgggtatgctgggaattgtgacatttaagaagtgacattgcaaaattgaacatgtcagttggcaatagggctcttccagccttaaagattgccaagaactcgagatggctgaagttgctctggacttatttctggcaagagtacacagggcaaaaaatactctggacaggtcaacattgaatcacatcgtatcatagaacatgacgagatgctttaatcttgtggttagactcactcaggagaagtgctggtgcaggaacgtatcctgaccaaattatgctgagagaaactcacaggctattaatttattagtagtagtcaagaataaaataacgcataaatgttcaagatgaaaccaccaagactccaatcttggtttgaaataaggctctcgagtttggccatgactagtggcatttaattgtttgagtaagttttcagtaacttggaaaatgtcttgagtcaaaagaaaatggagtaagatggaaggctgaccgcaagtcacaccttgaaggaggaggagctcctgagatatacatgggccaaatggctcactgaatttgctctttgactcagaagtgtgatcctcccagtggcggtggagagataagagtctaggattagattgcagcaggataattctcacaagtgggattccagtgtgatcttacactcagtctttcttgacttgaaaagctagatgcccttaaagtgtgtttgttgttgcggtcttcgagaagtgttactgtggaggactggatgaagtgctcctcttccatattttcctgctcacccagaatctcaactgcagggaccttgttgaccgtaccccctcctctgcaaccagtaagccccatctttcctattctataatatcccttctacctagtctttcctttctgtccccattgtcagtacctcatggtcatttagtcctgtaatgtctgctcaaacgcagtactcttcacggcctttaggctcttctctgatagctccccttttctctgcctatatcatacactcagatcactctcttcctgtgggtcatttgaaaagtaagcctatgtgctctggctttcctgcctgtagtcttggctgcattaccgccttaccactctacttaacagccttctcctaaccagacttgctcctgcttctttcgtggacctcgtattcctctcagaacatgacccacatgctaccttttttcttttcttttttttaattaggtattttcctcatttacatttccaatgctatcccaaaagccccccccccataccctcccccccactcccctacccacccactccccctttttggccctggcgttcccctgtactggggcatataaagtttgcaagtccaatgggcctctctttgcagtgatggccgactaggccatttttttgatacatatgcagctagagtcaagagctccgggatactggttagttcataatgttattccacctatagggttgcagatccctttagctccttgggtactttctctagctcctccattgggggccctgtgatccacccaatagctgactgtgagcatccacttctgtgtttgctaggccccggcctagtctcacaagagacagctatatctgagtcctttcaataaaatcttgctagtgtgtgcaatggtgtcagtgttttaccttttttcttgattggcctcttccccttctttgtccagtacattcttcactattcaggacgaagtcatggcctagattctgtgatctctatcaagtgttttctggtcctatcttgacacagtttctgccagtgataaatattgctaacattatctatctttcctgtaatatcatgctctgtcttccatggaaattatttgtatatttatccaggtaacacttcacagtaaggattatactttatttttcctgtctagaaaatcagtttggagcaggtagtagtagggtatttgtttaacaagtggttttcatataagagaggtgaatggatagggtcatgtaatcatggctagatctcaatgagaagctagaatctctccatgaattgttagaagacacagatgagtagataaactgatgtaaatggcctcacaaggatcacatgctagaggagactgaagagatttgatgcctagcactcaataaaaagtcatcctgatatggctagcacaggataggtgccaaagagaattgttcactgactgctagccaacctccccaacagtgtaaatagtagaacttggtaaacagtacagtggttatcgaagagattgttatatatcgtactgttgatgtataacaacattaatgcaaatgccagtgaagttaatgactgcttgggtgtctgctaagtagccattaagctgtctaaaccattaacccttgttactgagaaatcactttttcctcatggaaagggggattttttaaagtttaaattttatttctcttttatccacaatttaaattagttctttgagaatttcatagaatatatcttgatcatattcacctttatctctaaaatcttccgagatacaactcctttgaccctgtgttgtctgttttttttttaacccatcaagtagagtttgtgtggcccatctactcttagttgtatccactgaagcatggccaaccttccaggggtcacatcctctcccagcagttatcagttgtcaatagctactcagctagtgcttggatttggtacccacccttccctctctatcctgggattttgtctggctagaacctgtgaagattttgtacatggtatcttgatttctgtgaattcctatgagcaaatgccctgatgtagctggaaaacactatttccttgtcacccatggttcttacaatctttctttttcctcttccacaaagaactataaaccttgggaaagggaatgtggtgtagatgtctcatttaggactgaacgttcttcagtattagcctctatactttgaccggttatgggatttcactgttaatcatcatctactacaaaaagaagattctctgatgagggttgagagatggactaattcctggctataatgataattcattagaagtcagtttaatactatgcccatattgcagagtaatagtagtatgttgtctcctatggtctatgacctgtctagccataggttcttagtcccaatagtggtcccagatgtgggcttcatcttgtgggttgagacttaaatataatcataaagtagttggttactcccataacaatcatgcccctcttgccccactaggccgatcttagcagtccagttgttattgtagcttgcatggttcatagctgggtaagacaacgattgctcttctcttctgatagtgtgcactgtgaaagctacccagtagggatgaagcttccaggtgagtaccagcttgatttctcaaggttctaagactccagtatgtagtatcttctgcaagagggcgttgacatcaagttctgtaaggtaaccaaacacatcatcaaaaaataccctgtatttggtgaaaggtcaaattttgtgagagttgatattaacatttggagccccagtgtccaagcgggtggtagtcttgcctcctaaaagtctcttaggaaagccgaggtacatggttgggctttgttgcaagtgggataagcgcaccattaggctgagcactcacaccacactggcttgtcctcattgactagtgatcatgaagtagctcttatctttatatattctcttctatttgaggcaaaatagacccaagtgtatttgccagcttcatgaagccagatgtccataatctgtatttgctttacaaaatgagccaacacctaaatgaactgccatagtggctataaaacctacatcccagtgtcaaacttaaaactagaactgatgtcctatgagacagcgttagctacacaaagcttatcattcacagccctgtaaagaggaggcgtttaaaaatacacagaccctaagaatgtctcactaaaatctaaagcaagatttgtaaaggttaaacatctaataaagtaagaacagttcccttaggtgaagagtgtacattgattttaagggtgtggtatcgtaactagtcagttacaattttatcatcctgaacaaggaaatgtccaggaaggtgtggaagagagcacaatgtcacgtatcttattttcctaggcttgttttttttatacttaatgtcctgaattttattcttaagccagttccagataagcaagactaagtaagcagaaatttcagttatctttttgagaaacttttccttgaaagcttgaaggcaaaaataattggaaaactcatttacccatctaggcacatcacatttgcctgctctgtacttcacaaacattctggagcctacacagtcagacaagatagtggttgctacatgaaactcaagaagaacgaagaccaaagtgtggacactgtgccccttcttagatttgggaacaaaacacccatggaaggagttacagagacaaagtttggagctgagacaaaaggatggaccatctagagactgctatatccagggatccatcccataatcagcctctaaacgctgacaccattgcatacactagcaagattttgctgataggaccctgatatggctgtctctagtgagactatgccggggcctagcaaacacagaagtggatgctcatagtcagctattggatggatcacagtacccccattggaggagctagagaaagtacccaaggagctaaagggatctgcaaccctatagatggaacaacattatgaactaaccagtaccccggagctcttgactctagctgcatatgtatcaaaagatggcctagccggccatcactggaaagagaggcccattggacttgcaaactttatatgccccagtacaggggaacgctagggccaaaaactgggagtgggtgggagggtatggggaacttttgggatagcattggaaatgtaaatgaggaaaatacctaataaaaaaattttaaaaaagatagtggttgctaagtatctagcccagggcctgtccctcagtgagcgcctgatcccttcctggagttcataaccaaagccattttttagattctagatgggactgtgttttggaggattaattaacacatttggcttgtcttaatatattcctcaaacacatagcttttgagtgcttcctgggagctcagttgattctaaatgagaccataacacagatccgaggaaagaatgagaaaaacatacaagccaagaagtcactctgatgcctgcttttagaagggctgtagaactgaaggaacatcatcagatgggaaaactagcagggagagggtggtagcaagacgcacccattagaactgcgtggttagagactttctcttagagtgtcttggagtgaagacaacgtgaggagaggaacagctgggggaagcgttgggcagagaggtacagaggacagcaaggaagccagtgaggttgtagccagggcagagaaaaggtcctttgaggcttttcttagaaccggttcacaatctccagtgtccagccaatgatgtcacgtggagctactatatgtatgatgattgatatctttattcatgtttttatcattgtctgtagcagcaaagattgacagtccctattgtagatgtaggaatggataccattctgttctgtttgatgctggagttagagtgccatggttgctccgtgttttagtgatctgctatttgccggtacatatccaggaagacattaaatgtctataatgccttaaggctctcactgtaatgttttcctttaattacactggtagcaaaagtccatctcctattgttactttcatcattagcaggacaaatatgcattatttataggtccaaaggcaggctcctgtggcatataaagtaaattaataaggatggctcagcattaagctatgtcagagctgagtccaattttattccggtccagggatgactttctatgtggcctttctggctctgaagctaatttggatgctgagtagccccacaggtatttatatgtagcgtttggtatttttactgggccctattcttctcccttggatcacctaaaatggttaagaattttctagtgggattaaggttgtgatctcaggggaggggtgggacatctgctcttggttatttttgtgtgagctgcttccccttaaatgtatgttcacaaatgagccaaagcgttatcatctggggttgagggaagacaggtctgggtgccgctcctgaacttggcctctgagccatggcttctcaaagacactcaggtaaaaacctccctgttatttctcttatctagaggacagttgtttcaggccaatgaatctgtcattggtctagaagataatttgggatggggtgattttagtgctgtgtaaatggtaagtaaatcctggctgctgtctgtttcgttcttgttctgttttaatgatgagatgaaagtgttctccctcaagtaaacttagatgctaaatttattgattagtattgttttataccttattttacatttcaggatgtcttgggaaacttagatataatgtgatatgaggaatgaagtttgattttgttgtttggtctgggttgttaggaaattttggggtcattcatctctacagtacttgaagtctaacgtaaggcatttagggaaagggaaattgagtatggagagggaaggaggattatatttgtaactaaagtatccataaatgacttaagatgtcttccttttttccaaacaatattcttaatttttctaaagaatcagttatgtgtctttttgtcatggaaaacatagtatttgttattcttagctgaaaatgtttcctgtcccttaaaaaccatgagtgagggtttcctcgtgttttatagcctggcattagggatcctttcggccctaaacaagatgcctatgagataggggctggaggctggaagcccagtgctgtgaaactattgcactgtctgtgtcactgcctaaagccaagagtggagctgtttttctgctgccctcggctcctctgcttggcgctgggggagacagatgggcagaaaccaaacacttgctcctgtctcccaaatttcaggttatgggacaaagttactactgatggtagtctttttatttatttatttttatttttttatgtttggaagtttgatgtttgaaacttgggattgcctgttgatattattgacaatagaaatagcttttgaagaaattcctttttcagtatgtccaagcacatgtagagcggtggagttgcccacttaagtaatacacactccttgcattgtttctgtgtttaaaagctgtttgatgatttttctataaccctcagagattgttttaccaatatggattggtaccacatgtctgaggtggtgattatctgccaacccatcagctggaccagtttccctaatgggccttgactccacatcaactggtagattagttacaattggattatctaaaaatattacctaagctcttaggtgataacaaaaacaataatgataatgataataataaaataacaaaaattgttagaacagttttaatacttattatatgatttttataaattaagaactaacagtgtgctttgtggtaagttcattggtccatagaagcagagaagaactactttcatagaggagagagaagccctcacagaaggaaactcagtgttgttctgaaatgggctttggttgagcaacaggaaggctcaggtctttggatttgaactcattttttcgtagccatccacacaaacgggacattttaagggcaaaggtgtatactttcagcattaaacattttttgtctgaaaaaaccccatcaatttaatttctgttactctttggcttttcaagtcaaggtccatgaatagagtgtagagagaattcagattattttttattatcctgcagttactagttctcttcacaggccaacgaactatctcatacacctgctaccccctccctttttttgtttttcgacacaggttttactgtgtagccctggatgtcctggaactcactcttgtggaccaggctggcctggaattgagagatacacctgcctctgcctgccaagtgcccactgcccctccctccttttaatgctaaaaatggaaactaagagttgggagaagaggagaggaattgaagagaagtgccttcttaaaatcccagacagacagagtggtattagttcacagctttgtccgatggaagaataaacgcagatatggtttcatttaataatcacatatgcagcccttcttacactagacatgaactaaaatggtgttatctgtgcatcagtgactcaaaagagctttaattttttttaacaaattgtggcattctagagacattgccagtaacattggatcattgtgttcattttatatttttaagcaataataatgataataataataataaaaaactcttgctgaattttctacaaaattttcagctctgactcataagttccatttccccgagactatttaggtgtttattcccaaatgtctgacaacacccccaggtgtgtgttagcgtgtctgtcacacaagtgtcctattcatcagctgagcttctatttgttgaatgttctgaggagtgcactatgtccttttctctggaagccaacatttattgctatggcaccgatgtgttgcactgagcaatgagctggcttttgttttccctctgggtggtgttcagtgtttgcttggttagagcagtcaggcaaagcacacagagaaagaagggtgcctagatagagcacccactttcttctgaaaagttcatttgaaccacttggtttgagggacaaatgaatattattagcaagaaagactttagaaagtatatgaaaccccaaacaagactttatgacatacaaatcttctttaacaggtgtacactaagaaaagtgcttgagttagtgaatatgcagttgctctttgtttctaagtattagttggatatgtatatgattcagtgtgaagctaggtcatttttctcttgtgtgtatacacatctgtgtgagactgcttaagtgtgtgtgtacatgtatgtacatgtgtgtatatgtgtatatgtccccatacgtgcatatgtgtgcttatagaaaggccagtagtcagtgttgggtgttttcggttgtttatttttggaggcagggtctctcactgaacgtggagttcagcttggctggctggctaggacaagattcaggctcacaccagtccaccttccttttttatgtgggttctggggagccaaagtcaggtcctcatgttcacacaagcattcaactgagagatccacccctccactctctaaattctgtttttgagatactgatgtttctataagcaccttttggcatgctggatataaattaagttcgttcattctctctctctctctctctctctctctctctctctctctctgtctctctctctctctctctctctctggagggggaagcatacttattaaatgaacaatgatgtttcctgagaaaagtcaggctgacaccatagaatggctaggtaacatttgatcacctagctagattttaactgtattaagctaagcatccagaattactttccttaaacatatttgtaccaaagatatcttagaaaaatcagatgacagttcacatgacagagaggtattgtttagatgtggggaccttaggataacgggaggtgaattttaaaatcaggacatagtattttgtttttaaactcaggacctagtatcaggttcatttacctgtaaacgtaggaaagaatttggttcatgaaagagaaaaaaaaagttctcccgaaaggaaagccagtattgcctagaaatagaggctcagatcattggaccagaatccattccgagcgcctgtccacacactgaagttttagaaggtcagtggggatgaccgtttcccatctgcctgccagtagggcacagtgaataatttctatatataaggtcctgaactaggttcctgggcttccattatggtggcagagacatcacttccatgtacaaatgaaggctacgctgagattaaaattcattaaagaaggtgccctcagacacagtgtctccagaagaagcaataagggaagcggcagtgtcagtgcatgtagcagtatttccatttcatggtagatgacctttccaagttaaaaaccattgtaggtcaaagcaaaggtgtctagaaatttgtggggtgtaaaaggttgaacatttcatgtacttaaaaattgctaaaggagtagatttctttcttaagggagaaatgctgaagagcatgacactcagcaagagtagagagcccaccaaggaggttggttccttcttctctctgctgatttctaatgaaggcgaggggtaaaccaccagcttctcctctcccatatgactccatcttccttggcacccaccacttagaacatgtattctcctttaggaacctttgtgccaatactgttgtttgtccttagcacctgatgttaattcctgtgaatgtttttgtcttgaaaaagtacctatattttatgtgaggttttggtgcagtgactatctcaccagaagcaatatattactccagttttgtatgtagtaaagcatatgctataaggctttgcaatcgttttgtaccaaataatcatatagttagaaaaaatgagaggttggataatttaggttgcccaaagtttcacttagatttttttgctaaataaagttaatgtatttaacattactacatactttaagtatttccaaattgtttgtgcatttgaggaggaatccaacattcctagacgtgcctattttatcttgattaatagttgtttccacacatagaaatgacttgagtcaactgttaaaaatcagtcctaaaatagtccctttgaaatccatcttctccagctgcatacagagtctggcctcaagtatattgtggtggggaatctgaggtgatcctcatttctcctgcttttaaaatagaaaaatatagccaggtggtggtggcacacacctttaatcccagtactctggagacagaggccagcctattctacagacaagttccaaggcagctaaggttataaatcctgtcttaacaacaaaacaacaaaaaacaagcaagcaaacaaacaaaaaaatcctaaaaagatggacagccaaaagccaaaacttaaaagcactgagatttgaggacaattttgctagtaccattaacttggagttggctcatttcatgtgtctttggcgtgctttagaaacctgtgttaaaggaatgaacaggaggtgtgtattttcattgatggatatttctaatacactttggtataggcatgtctataccaacctgcagactacatgcatcccaggatagctataagtgtgactctgcacatttgtgcatcaaagcaccatgtcacattgtcaaaaggctggaaccttgctcttaggcttggcaggtatctgtctggtactctgaatcgtaatgtaaactagccttttcttaaaaacctctagataccagctcatgcctgtaaaaatctcaacatgtaggaggtctaagtagaaggtttactacaagttcatgaccagtcttggctacagcattagactttgtctaaaagcaaagtcaagacaaaaccactagatacctataaatgaaatttgctgtgttttctagcattttatttctttttgtgtgacccagcacctattttaaccataaagggagtgcccagcaataccaaaaggtaggactccttttaggtgggaatcagtacagttcttaaatagaaaaatatttagaatccattacggcttttctagacattaagagagtgatagtaaacaagaaatagacaactcagtaagggagaatgtttgcttttcaaatatggatgatggaattgctgggctgcacaaattctgtttccttgccattggcacttagagtcactgatcatttgagttccttgtacttagtcttttgttttatttagtttatggtttaaaagattaaaggattaaaaccagggactcatgcatgttaaacagagatcctgcccttttatccccagccttttaaaacttagaaaaaaaatcacaaggtggcggtttgattcagttgcaaaggctagctttgaattccctctatagagcagataggccttgaacctccatccttctgtataatccccctgaggagcagggattacaggtctgtaccaccggactgacctggcccctacctggctggcatctaaagaatcagttgggttttcaaatgaggtcttagaaagaaagcccatctttgttgatgtacacaaccattgtacaatttccacatggcagaagaaaacaaatgggagagaccagttcaaacagatggaaaggggtttcccacaggcagtcatggccacgggtacttgtgcctgtaagccacaagaagttggaacagatgcctcaaagttacttggtaactcaagaaaatcgactgggcttccttgtgtgtgtgtagtttgtgtttacctctatacacaagggaacatggctggggattttagagaaaagcccaagcaagagcgattctctcattttccctattgacttgacagcgatacaactgtgccaagcaaaggtcgttatacaaaaatgtccctcatttacttcttgtgtcacttctctgacatgaggggcctgggtagtggatgtgtcagtggactttgtgtttgttccatggccccaccttcccttgcggagagagactggcataagagactgacagtccaagtgagagttcaccagcctcagcccaagcgcgttcccagacaaagggtgtggtttccttagctcactctgctatttggttgcctatggcagcagaatccaaacaacttggacatgtggttgcatttaaaaaaaaaaaaaaaacctgggaatagaacccaaagcaggagtttggggccattcagttggtggaagagctgcggtgagtacagacaggcaactgctcatttctctccccattctttctctaaagtacatgcaggatgaatagtttcagttcaaatggtttcagttcttgtgtttctaacacaaattaaataattgctgtctatttgcttatgcaaattccttttctaatgggagaagaaaaattagcatatgtgtgaagaaattgggaactaatagaaacccttcctggtggcaggattctctagaaaaaaaaatggtttggcaaagggactggcagcagaagaccttagcagggctgtgggagtctgtaggcttgttacttacagctgtctggggccacagctgggatgctggtggggagcgaaaggagtttgatcatatgagggaggaggaggttcttggaatggcgactttagccctttgcaaaagtcagttttccagattatacttaaaactttttttttttttttttttttttgctgtttagagcagcagatatgacaaaaggtaatacttgcatagctaggccagccctcactgtctggatctgagagagatttgattttgatgtgtcacaaaactctacttcactgtgacaaatccttcataattgcagaatgagcctgttggccaaacttcagccaccaagaaaatatctgggacaaaactgtctgggctctttccaaggactgaagctgcttctgtccacttaaacatttgaaacaagttcatgagggctgcatgggtgcctgggggtaatgacttagctgttaagtttctgttcggatgactagaactgtatagacaggaaggaagtgagaccacccgaacatatttgcccccaccctaaaaggtgacagaatatgaggtcaaaactggcagggaggcttctggctggctgtgtggtgggcccctgctgtgccccattcttttgaagtgtcggtgcaaggcagtagaacatggcatagaccagtggatgcacgcagtacacctgccctgcccaatagtctttttttcctgctccaccttaccctcccattcccctttccattcttggttacttttcaaccctggatgaatctcccagaatccctctgtgtggtgaccttagcctaaggtctggcccacttgtcctctgagtcagcagcgtgatttctgacatgtccctagggaattactggcccctttacatgtgatacttagagttcaaatcagaggccttttcttcctgggagccatagtgaagtatctgttgctgtgacacttggtaattagccaggcttaaatggaagctggaccctgaggactcagggttttcctagctacttgacaacagtgccctgggacctccagggctgtctatggcagagtgtccttgtgtttcccttactcatttgtcctgcttgcttgtccctacaggtccctccagctataaggtgggcaccatgtcggagaagttcgactgtcactactgcagggaccccttgcaggggaagaagtacgtgcagaaggatggccgtcactgctgcctgaagtgctttgacaagttctgcgccaacacctgcgtggactgccgcaagcccataagcgctgatgccaaggtaactgttgttgctgatggggaaacgggaccggctgggtgggcttcaggtgtattcctgcagccttgccagcaacgctgccaatttgaattctcatcacagcagccttaagtacttgaggcaggtgcttctgatgtccctagcttaaaaaaatctataatatggacattggactcgatggcctgctaaggcactgccagctctttcatagtataggtttaatggcctttagccgaaaagcttagcaatagaagtgtttaattttggatttcttattttataatacttctacatatttaatgaagggtactaaaatgatactcaagtctaaacacaaaattcatttacatttcatatatacatagcctgaaggtgattttatatagagtttttgtctttcaaattaaatataattctatcatttttcccctttccctttttttcctccatcctaatttgggcatcctccagttcccgcatgctttctctcaagttcacagcctctggcctcctttccctttactgtctgtggaatgtcatttctgtgctctagctgacgggactggaagggtcttacttttcccagggacacagaataaactgtgtgttgtgctttgacactgtgaccgtgacctggcccacgagatcagatgtgtccttttctccttgtgagatctgtctgttaacccgtttacgcttgagattccggagccttttggatttcaggcttgggctgggggctctcccccctcctcttatgtactttgggaactgtgaggctttcgtcttcactccagtgctactcttcctgttactcctaaaagcactcagcacagggcatccccacatggagggggctgacattggcgtgagtagttacctggccctggagaacctggtctctgatggtaaggctactgccactggccccagtgcccctcacagtggccaccctgctctgcttgatgtccaggaggtgcattataagaatcgctactggcacgacaactgcttccgctgtgccaagtgccttcaccccttggccagtgagacctttgtgtccaaggatggcaagatcctgtgcaacaagtgcgctactcgggaggactcccccaggtgcaaagggtgcttcaaggccattgtggcaggtactggccccctcccaccctgaaggcagacatgctgtgtgcttgcttgtcatggtggggctaactttgctgtgagctgctttgagattttagcatatatatgtacacatatacatacgtgtatgtatgcgtacatatatatgctcgcacacacgcacacactcggagactaacgagcactggagagaacagtctgtggccagagaatgaagtgagaagtatgtagcatttcctcctttgggcgtagtaagtgatccatgcatgcttcttcctcaggcgtttttgggttaggcagacccgtagtgaaacttattaagtcattgcaatggtggaagtggggcgtggggcttcaggtacctctcctaaatggtcctgccaggatccccacctgtgacagagcccggggttggcatgactgcaagtagcactcagataggatgaggccactgactgcagggccctgcatcccctcacctctgggggtgggctggggagctgagtggatgcagccccctgcagagcctggcagtggggctatcacattgtttccccctgcaggagaccagaacgtggagtacaagggcaccgtctggcataaagactgcttcacctgcagcaactgcaagcaagtcattgggaccggaagcttcttcccgaaaggggaggacttctactgtgtgacttgccatgagaccaagttcgccaaacattgcgtgaagtgcaacaaggtatgttgtggtaggtttgcatcaagtgctgtttccctggaggttggcagtttgcagagcacttgcacacacattatctcattccatcttcatgatagccctgtgacgtaggaattattgtgcccattttacagacgaggagccgaggcttagaaagcagtgccacagctgattgtctgtgtctctctattctgagccggcagccctggctctggaggcctgtggcctccactttattcctttccaaagaggcgcaccttgtctaggccttggtctcctcatctgtaaattggggataataatagcaccttcctcccatggctgtagtgctaatgaaatgagatactgtatcccgaagcatccagcacagtgcctggttgttgaatctgaatcccggtgctacactccctggtctaggccatcacatctggaggaatcacttaccaggatcagccctggcatgccgagtgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtcc

SEQ ID NO: 463 - DNA, 9405 bp, mus musculus
tgtggcaacgccattgcctgtgctttgttgaacctttccgagtttactggagccatttatagtatgtgtgatctaaaagtctgacccttccctaatggatgttatcgcgatgagagatgtattccgattcattttatttgttttattttcattcgtgtttggaagagaatgttaattcatggagaaactgctacccttacaggaatctagtaagagccccaaaacaatgaagaagtttcttcacaaaagaaagacggagaggaaagcatccgaggaagaatacgtgattaggaaaagtatgtgcctgtacttttgcaaagttatttatgggtgaactaacatgacaatgtttaaaaagcagataattagagcagtttgttcttggcatcatctgttgtaaaaaaatacacagaaaatttgctcacttctaagacttcagaataagcttcctcctgctgcacttcctgctgactctgacagacatcagtctggaccattttcatgctgcatcacctcaccccacctggtttagatcccccaattggtacccattttctaagggcacatttttccctctagatttctgatgcctggaatatttttttctgaaaaaccaaatggacctgaggacagaaatcggtcggacagtctcatgctcagggatgtcctcagttgcccatggagtcagtctgctgacatcagaaaacagagctgtatttaggagatgcctacaaagtcagccagacaatcgatatgtctgtatttgactctaaaattgtgaacaagggaactttgggagcatacatggagacatcagtgttttagcaagcaatgcatatatcagttgcaagtatagtttagttaaatctttcctgtggctagggacatagcttaattcatagagtgcttgttgagcatgcacaaagcccaaagtttgatccctagcatgatataaaccaggcatggtggcatgtgcctctaatccctgcttggaaggtggaggtaggaagatcagaatttcaactcatcctcagctacataacaagttagctgtaaccctggactgtatgagactctgatatgatataataaattataatataatataatgtaatataatataatatattaaaattatatctttgctaaacttcaactcctgaagctccaaccccactgttacctaaacttattagtggaacattgccatctgagtatttaaagactgagttggggagatgataagtgatatctggctggttgaaaagatgggtggggtcaacaggaaaagactcttaaagaaggcaagtcttgaaatttaattgatagaaagactttggtgtcctggatgagagttagagcaaaaccaagcccactgccatcattttagccttcaagagattattaataaaacccttactgctttagagttctgaacttcaaagcaacattccttcccctgggtaatgaccccagaactcttggggttattcttgatagcattcttttgcctcgtggggcttgaacaaatttctacctgcctttcagaaacactgcgaacccttggcagtgatgggcacaacacatcattttgagtgtttggggtcatatatgtagcaaaagttattactgattaaatttgacaggtactgctgccctggaagaggatgctcagattcttaaggtgatcgaagcttattgcaccagcgccagttttcaacaaggtaatggctcaattagaattcgccacactgcttttgctaatgaatggggttttattgtttagtgctcactgtctcttagaaggaaaaaaaaaccttcaataagatggggtttgggtttgcagggtatgaaaagcatgtgactcaatgcagagcagaagtgcaggactgaatctttcagataaggtgctttagttactgggtggtttgcttatgaactgttgcttttcacccagagagaaagagatgcaagagggaaaatgttagaggtgatagaaatgagaaaaaaaatttttttaaagtcactctcttttgatctacacagatacctccaccagcactagttaggaattaaagagcccagagagttcctgtgtctgcaaactgatgctaatctcgtcttataggcagaataggaaaggaagtcagaatactatctctcatcagctatgtattgaagtgagcgatgcttcatcagacttgggtttcaaagttgctctgaaaatccgaaaaatgtagctacacagctgagacttcacaatgtataaaatgtctcaaggagctgtgagatttgggcatttgcctaaacagcttttaggttatacccttgaaagctgggtgatgccttttgacaaacccttgtgctcttcgcactctaggtcacatagattatatatttcgttttctctcatctcagactttacgccattactgaactggcccctttagagagtttttctcatctgcatagggaatgaacatcccctggtgctgtagtattcacagctgctgaccagctgcttactcggaatgagagggatttcataagagactgccttaacacaaagtaacacatctcacaggctgtcacaaaaggaaagcatttgatgtggaaatcaatacatttcactgtgaacagggacagtgtaccacagatgcaacctggctgcacttctggcatgctcggttctaataagttttgatgagctgggggaggagagtgagagaagtttttattgtgaaaggtagggtggaaatggggacgaggagacaccagagcatccctcatacaaaatctgaccttacctcacctctgagccacttgtttttctactttggtgtctagccctgtactcagaggtaaaagctcaggcatgtgatctgccctaagaaaaagagcagttttgttcctccttcttacattcccttggacatgtaggaagtatcccgcttgacactcagatgtggccaacatttcagcagcatcatgggccagtctaatgtcctgtttccctagaaatgactgctcttggctttcttttatccatccatttatcttctgcatactgatgaagggccattctccgaacacagaaagggaaacacatcttccctctggggaaatggaagtggtcaaggaaagcagtgaatgtatacctctgtgcaggatactcttccaaaacagtgacctagacagtggcttagacagaccaaagattatgtctctgaacccagagaggaaggatctagattgccaggctggagaggcagtgtgggcagagagaagtgaagaaacctgagttttgttgctgagataatctcccatctccactgtacccaccaccaaaatagctttaggctgctctgcatttcctagaggaccatggaaggaacgagtgctgcttctgcagcccgttttgccgtgttgtaccccagagcagtgctgcctctcagcccgatcttcactgaaattaaagaattcccagtgatcatgggatgtgctgtgtgactcttggaggcatgcagagactgggtgatcagtgatgagctctttgctctgggaaagggaaaacagaaaagtctgggactcctaccacatcagttccccttcttgaagacaaaataaggtcatttggtcatttagagtcccctatcgggaagtgtaaaagtggcatgcttgccctttgagtacaagggcatgaagaatgtctctgctgtaactacaatagaaaggaacaaatacctaggtctgcctctgataactccctaccccatcttacatgatcgtgatcatcacttacaggtactcgtaaagattctgttccacaagttctactccccgaggaagagaaactcattattgaagaaaccagaagtaatgggcagaccatcattgaagagaagtgagtagagaatgttgctttcttgacatgtctggggcctaaagtaggcatgacatcctgtcttagggcttctgttgctataataaaacactataaccatgaacaagttggaggaagaaactgtttatctcagcttacaactctcaggtcactctccaacgtctagggaagccagggcaggaactcaaacaagggtggaacttggaggtaggagctgatgcaaaggccgtggagggatgctgcacatacatagtcctgctcaagagaacaggctagagtccaagttcttctctcaatttgctgtgtattgtcagggttattgcctgggctattgttagtgtcaccctgggctagctcttccacctctctgaatttgttttcctcatctgtaaaatgtgagtgatggagatactttctgtgttattttttgatcacaaaatgttttataacctttataaaggttagcactcaaaaatgtatgcccatctatagtaattattgttattaagaacattattattgatatagtagtcatcattagccttgtgaaggctgcaagggatgtagtattatccttatttcatatataaagtaagtagtagccatgacaagacaaaaagaaaactggttacacatgttcaaaatgacagtaagtgacagaataaaaacgaaaacctagggcctagagagatgattcagtagttaagagcaccagctgatctttcagaggaccctggttaaattcacaagacacaggtagggcacctagctcacactgcttgaaattccagttctaggtgatctggcgccctcttctggcctccttgagtacctgcattcacatgcacataaacgcacacatcaaacataaaaattaatcttaaaaaaaaatccccaactaaaatctgatctgaaagttccttgatttggaagaaatcgagaaacaaggaatgccaccactaaccagggaacttcatcatcattttttaaaaattattatttttttaatgtcctaattctctgttatgaaaggttagctaaataaagagtaataccatagcatggctattgtagcatatatagggtcttgtgatagcatagctttaattatattgtaagtaatatttacccctactctaaagctgcagcaataaaaccaaaggatgagactcttttaaaaattgaactcataggagcagaatagaccagaagcttggagggggtagaagaaataggtgatggtgataaaaaaaaagtttaatgttcatttgtatagggtgataggtaagttttagtctatctaacagtgactataattaatagcaatatatattggtttttcaagacagggtttctctgtatcgccctactgtcctggatctcactctctagaccaggctggccttgaactcagaaatccatctgcctctgcctcccaagtgctgagattaaaggcgtgcgccactatgcccggcttttttttttatagcaatatttttttaaacttgaaatttactaagagcattgacctcctgtgttcccaatactctctctctctctctctctctctctctctctctctctctctctctcacacacacacacacacacacacacacacacacacacacacaaattgtagctataaatacatgtggtgatggttgtgataataatttcatttatgacataatttcataagacaaacacaccaaagctgtatactttaaatattatactttaaatatatcatttcaaatttgtctaccatgtcctcaaattgaaaaagaaaacacatttcattgttgcaatctgttatgttctggtcacatgagctgggactgagaagtgaactgtgcagtatagaaatgatgctgtaacatggtgttgaaatgagcatatgtgatgagaggtttcctcctatgaagagaaaggatgtgggtcattctttctccccatcaagtagaaacccactgatatttccatctctgtatttatatagaatggtaggctccttatttatcagcacttcagtaccaaccattcatttataaatttgctctgtatattttaggagccttgttgatactgtctatgccttgaaggatgaggtcaaggaactgaagcaggtaatgcattaccaaagctatcttctcagataaaaatagaattgctctgtcttctttgccactgggagagggattcaggaagagcccaggagcagatactaagggagggttgctattttctttgtggtatcaggtgggttttatttattttaccatatggccttgaatttctgagcctttctatttagatatatacagcagagtcccaaacttagatacagctttcttgttcccacacatcttttaataaatgtaagcaagctcaggtatggtggtacctgtctgcaatcctagccattaggaaggttgaggtaaggacatcatggattcgctagtctggtatagcaagaccttgtcatgaaaacaaataaagggaataatgaaggagatataaaagaggaaagaagttagtaaggaaagatggaagagagagttgtctgtggtggtttgtgaatttatgggcagtgtggtcctatgttccatatgtgataagactgattgtacctgtgagaaggggatgcatagggaagaggggagtcgagagcctgcaggagcacttgtggaatgcttagcatatcctggatgaggcatggtgaagtcgagagctgaggccggccagtgaggccatgaggaatagagcaaatataaagagacattgcagagtcgaggcttatggcacattatggcacagggcaaggatcaggagagaacagacattagagaagcgtcttccctggttgtctaatttgctatggtgggcaacctctcaaggatccagaagcactggaagaggtttcgggtagtgggagaagtgatactaagttccctttagaacataataagtttaaggtatttgacctgccccattgatatggccctatgggtctggcactcagaagatgaagttggcaccagagatatttggggagcctcttagcacatgcttgcattgaaagaaaagtaatcctgaatgaaaaagcatggagcaagttgtctgtgcagcaggttccatctgcaaggacatttggagaaaagtgaagagtgtaggaggctgcttacacacaggcagagaaccaagagacagcctgctctcagaatatgtagtcagtgtgaaggatgctatgatgaggaggggaagtaggagggggaggaaccccgagaagggctgccttagctcagtgattaataactcttttcccttcaaggagaataaaaaaatgaagcaatgtctggaagaagaattgaagtcgaggaaggacctagagaagctggtccggaagctgttgaaacaaacagatgaatgcattcgatctgaatccagcagcaagacctcgattctccagtaaccatcactgtgcagctgagcacagtgccttcagcactccttaaagtggccagctgaatggtttcactgtgcatttgagctttgtgctttgtggtgttgggatgctctctctttcttcctctctcccttcccctcccccttccccctccactgtttgattcagagtttattgcttggttatcagttgattgacacttgttttaacagggggaaatagcctgacgtggtggccaaaatggccccaatactttgctatgcccaacagccctttactacctaattcgctggaggctaagcttctcaggctatgtatagagtaggtgaaaatgaacacctttgcccagtgacccagttgcacttccctttactatcatatggcccccttcagtactttaagaacttattgcccatgttgtctgttgagatcaagaacagtgtagtgcccttatgccctctgccctctgtgctgttgtccatttaaagtcagtgtggtaggaactccaaccatccacaccagcaccaagtctctcagcaaattgcttcaggcagtcctccgtcagcagcagggcaaagcagcttgatggagtacttatccctagtatagcgtagctttacagcccagccctctgcctctatgtaagttttctacctcccctcaaccccatgcttttagccagccatacaaagtggggtgtcaatgatcatggatttgctttgcttatcttgtcagttactgtgagcaatgactttactttgaatattcccatgacaaccttttcacctttctaaacaacttgggtgagaaaatattgtgccctcgtacaccttccatcccatctcaccaagctctggtttctgcaatgagaagttggactcatcagtggcctctaggatgatgatccagattatagaccctgagttaaagggcccctcctagctggagcaggctgtcagtgaagctgactatttgaaactagtttgttcaagttgtttataatgtcaaaccattgactttgtatgtggtccagaaaagtgacccgtgagaaagcagatttcacagagagccccagaagaacactgtatacctaaattcaacacaagtcaaaatgggctgaggatggaggaacacagctctcacctacctcctcagatgacagcacaacttggccagatggcaaagtcactggaaaaagatgcagaaagccaaccaaaggcttacgtgtatattatttgattgggccctgtaagggttgtttcaaaaccaaccttgaggcctaaaagcttgttgaggagcccttttcctttgtgatatggaggctctcacagtttccataactttatggtacagtgctattatctcatgttacatggccaacattatagcacccacaggatgtggagtattcctaaaggccaacctcagacaatcgcatagagctatctttgtcagcttagagagtaaaggttgctaagaacagctgtcctgtttctaagcccagagatttctatgagacatctttcatgtaaaacatttttacaaaaggaataacagtagcaacccacatgttcccatttgtcctgtctgtgcttggtcaatagttggcaatcaatgtgcaaaatttgtccataggaaaaaccacttttgtggtcgccaaataatttagttcattgcttaagacattgaaaggtctcataaaggatgtgtacatatgcatgtttggggactttgcccttatgaggagaggcccttggtactctggataaggaaacttgtgcagtgggctgcccatgcttacacactaaataatataaaggaaatgaagccatgttaactccacagtcatgtctccatagttgtgttgtttacaatactctggaagtaaactgctgcccttaggggcctttcagtttcccctctgttatgtcccttcttataggagctcagattttctaaacttgtttttattttaaagacttttaaaatggacattttcaataaacaagaataaacagtgctttataaataa

SEQ ID NO: 464 - DNA, 2009 bp, mus musculus
atgtctaaggaaccaacagctggcactgattttggcaccgcttactactgtttgagtgtcttgcagcatggaaaattgctagtgaccaaggtaactaagccacaccaatgtatgttgcatttaatacttggagtgattaatttggaatttttggaagaatcaggttgtggtgaaccccaccaaggcaatttttgatgccaaacatatggttgggcataggtttgacaatgccatttttcagtatgatatgaagcattgggccattatggtggtgaatgatacaggttagccaaaggtcaaagtagaatataaaggaaaaacaaaaattttcttcccagaagaggtgtcctctatgattctaaaaaagatgaaaaaaaaaatgtagaagcctgtctgggaaagattgtgaccaatgactgtcagcactaggcaataaaaaaatgctggaactattgctggccttaatgtacttaggattatcaatgaacgtgctgctattgcttatgtttgaagctgagaggagtgtgttgatttttttattggggggggtgatatatttgacatgtcaaccctcactatttcagatggaatattttaggttgactatacagctggagattctctcatgggtagagaagactgacaatcaaatggttaaccatttaattagagtttaagtgcaagcacaaagaggacatcagtgaaaataagagagatttccaacatctttactgcttatgaatctcttctagcacctaggccggtgttgaggttgattcttcccaatgaaggaatcaacttttatacctttttcacctgtgctcaatttgaagaattgaatattgatctgttctgtgacacttggaccttgaaaaggctctttgaggtgccaaactagacaagtcacagatccatgatattgtcctggtgggtgtttctaccaggatccccagggttcagaagcttctgcaagatttcttcaatggaaaagaactgaacacaagcattaaccccaaggaagctgtccaggagtccgttctatctgcagacaagtctgagaatgttaagaatttactgctctcagatgtcacttctcttcttcttgatattgaaatttctgatagagttatgactgtccatcatgaagcacaataccatcattcccaccaagcagacacagatcttcaccacctcctctgacaaccagctgcatgtgccttttcacgtatatgaaggtaaaagggtcatgactaaggttaacaacctgtttggaaactttcaactcatagatatagctttagcatcccatgacattcctcagaatgaagtcacttttgacactgatactaatgtcaatctcaatttttctgctatggataagagtcccagaaaggagaacaaactcatcatcaccagtggattacaagggatgcttaagcaaggagggtattgactgcatagtctgtgaagctgagaagtacaaagctgaagactagaagcagagggatgaggtatcatccaagagttcactggagttctatacattcaactgaaagcaacagccatggaggagaaacttctaggcaataccagttatgaggacaaatagaagattctagacataaaatcatcatctggctggataataattaaattccagagaaggaaggagctgaacatcagcagaaagaactgaagaaggtctgaaacctcattgttaccccgtcatcaacaagctgtacctgctgggaagcatgcctggtagctgccctggtgggagccctctccctgatggtacttcttcgggacctaccatcgaaaagattaaatcagtcccagaagaggtgtaacattgttccacagggaaatatttgaaggacccaaatttagcaagttctgtggtagtttgaaagttaagctgctacaataaattacttggcattctcaatactttaacccggaatatgtgcacagggagggaaaatagaacattgaactttataagcaca

SEQ ID NO: 465 - DNA, 64 bp, mus musculus
aggtagtgagggcgaaggggcacggggttttggttcaagttgaggtctgggacaactctagctc

SEQ ID NO: 466 - DNA, 64 bp, mus musculus; identical to SEQ ID NO: 465

SEQ ID NO: 467 - DNA, 333 bp, mus musculus
cgcgccgcgaccgcgggcgtgggggtggggggagtcctaaagtccccggcctcggcttgaaaaggccgaagccacggggagcaggggcggggttgaagcccggaccggagcctcctctttcctccctgcgggtcccagctaaggccccggccgagctctcacacgtgcgcgctaaaaacccacttcaaagtgtgttcgcagtgccgaggaggccccttttggatcagcctcatactcagggaatgcaggagcctcgccgcctccattcccggcactgcagatgctctttggagagcctagcaagagggcgtttgccgagtgatgcggatgtcg

SEQ ID NO: 468 - DNA, 235 bp, mus musculus
gccccgccccgccccgccctccccgcgacccgcccccagccccggcccgcccgcctcgggggcggcggccccgtcgctccccttatctggccccagcaccgccccgcgctcccgccgcagcccgcctcgcagcgagcccggcgcgcgggggagggatggcggaccggccgctgctcagcctggctccccgtcagcgcccgcctcggcaccccgcgcctcacgctcgtcctgccgc

SEQ ID NO: 469 - DNA, 128 bp, mus musculus
ggcccgcctcgaggcttccaggcgtgcccgcttcctgcccgggagtggccgctctctgagggacgactcgggacgagccggggactaaggggaccctggcgcgggcgggcgggcgcggcgcgggcggc

SEQ ID NO: 470 - DNA, 831 bp, mus musculus
atggaggaccagccgaaggaccgtgaggccgaggtcgccgggccctggttttctaagtgggagcgccagtgccttgcagaggcggagcaggcggagcagctgtccccggagctgcaggaggaggcggctgccgatgcggcggggctcaagatcgagcgccagaggctctggcacctcttccagatctcagccacggcagtggcccagctctacaaagattccgggtgccagcagccaggactctctatgtgggaccccttccagaacgcggccatggccgtgaccagcctctacaaagagagcggggatgcctaccagagaagttttgaactgggcgtccaggttggctaccagcgtcgtgtgagagacgtgctggagtgggtgaagaagggtaggagcatcattcgtcgggaagacctcataagcttcctctgtggcaaagttccccccacaccccagcctccacgcaccccccggatgtcccccaggccaccggcggctgcctccactcaagctgctgccactgagtccggcacacctgtgggcgtcgacctacagcccttccacgaggccattgctctccatggcctcagtggtgccatggcaagcatcagcatgcgatctggccctccaggttcctcatctcaagatggaggtattgccagcagtgggcgatggaaaagtagcttcctcgaaaatgatcctaactccttgagctcagaagaactgactctcctcctggacagtgggggagtccgcaagcgcacctctgcccagtttggtgatggctctgcagactctccattgcacaagcgtaaccgaatggtctaa

SEQ ID NO: 471 - DNA, 831 bp, mus musculus; identical to SEQ ID NO: 470

SEQ ID NO: 472 - DNA, 4415 bp, mus musculus
cgtgatgagagctttttcaggaggcgggagtccacgagacccgctctgagaccaccaattagggtctcaaaaagtttgaaagagcgagaaacccgaggaggtgagggaggaggggggaagagggcgcgcgagcaagcgagactggggggaggaggggcagaggagcgcccgcggggttcggaaacaactttgcagactcgactaggctgaccagcgccccatcccatggcccacctggaaagctccccgcccgccgtctgcacggaggacctccaaaccctgctgttgccagcgctaaggacactggggacctctagcagtccaggcatgcttgggacgttgagtgtataacggaggtgcgctacgctgagccactgagaagccttccttggaattgatggtagccggttgcctgaaccctccaccccgagggccactgcgtgcaggaccgagagaggggcgggggccggggagcgggactgctagcgcacctggctgtgaggctccatggggggtttgccagtgcgagtggggagtggcctcggcctgtgcccgggggaggcgctcgaacgtagctcctggggagcgggtttaggatgcaaagggcgaacgagccttcactttttcgctctgggcccctgcttagaggcccctttttgtctctgctgtctggccatttcgggttttccagtccgatgctcctgagggggagggtcgggccccttggaaaatccgttttcatggcaacacggagcctctcgcagtaaaagaaaagtttgggggggggtggccggagctgagcctaggccttgctccgggtgcaccgcccctcctccgaccgcgcacctgctacgaccgctgcgagcggctctcggcacgcagccgcgctcccccccccccccaagcgggctgtgctaacagactctgcttctcctttcttgttttacagcctttctgaccgaaggctggagaagcagagtgggaccttcaggcactttgttgggttatctgccaaggactaccatctagagaaacctccgctgcccggagagggaacccggacattctccgctgccagctcaagcaagtggcatggcgtttgaaaactcttgaagccctcggaggctgctggagggaataggaagccatctgggcagatgtggcagaaaccgaaataaggtgtccgcgcagtactggattcccgcttcctcctttagcttggtggaaaggtgggaaacctaaagaaaagcacatgccctaagtgtgtgtgtgtgtgtgtgtgtgtgtgtgtgagagagagagagagagagagagagagagagagagagagagagagagagagagagagagaattccaggcgtctagcttttcagcgataatactaaatgaggtgatttgggatgcctgtactcccggcttctgtctctttctctcatgcactaattaaaaagtaagccgccaacgtttgcagggcgcagaccagttctgtccatttgtggccacagggtccgttggcacccgaatcttgctttctagccggcatcagttccagaaagtttgtggtcctggttccttccttttaagtttgtgttctacctggtctgagccgtttcctgccaaggatatcagtaaattaggtgggtgtagggggtttaaagtctctggagactgtgtggggatctatgttagtaagtgtgcacgcacacgcacggctgagctggaaaacatgtttcagaacagggaatgtttcagcaggccccacctgcactcgttttcttggtaaattggctgacagactcaagattttctcaggcacacccatggtcccctaaaaaaaccaatgtgcgctggcccttgccctcccagcaccctcttcacgccctctctcgtcgccccccccccctccaccaggcccctgaggctgttgctaagtgaagagccgtttaggaaactacccaaccgactcgcagcctggcgtccagtagcctgacagatgtcaggattctttccaagttttaggacccaagtaagccgttgtggtgacagtgcctgggctgcatatttcccaagacagaggatgtgggtctgggtccctgctcctccccgaagcagattagctgtttgtcatttgatcacaccttgtcctggtttaagtgagctcattttcacattacatcctcctgccagattcgctgagggcttttggtaggatcagacaccttctctcaccctcttggcttctctgcggtgactgtgattaaactgatctctgtgtggtggctctgggctgggctagacagagccaaacaggtgtttcaccgaattcccttcaaaacacttcataggaaactttcttcttacaatttattatttcagtagacaagcagagttaacactgtggacctgaggatattcagggcggctaggaaaccagctttccagaccctccccgcactgaagactaagacaccagtcatgccaaattccttttattgggggggtctgtagacgtatctgagcgggtacttccttaatcttagtggcttctgtctccgcagaggctttccggatggcaaggtattgaactgtagagtctttcaaactgtattctctgtatctgttaacaacaacaacgaaaagcaaaatacatcgggacacaggaaggaaagaatgcgctcagcagagctcttagccttagaggcctctgggattcggtgggcaataccaagagctctggatcccagactaggaaaccggccaagtgcttccccctccacccctccctgcccgccccccatgccccacccccgctccaaggagcgttaagactccctccgattggggtcgagccaggggctcctaggacccatggcgggacaatagcgccgtttgttggcttcatttggaaacttcacccagaggagcccccttctctccctgagggtcttccaggtcttctcaaccccggaaagacaaacagctgcttggctgcagggcagaacaggacctatctttaggaagctggtgtaaaactccagtgatttggcggtctaacccagcgaactccaggtatatagtttatcccctatctccctccttcctgttgcttcgggagaatcaggtgttccaaagggcctcagaactgcagagaacttctggtattgtgctttagagctgatagggagcgttagatctgtgtaggtacctgctggcacgtggagaggatggcagtgtttgaagtttgttcaggctagttcaggcccaagagtagtgccatccgtggtagctggcccacagtgctctaaggttttccaagtatgttggtgcctagggctaaatactggcttgaggacatgaaaacaacttcttttggaaaccttttccagcagacaaaagccttacattttaaaagtcaattctgtctcttcattgagagcattgcttgaccatttaccctggtacatccaagactgtattcaggctacagagggagtgccttgatcaagaagcttgaatctattttagaaccatcctttgtaaaaaggtcagaaaggtcactcctactggtggaaaagacataactttcccattccactagcactatgtgggacccctcccatcccaaaccccacacagcagtgtgtatgtgtgtgtgtatgtgtgtgtgtgggggtgtgtgtgtgtgtgtgaagggacagctttcctgtctttaaggtcagagagggacctgaagatcctaggttggtggatacaggctttaaacaacctagttgatgctctctaaagaaacacttgtaggagctttgagacatggaatagcattgttctggaggtgacaaactgtgtggtggcacaatttattctactgctttttggctgtagatatttttggggtgagcacttttgaaacaagtttctgaattcaattcatttacttagttgttgtagagatgctggggtctctttggcctccccacacttgagggctctcatctgtaagagggactcttactaacaagggtgttaaggtattattaattacccgctctcttttccctaggtgtgcagcaaatctgaggattttgacaaactttgccttcagcgccctcttgttgacttcacaacccatatccattgccttcttcccagaggggggaaagcactgcccaggaacagggtcccatttcagagggcttccagggccactgtcattgccctgtttgtctcctcctcacccccaccccctcccaccactctgcaggagctctgtaattcagatcaaccaactcacacacacacccgcagagcaacccccagaaacctggctcccggatggggggtggctgccctcccactgtgcttgccaggaaagggagtccatctcctttgctgatgcaaaggcatggccctcgct

SEQ ID NO: 473 - DNA, 4415 bp, mus musculus; identical to SEQ ID NO: 472

SEQ ID NO: 474 - DNA, 118599 bp, mus musculus
  misc_feature (2990)..(52989): n is a, c, g, or t
  misc_feature (54627)..(54726): n is a, c, g, or t
  misc_feature (56365)..(56514): n is a, c, g, or t
  misc_feature (68121)..(68220): n is a, c, g, or t
  misc_feature (72092)..(72327): n is a, c, g, or t
cctgctctgggaccctgtgcagtggcgactccagaaccagccacagaaacagacgcaaaatcaaccccagagccggccccgaagccggactcagaaccggactcggacccggccctcgaaccagactcagagccggccccagagccggaccccgaaccagactcagagccggccccagagccggaccccgaaccagactcagagccggccccagagccggaccccgaaccagactcagagccggccccagagccggaccccgaaccagactcagagccggccccagagccggaccccgaaccagactcagagccggccccagagccggaccccgaaccagactcagaaccggccccagaaccagtctcagagccggccccagaacttgtcccagagctggcctcggagccggccccagaacctgtcctagagccaaccctagagttggcctcagaactggccctagaaccagccccagatcctgccatggagagggccccagagtcctggccagagccaactccagagtcctgtctaagaatgagtccagcactacatctgttgcaggtagttcctggagagaaaagtggaacagcatctccagtgctattgccattgccgtcgcccaaaccgccaataacgtggtccagaataaaggtaagaaaaaagaccccagggggcgggggccaaggctaggtccgatgactatggagtttgctagactccgggtatcccttgaatccatttgactaccactcactgcatagaaagatgtgggaatgggagacccggggaagcgggaagtggcgaggaagcgggaagtggttgggaggcgggaagcaacatgtgggaaaagagagtaggctgcttgggttaggaaaagaggtgatagcagaagtgggagtcagagcagtttcccccataggaggaagtgacagtgcagtgagcgcctatatcttgaaaacgcattgaaaggcaccccggggaacacaagataccctgaagtatttggggctggctcgaggcactggagtggaagacactgaggggggagggagatgggacacacctctgccacagtcattgccgcagaggcccaaactgcagagcctctgcctgcttggccccctccctgccactgaggagcagggggcacatcagctgagatgcagctgaagacattccagggaggtgcctggtgcctctgtccactgctgggcactgggatccaggcagaggtgaggggaagggcggcgcccacgcgcactgcaggggaagggcaaggttcgctgggaggagggggagagcctgcgttggagccaccattctgtctgtctgcagaatttcccagcaggtaggtgcaagcacagtgatacagtgacgcgcggcgtcacaagcgggcaactgtcatcccgagccaggaccagttgggatagtactgcagtcctggcttggcaaatgtgaaaaacactagttgggttttgctagcagagcatgtgaaccacaactttcatctctacccgtcgccagcagtttcttgggaaacattgcacttatctgggagaaaacaaaaatgaatgaagggtcctctggcaccagtccatgccagagagcgaggaaggttttcaatgtttacctccagtgtatctgattttctccctgtctctggtttccatagtctaaaacggtgaaaatcacaacaaggcttaaatatatgcctcactttagcttcccccaaagacaaacacacaggtagaggcacaagcagataatgcaacatgccaataaagaaagcctatgcagctgcttggcagggacacatcttgaaaatcttgctgctgtttgacggcacacttgtagaatgcagaatgcagcagggctttcggggtagaactggcatcataaaatagccagatatctgcaatgataaagtctacagtgaaagtctgaaaaaagacaaagggctggggatttatttaaataagtaaaatgggacgatggtgacttggacaagggaaaacaatcaaaatctcagggatgaatcttccccttttcctgcagatattctttcttacttagatttcaagaaaaggagggtgggtagccacacagggagctcaccctaaccctgaggctagctgttgtctttttggaaaggtctgcaatgagctggtgagtgggagatgagcaagaatcacctgacccgtagccatcttaagtgaaaaattgggaactaggctgaaaacgggggacagggggctggctccttaattacctgagtggccttctgaagcattctccctttgacctcaggaaggcaggctgaggggggggcaggaccattttttccccaattctcagtgaaaataatccctccttagctgtgaaagcatattttaccagattgactggaaactatctattgccagatgggaagaatcaaggcaagggtaatcaggttagtttcttttctatggtacctgctcacatatactggctgggtggctcaatggcatgagacagcattcataggagacagagaccccagggggttgagtttaccgtcagaagagtgaggcatttgtggattcacttatctgtagagttaggaaccccaagtatccatcaggaaggacctgtagataaactaatgaaggctcttggagattccaaggatacaaaagatctaggtaaatgttcacattgttaaggaattcaattcttctctgctatctttcagttgcccgctggtgcagttggtaacagctgatcttcagcaatatagccattttcttctgcagtcttttcaagcagctgacttgtatattaacattcaaaacaaataggttgccttattagctggggtaagactattctcaagcactgcctccttgaggaaagcttggaaaaacacacacaaactggcaatgaatcattggtctggccagagacctctggcttctgctcaccaccaaattatcaaaactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatcatacacaattacacactcagaaatacacacacatcacacacaaatacatacacacaccacaaccacagaaaatgtacacatactatgcacacacaacatacacaaatagtcacatctacacactactcacacacaaatgcacactacacacataaaccacatacagaaatacacagcatacacagaaatacacacataccatacatactcacacatcacatatgtacatacacataccacacacagagaaatacacatacatcatacacacatcacataaagacacacaccacacatataccacccacacaatctcaaacaatacaagtctcactatttaaagaaattctttgaagaaactagcttgaaaattcaaaagaaagaggcaaaagcaagtggctgaatatgactgcaagtttttatcctgcaagtgatattgctagctggcattgtgatagacaggcaggcaggcagacagacagacagacagacaggagataggtaggtagataaatagacgggcaggagataggtaggtaggtagatagacaggcaggagacagacagacagataatcttccagcctgtactctgctctctttggagcattcagtaaggtttcaggacctattagctgcagttctatgcagacataagactacgaaaaggtgcctcatgttttctttcccagtagctaccagggttacaaggtttgtggactaagcctttctggtcctccccttctaaactgttctgattcccaggaaatgagccttggcctcccacctggtggcagtaaatgtaagtacagatgtgtgaattggttctttaacagtgctatgactctcttggggggatgggtgggacttctgtgaagcaggtcccgtttctttgtcttccatcagttgtgttgtgcctgaagaaagtttgtatttctatttaatggattttgagcagttataaaattataatcaccctgtatgagtgactgaggaaagtgtggggagaataacacatttgtgactttgatttgtgcaaagaagggtgtgtgtatccctgttaatgataacaatatagtaattaccactgcccaatgctataaaagtacagtttttgtgcaaatagctaatgttttggacacatggttttttataaagcatagactttctccaaattttatcatgtgactttatatacatatttatttgaataagcatttattatgaaaatagttttttattatttcctaaaagtaaaataataaactaagtttggcactgccaaaatagcaaacatttatcatatataatattgggtaaatcttaattggtcttttaattagctcacctatttgtttgagtttctcaaaagtagggactatctttctcaatgcctggtgcaatgcagtattccttggctttgttcaataaccacagagagattgctactgggaataaatgaaaatacattctcatcagtttcaaagtaagaattaaatgcttatttaaatagcctgatgtataccatgatatctgtaatatggacatacatacatatatggagtcgatttaataatactcagaattgccattgaaatataaagagaaatagtattagcaatttttaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggcagtgcctttacccacaatgacttccaagaagagggaaaaatctacgaaggccaaagagtattgtaagaaagttggcaaaatcatttctgctagtatgatactttacaatttctagaatggttttgtttgcagtaaggtcaataaggacaaagccaaagcctgatggctaataggatctattgattcctttctatgttgcggagtttctggaatactaatatattgctttgtgtaatacctaggaccgtcatttctctaagaacatctcctgagtgctgacgtatttccaaagcaatgattcttattcctcacctggtgctcccagaggggcccagtatagagcaggaccctgaggagaaaagagcaaaagcataaggccttgaaacgattgctcacagagagctttgtgggttgagaaggaaataaacataaaatcctgctaaggataggaacaaaatgatcaactcccccaaagaaaatagagatacaaccaatgtagttaataaaatttatccccaatctaaaacttatcaaaagaaagtctaaaaggaagtgtttcttagccactgtcaaggcccacaaaggaaccgtctctcaaagaaaaagttaagaaatgaaatgaaagagaaagaatcttaaacagtatttctactctttaaaaggtcatagcacgtattcattttgtacccactccatagcccctggctgttctctgacacaaattatggaggcgagaccaaatattccaaaggaaagctctagcaacctctggctgggttgctccccaacaagctcccctaaagcatttcttccagctgtaggagatgtccaagataaccgagtcctgagagacaaaaaggaggagactgatgatcacgaggaaggaggggggggagcttgaggcgtacaagacttcctttaggagggatacacgttttacacttaatgctgatggttggacaactttctgaacacattatcattcacaagactctgcacattaaaatgatgaaccccaagatatgtgagttccatctgtattttttttaaaaaaggaaaagtaaaatatcatcttttagcctcaagataatgaattgctatccctcacaaacacataaagaaattgcaaaactatttaagaagggattttttccaaagggaaattctctttaactgtacacacaaatctctttatttactcctattccaaatgtttaatattacatatatttcaaagtgcaaacactcttaaaacatgttatcaatggaatgtactgactcctcatatatacattttcttctctcattcccgaatctcattgtttagtcctgcctatatggcttgaaacttgttttgtataccaggctagccttaaatttatgtcaactttcttgcctttgtctccagcatgttggaattgcatatgtggacctaacaccatgtattttcactttatctgcttttagttattaaaataaaggttccctaatcttataaagatttaatttccagggaaaggaagagagaaatgaaagcgataacagctgctttcaggtgaccaaagaacaggtgcctagtctctctttttaaaaaatatttaattttttaaaatgtggtgtgtttggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaccagcatatgaaagaaaatatgaaaatataaagatctaaatttggtttacaccacttaatcacttccaaatctatccattttcttcaaatgttatttttctttagtgctgaatattcagaatcccattgtgtatacataccatatttttacatattttttcttcattagacgatggatatctaagatgattccatatctatactgttgtgactaaagcagcaataaaatataaatttaaaagtacctctgtagtatgatatagccttcttggtatacactcagaagtgctatagctaggttactttgcaatcctatttttatgaggcactcccacaattatttccaaagtaggtataatagtttatatactccaactaacaattaataagccttttctcacatccttatcatcctttgttgtcatttattttcttaaagattgcctttctgacttggatgagatggaatctcaacgcagtttgaatttgcatctccctgatgactaaagatgctgtccattttaaaaaagtattttcagttttcagtttttcttttgagaactgtctgttcagttcattagcccatttgttgatcaccaggggcctttttggcatttaattttttaagttcataaattctacatataaccccttggctgtaacatagctggaaaagagtttctattctttttgaagaggtctattgttaaaaaaaaaaaaacaaaaaactccaagcctaagaaagcacttcctcagcaccatgaaagtaagaagaatcttctcatagaagaaagaaatgagagagagagagagagagagagagagagagagagagagagagagagaatatcttttatcatgagatactgagagctttgctaaaatcaatggaccttatttttttccacactcatgaggaaacatatttttaaagaaaaagataaattttctcaactcaagacaaattggccataatctcaataacatcattgaactttctcgccctaaagagatttttttttcccccaaaccaagggaaaattgaaaggtctttgttcagggctgacatctgaaaatagaatgtactctttcacacacagcccctccacatacaagaaatagaaaagaaaatgtagtaaactttttttgaaccatgtcactgaacctcaaatttagcatcaaaggctgaggggcagtacattttaaatcccagcctggtatcccccacccctacatacagcatcatccaggcaagctgaatgaggaaagcagatcccatctaaaccaaacaactattaataaagtaaaccactgaaaaaaaaacccatataatttctttcctaatcaacccaaaattacttggttaatggctgcatcatttcatctaatagcacagagaatcaagagttcaaatagaatttaaggtaatgattcttactagcaactcccagtaggacacatacccctaccaagcagcagtgaccattagccaggctcctcctggggaccaacgtgacacacctcaatctttggcattatcttctttctcataatgtgctggtttggatgtcttttcttgtaggacttgattttcatgaattaaaaaaaatgttatttataagatgaaaaaaattaagttcatctttcttaaaaataataaattgggtatttgctttgtgtgctatatgtgcaaagcattgtgctaaaagctgaagatttctttccagtagaaaagaccacaaggatgagatttacatttagcgaaagtggtaaaggatagacacagataacatctgcctttacggtgtaaagcaatttacactgtgaataagcaattgtctccacatacctcatctcaaaaaaacagaatgtgagaaacaagaaaccttgtagaattgaatgaaattcttctagcactccatcagtgagaaataattacatcttgaggcatttttctgtatttcccccactgaattattcctgtaatctatacagcaaggcgtcaatgaatgtaggatttctttaaaattacagctgtgttcattgctcctcattgtttttaggaggcacattaattttagcttaaagtttagctaattgacctgtttgatatgactgatatgtatgtgactgaaacgcaactgtgggtaagtatttgctgtttaaagtaatatgagtatatgaccagcgaaggacaattgttacaattgcttctgtatcaaatggcgggttcatttcatagttacttattacactttgggatccagagttcacctgtttgtctccattttaatttttttccttgaagaaaacaagctgaaccagccccactctcttcctactgtaagttcacaaaaaaaccaaactaaaccaaaccaaaccaaaaaaaccctctaacatttctgcaactctgttgatccacttatcactctcagcaaactaagaatgagactgtaaggaagctggtaaatgagatgcctagatgccaaaacaaaaccttggggagtgattatttattttaccacatgatttgctgaagtgtttactgtgttaatagctaattctctcagcataccttttcacaaataaaaagtgaatcaatataatacaggaaggtatactaatttcagaaaatatgactgatggctttgtctgtgatgcaaactgtttcatgtacaattaggcaccactaactgggaaagaaagtataccctgcaggtgatgatattatccacaattgtaaacaaatagtagatccaattcatccagcatgtaaccgacaattcagaattaataaactaagatccaaccaaggttgagttagaaacttaaaaggcagctgtaatgcattattaagatgagactattcttcagctttgtctgtagcacctagtaatgcccatctgccaaagcattataacatttacatttcagcctgtgctttaatgagcctataaaagagattattggctcctaaggacaaggatttttacctcattttcccccaagaacaggaccagggacagaaagtcctaatcaatacctagagctttacagaatacctctgagatgagacaatgggcctggaggctgaatgcaccagcatttaagagtactgctgtcagactcaactgactgcatttccaacattgagttgggcatggtgatagacacctgtaatcccggctcttgggaggcaaagccaacaggattgatgcaagtttgaggccagtctgggccaaataggaagtttcaggccagccaggattacccagtgagaccctgatagtaacaatagcaacaaattggaagcttgggttcttatttaccttttcctgcagataatatctctgcctcttctcttctgggattttgaagcttgagacaggaaataaaaaccacctggggagctaaacttgaacagtaagacctgaaacctgaggagagattcctttaaccctatctatgttctgtcagtcttcaatagcctgaagttggagaagtcttcactctctaaaccctgactctaaccattgactatgagtaccattttagaaggaactttagtgttaacattccactggcaagcatcatttacatctatgatctacatttaacatattgttgcatcatttattgacatcactaaatatattccttgtagtatagagaatgatttgatattaaaacatctaagctaagcataagcagggaagagattcctttttgttgttgggttttggacatgggatgtcactctgtgctttggatagattttaatctcagggtgatggtgatcttcctgcctctgcttctcaagttctagaattacaaatatgacccacgaagactagccaagacagatattttaatttcaaaaaaaaattatcaagttgcacccttctcagaaacttcaattagtacttactatgacagacaatttccctcctatttgattattgtccttccttttgtccttgtcttccttttagcagaaaacaagttattctgcctgaccactagaactaacaaaaacggcaatcttgagctatatggtcccctttgttttaatatgcttaactggtgataagatctccaggacctttttgggggtggtggtgacagggttcactttagtcttacatggaataaaagcacatcagttaatgagatttttatcagctctcaccagtgagccctttttgtagagctcccaaaatggcttcactttcccttcccaacagcactcaacttttcaagaatgtcttgaattttcttctagtcctaattgtaccactctttttgagcctgtgggggccattttcatcccaatcaccacaggccactccctggactccataagctcattgccatattataatacaaaatgcattcaagtcttagtgctcttattagtatggcccaagtcctgcttaaagcatacaactgctttcctaatccaaaatctcaaagtccacattcttccaaaaaacaaagtcaggcatatcacagcaatataccaacttctgtcttagccaatgttttgtttctgtgaagacaccatgaccaaggcaactcttgtaaaggaaaacatttcattgggactgacttatgttcagaggtttagtccattatcatcatgtcaggaagcatggtagcatgcaggcagacatgctgctggagaggtaactaaagttctacgtcatgatccataggcaacaggaagagagaggtggtgccgggcctaagtttctgaaacctcaatgcccatctcctatgacacacttcctccaacaaggccacacttcctaatagtgccactctctatgtgcctatgagggccacttttgattcaaaccagcacacaggggtcttatatccagtgtagactactttagctattgtagaataatatatgatggaggattattacatggctatttaagaacacttaataacgccttaaaattttgactgtatttttatataaatgcagtattactgtttccatctaaataaaagaacaaaggcttctagtttccaaagtttcactgtctagttttaaagaatgaactgagttcaggtgtgaaggattttctgataacaaattcactttaggtttaggaagataaaatgatgaatttgtttgagttatgaggacaatatatatagctccccctccctgacatagagagaaatattggtactaaattaaactgtgaccatcaaaagtatctgtagtagtgacgttgtacttgatttaaaagcaaggtcatgatgacagaaaaacgagaccctgtgctattaaaaggccactttgatagacttataggctatatgctgaaatattatagaacataaatttgatgaggcaagccctactgaaatcaaaaaggtagctaacaagcatatatcttattagctggccatcacagggctattgattagtgtaacactgttgaagaggaaagtgaagccacaggaaatgtctctgtatgtctttaacctcttaaaattagaactgctaggttttgtttgcatactgtttcagactatctttgaaccacattccaacttttgtaagtctgtattctctatgatatctttcacattaaaattttaatacttactttactcttatttgaatgtgtgtgtgcctgattatgtgcacacacacatatacacacagacacagacacagagacagacacacacacacacacacacacacacacacacacacacacacacacatggctgcatgactacaggtgtccatggaagctgtcagatggcttagagctggagttacaggtggttgtgagctgctttgacactgatgctgggaacagaactctggtcctctagaagagcaccatgtactcttaatctctgagcccactccccagtcctcacatcacaatgtttcacatactgagaaaagaaaccatgtttagtttccagtaaaacctcctatcttcagtataacagacccataaaatatgttagactgatttgggggataatttttttcatggttttagagctttattgtagaaaggcgagagaaagagagaaggtagaaagagggagagaggccagccatggccacgtggagagaggggggaagggagagagagaaggagggctagagatgagagtaagaaaagtgagagcttaaagagttggggatcatttaaatcagttttaaaaatcattttagtaataaaatcatattttaaatgaaatcatagaggaaagttgatattaggataaaacaaataatgatttcccatatatacttctcttatatacttctcttatatactaaaatgagcttataactgaattgccttctcagttatttattttaggttgctataaccatgaatttccacacgtaatttattactggatctttagcaaagaaagagaaaaaaatgggaaaaaagaagcaggttggtgtttaccatttggcttactgtattctgatagataacactctcatagcaatatcaccatttttgagaggctctctctccctgtaaagttggttttcatagtactgcttttcttataagaatattattactggaagttgtgttcctgagcaaagacatgacaccaggtaaaccattgatatactacaaataagttgtaaaagccagaataaagctgtaagcctctgtaaacagttaaggcagaaaacttgttccaagtcctataaaatgggcgtaagtgtagaatacacattgattttataagaggccccagtggactataaactgtacatgaagcatataaaagagccaattgtacataaattggatgtactgtttattattgattcagaatttacactctgcctacacccagaaagaatatgaaatagcttacaaaatcaagtacaataaaagagggcaattcaacacaaataaaagcagggcaaactaactcaaagctattttgtaagagacctaaactcatacgttctaggtataacatcaatcgcagattcaattaagacagcttttgttctgctctttccattggtttgggaactttggaggatgatttgaaagagttcagcctctttgagttggtatttgagggaattaaaccaatgcttcgtttttgtgcaatgtgtcttcctatagccaactgtagcaaccataagatgaaacactgaaagactgctggcaagactgtggtacttagttgtcttagatggctgtggtctgcgttcttccaatattctagcttagcctactgggtagcacatgagtaccttgtagccagagattcgagagtttggactctgtaagagtaaggccttggcagctcatccagtgcttgtccttctccaaatggcagcagagctaccttagaacacagtatcgggggtgtcagaaaagcagattttcatcgtttatcaagtgtcatatgctaattgtacatatttatgggatggttggatttccaatagctatatagcatatataacaatcagatcacagaaactggcctatctatcacctcaggtattttactagagaaattagactcgaaacacacacataaaaatagtaacatgcaaatgaagatttattgtgctatcatttatatatgtaggatcatagttgctagtggccacttttgatgtttagatgtgcagataagttttaataaatctgaccctgaaaaatagaattagtagtttacatgtcttaccaataggtgataggtgggtagagaggactgtctttgaaatttttttattctcctaatttattatgcaaaaggaggaatttcattaaaatatttttatgcatatatcactgaatcttgctcttattttcccctctcaccatcaactcctccttttgcctttatgtcatatgattcatatgtgcatagatctctagattctgcatagaacaaaaataatatgatctattgcctcccctgcccacattatattctcttgatattacctccccccacccccatgtctctccctttatgagtctttctcccctttcctagtccgcaaggctactgtatctctcagagggctataggtttttcttttttttttctttttttttttactggatattttttcccatttttattaggtatttagctcatttacatttccaatgctatacaaaaagtccccaaccgccccccccactcccctacccacccactccccctttttggccctggcattcccctgtactggggcatataaagtttgcaagtccaatgggcctctctttgcagtgatggcaacttccttagaggtacgttatatacctggagcagccctgtattcactatgctgtcttgaattactagcttttaattttaaatatatttagttttgtaaataccccccaaacacccaaaatataaatttactaaaatactcaaggatagccaaactaaagagagttttccttttttgaattttttttttttactgtactgggatagaccctaagatatacaaggcaagtaatttaccactgagcctagtcacaaaatataatatattgtatttatttttatataaatatatttaatgtttatattcataatataatgttacaaggagtaacattaagttaatagctatttatcatttggtaatttggaaatcttgattaatcttaatatttaatcagaatttaatttagttatgatttttttgccttaactgaaaagctcttgactcattaccatagtgtaaattttttcttatagcctgtacttgaatttggatgtaggtgtccaggattgttgttgttgttgttttccatgaagattaatagcagctaagatttaatgttcccttggtagttcaaattgtattgaaatcgctttacactgataaaagaaaagccttcattagttacaccaatgcctgtgttcagattagcagcctgagcttgaaaatggcttagtcaaggaaaagaatatcaagaatagaacccctaacagccatgtcatggccaatcaggacaaaacatttcaatgaggtgggcaactcctaccatttctccaatagatatatacattatcacattataattttgtgtctgctatatgttgtatcaaggtgtcatgtctaaggtgatatcttttgtgtcataggtatcatatctatgttgtcatcttaacagttgtctgttaggtggcagtccagtactctaacaaagtcaatatattatgacagcttctgacaagtgcaaacaaagtatctttaggaaagggtacattttcctaatgttacaacattatgttatgaaatcatcatatgctaactcttgacacagtacagtatgtgcagagagtagttagcaaagatgctggcaagatttagtctgtgtttggtttcatgtggatgactgggaaggaaggacagtgaaagatgattcttgctcggagttgtaaagttttagagaacacaagaacaggacttaaaaaaagatggagagttaggttaggtcttgagtctgagatattggtgaagctggagctcaaaatggtcattagagaaaaactagaactaaaggactcaagagctaaaggactcacatgtgtatacttttccatgaaagaggatcaaggtagaaaaggtcagcataccactcccacccctgtcaaaaaaatgaagccaaacccgtagagagaggtgtatgtggacaaatgtctcgagaagtgggtagggaaaatacttgaattagagtttgcagtattaaatggtaaaaggaagggaagaagatgcaaattttaaaaagatattttattcttaaaaacgattattgtgttattattggataaaatgcaagtgagcttctttctgggctttcattacccaagttttcattcaaacgtacagaaaactactgtatgttgagggaagaaagcacaataatgatcaggctaccaagagtaggaacatgaaaatcctttacttctgttaaaatagtgagaatatatatctatcaaatattcaatatagatatttatcaaagattcaattttagatttgaatacatagaagtcgcctaataactgttgaatgagaacaatatttttgtcttttaagtatcagttgtataaatagcaccttaaaataagtggcttcagatggtggaggaaacaaagaaaaaaccagatcgagtactcaggaaataaactaacaaaaaaggttagttaaataaactgtctaaaggtttgaaaccaactatttgctagttagggaaagaacaataaactatgtaaagtctgcatgctcatttggaagataaaaaggtacaccgagatacataaataacaactcaggccagtgactctgttggacatgtgtagtacagataatgggatttcatcacatggtgctggaaaagttggatttccacatgcagacgaattaaacctagatagctgtctttcacccagcagaaacatgaacactaaatgtttcaaagacccaaacatgaaactttgagactcccaggggaaaaagtacggaaaaacacttcaagagatatctcacattctcaacatccaccttagatggttcccaactgcctgtacttccaaaaccaggagatctgatcccttcctctgctctccacaggcacttgcaacctgtggcacacacatgcaaacacacatgcacacacacacacacacacacacacacacacacacacacacacacacctttttaaaaagggactagcaaaacatcgaatacttagataattctttctggtagagataagctctgttgagtttacatctgcagagtagtgacagcataggcgcgtgcttggaaattagtgagaaagctattggctgctatcagatagcttagaggaaaagcagaggaatgtggtcttactctctacttgtttattaactaaggtccttggtgaggagagcaacagcataaaagtacctgattaaaaggacatatagtgaaaagaacccattgaaggggaataatacaggaaacagaacattagttaagttgttgcaaaaaaaaaatccaggtgagaggtggtggtgacctgtttattgaaaagaaaaagaaagaaagaaagaaagaaagaaagaaagaaagaaagaaagaaagaaagaaagaaagaaagagaaagagagaggaaggaaggaaggaaggaaggaaggaaggaaggaaggaaggaagggagaaggaaggaaggaaaggagtgagggaggaaggaaagaagggaggaaggaaagagaaagaaagagagagagagaaagaaagagagagggggagggagggagggagagagagagagagagagagagagagagagagagagagagagagagagagagagagagagaaagaaagaaagaaagaaagaaagaaagaaagaaagaaagaaagaaagaaagaaagaaagaaagaaaaaaagaaagaaagggaaggaagaaagaaatcatttaagccattttgggggcactcccataaatcccaggaggctgtggcaaaagaatcatcacaagtttcagatgagcctgagctatataatgagatcttgtctaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggttgccctggatgtccaaacacctctcaacctgtcccctctctccctgtggcagccactagtctcctcttggttcctctgaaggtttcatctcccgtaaggagactcatactgtatggccctttcttgagttgacttctttttcctctgttccatgctatggatcccatagttcgttcagacatcagtcatggatggatcactagattgattccaatctgggggctttaataaaccaaactcatataaacattcctgtaaagagttttgagttcttcgtctaaactaaattccaggaggtcaaggacaaggttgcatgatggttggacacttagcgtttttaataagccagttaacattatatggcttcatgagtgacccacatctgttgttgccactgctgtatatttgatccagttttggtaaggatgcagtgctgtgtcacgtggatctcattttcattttaggggtgagtaatgacactgaaccccatctcctgtgtgtctctttgtgactttgcccaagttttaattgatttgtgttttttaagctttgggtttggagagcattgtcccttatgagatggatggctttcaataacttctcctaaaggaccactagagaagcagagaaggagccaggagagaaatgggaggacagtggaaagagtcacatgatcaaagtatgatgtgtttgtgcgtggaaaacaaacattacagccagacccataaatctatccaactcaaaagtgttcatgattacaacttttaaaagaattttccaccactggatggcttgtgcatagtatgcaggtccactccaatcaggtggtacacaggaatgcagttttattgagtttgacttattattctacttccaccggtcttcagagccacccctcgcctcatgtataatcccagataccttcttcagagttcttccttgtaaatatttttcttcactatttcccactggtttacatttaagcccaggatctgtttttatataaatagttaaacttgggtcaaaattcaccctgtcagtgtttgtgaacatacccagattattgtccaaaagatggcccctcctctgtcatactgctcttgcagctagagtaggcatctcctggggctcctcattccgttttactcatccctacctcttgattgttagcctgacagaatgtgtcttgctggctgtacctgtatgagtctttgagaagactaaaacactattcttttcaaaaaatcattttagatgttcttgctcctgtatctgccatagaaatgtagaaatagttttatttacacttataaaagtctttatagtcagccagacatggtggcatgtacctctaatcctagctcttgggaggcagaggcaggtggatctctgtgagttcaaggccagtctaggctatatagggatttccaggacacccagagcttcataatagagacatattgtcagaagaaagagagaaagaaagaaagaaagaaagaaagaaagaaagaaagaaagaaagaaagaaagaaagaaagaaagagagagaaagagagaggaaggaaggaaggaaggaaggaaggaaggaaggaaggaaggaaggaagggagaaggaaggaaggaaaggagtgagggaggaaggaaagaagggaggaaggaaagagaaagaaagagagagagagaaagaaagagagagggggagggagagagagagagagagagagagagagagagagagagagagagagagagagagagagagagagagagagaaagaaagaaagaaagaaagaaagaaagaaagaaagaaagaaagaaagaaagaaagaaagaaagaaaaaaagaaagaaagggaaggaagaaagaaatcatttaagccattttgggggcactcccataaatcccaggaggctgtggcaaaagaatcatcacaagtttcagatgagcctgagctatataatgagatcttgtctaaataaatacataaataatgtatcgaacacctattctgtgtgagacagtatgcaaagaaataaaatttacccacaggcagtcatagtctaagaaaagaactaagagaaggtatataaactactataatcttaagaagaaattgaaagtggctacaagagaaactctgaaattcagagaaggtagcaatcaattgaagtctagcataggatgggatagacttggattaagagataagtaaaagaacatttccaattttcttactttggagaaaggctaaccagaatgatgaaagcgaaatagtagacaagaaaacattgtggggacaaaacgtctttcagaggacacccgtttgcctcctagcacccacacagtggctaacaagcacctgtaactacagggacagaagatgcagtaccctctgtgacctccttagatgttgcacacacataacacgcagacatacatgtaggaaaataaccacacacagaaaataaaaataaatacactttgtttattagcataatagtcaagtagtattgtctcgaaattgagatttcagagaccaattctttttttctctttttaaaaaattttattagatatttactttatttacatttcaagtgttatcccctttcctcatttcccctctgaaaaacctcctccccaccctccccctgctccccaacccacccactcccattcatggtcctggcattcccctatactggggcatagagccttcacaggaccaagggcctctcctcccattgatgtccgacaaccactgtgcttttgtgctttgagacaaacttaactctctcatttcatatttgtaaacaagcatatttctaattatagatacccaggaagcattttaaacgtctatcttcaagggctttttgagtcctttcaaatcctagagagcactttatgtaccttcaaactgactatgacatcaataccaagtggaatttgttcattaaaaacaagtcgagaggactaagatgtagcttagtgataaagccttagagttgaaccacagcatggtaagaaaaaacaaacaaacgaataaacaagtatatgaagacatggttagagcaaatagttctactctttaatcagctaagggctgtgttttactacatctctggcacattgtggtactaccacagcagcctggatcatctcataggatattgactgtgccatgggatagctctaagattgctaccatcattcactgtgaggaaaatttctgaggtagtgaagaaggcttcctcggtggcagtttcctctttaaagtagggactgtgggagagaaaatgtcataggcatatttctttgtccaacattttaatgtgattgtgtagaaaacgaacgtattaagatctcctctgctccatcagtaagtataaaggtgtgaagtgtgaggttaaggtacaagggttgcagcatagttaatgggcactatagagtaagacacatgtgagttgagatcccagcctagtcatctcttaggcggcccaaggcaaaaacaaaaacaaaaacaaaaacaaagcaacaatatatatatatatatattttacccatagagatgaataatttctgccttgtaaggttagcctaaggaccaaatatgttcaattacttaggccactgctttgtacctagtcagttttcaaaaacaaagtagctgctatggtgtttaaggcatttaaattttgtttgaaacaaatgctatatctgcccactacctctgtttcccttccttcgtaaagaggtgtgacccctgtgcaaaataaagaaaaggcaagaacaacaagggcatcgttgcttcttttttttattattacgtattttcttcatttacatttccaatgctataccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatatgcagtctagacacacgaactctggggggtactgggtagttcatattgttgttccacctatagggttgcaaatccctttagctccttgggtattttctctagctcctccattgggggccctgtgatccatccaatagctgactgtgagcatccacatctgtgtttgccaggcccctggcatagtctcacaagagacagctatatctgggtcctttcagcaaaatcttgctagtgtatgcaatggtgtcagcgtttggaggctgactatgggatggatccccacttcttggcagtgtagagtcacatagcctatatagcatttcctttttttttttttaatgatgcgttccagtactggtgattgaacggaaactcttgagtattctaggcagatactataccactgagatgtatagatagtatcatttcaagccctttcttttggttttcttctggctaaagagaagtgtcaagaaaaagattcgtctttcaacgcaacaaagattttaagaacctaacatatgtcttgtgacaaatctaatgatgaacttctttaatcatggaatgaagagtgttggaactctactattaacttgaaagcagccttggaagagactgctgcaggaacctaagtgctgagtagggttattttctcttggagaatacttagatggagttatcagcagataacagaagtactaatgcagcatccatatagagcttccctgttatatggatgaaggaatggcattacgttgcaaggtttttgtcattctttcactgtaacaacaagaacaacaaaagttgtcctgggtttttctgaatctactaccaaataatactgacaaatatgtttttctacgattgccttgtaatttgaccttacaatatagcaaacgtggtagatccaatatctgataaatgctttgatatccaagggaagaagtgggggaggagacaagctgttatgtttatgtagtgataataatacttgctaccagaaagttatctatgttcctcagactcctttccctagatgatgctcctgggactaattctccattggtaaaggaagtaaagaaagatggagtccatggaatgtttgtgatgccatataggaagctcatggcagagcatgtctccaatctttggaaattattagactcagtagcttaaaattagcatgtgagtagctgaggatgtagcttagttagtagagtgcttgctgagcacatgaaatccagagtatgagtcacaccactgcagaataataggtgtggtgctgtgcacctgtaatcccagcagcactctggaagtagaggcaggaggattcaaactcagcttcaactatttaccatgatcaaggctagcctgggctacatgagacactgtctcaacacaaacccattaagtgacatttgaattcaagaattttaaaattagatttattttaaaatgttcatatatttgtattatagttacatactttatattctcctcatctccctctaatccctcccatgcttcaaattcatggtccccttttaaaaattattatttttgcatatacacacatttataaatgaattaataaatatgtaactaaccttctgagttcagttagtgttgacaatatacacgtgtgtgcatgtggatagtctgtggttctttggatgggaggaattatcaccccaaatgacagaatttctatctgttatctagaatagatacaatagatgtaatagatataatacgtaatataatttcaggtaaatataaaataatgtgactgtggcttttcaaacatccttaatgttatttatcctcctaatgttgttcctctttgtccctctgtattttcctccacaattcagtaaaagcccctgccctattttccttctttcctcccacacatcatccagggatattatggtacacaatgctgcttttcaatggctctattttctgagctcaggagtgatatgaatggttataaatggctgtatagaaacagaactgtacgttaggagagtgtgacatgaacccagcttatgtgttaccgtacaaacaggatcaaattcctgccacagatgacaaacaatgggaagctgccacttacagcccaccagtaggacaagggcagcaaaagggacagcaatagtcaagttctcaccgccactctacccacctgaattagtgccatatggctacaaaacaatgactacaacccaaacagctgctccatgacgagatgagaagcttagaggatgaacacaggcttctaggacacagcatggctttactgtccacttataacaagtgaaagtatatgtgtcggctattctagtcatgagttttcagaagcaggatgctattttgcatacttagccacatccaaatctttgttcaaaaaaaaaaaaggaaagaaaaagaaaataggtgttatgagcaatggactagagaggcttttgaggattggatttggtacttagctcatcaggaacatagtctaacatgaaaaattataagtctttcaggagcctatcacaaaaggctagtgaagatattttctatgatctaagagagaaaaactataaggctcagatctgggtctaagttagtcctacagggggaaccttgatttttcagggattttttttgccttttttctcggtgaccattgcattctttctcagaagcagcatagtttctgctctctgggcataaaatggaaaaagaaacaaatgatcaaagtacctagtcttagctctcatcagggtctgctcgttccattactactgcactctgcttcagcaatttcggtggttttcaccacggcggccattccttctactgtttggatattgctgaggagtttgagtatttggtcaccttggagagggcccttccgagtttttagttctggagggggaaaagtagaagatgtggtgaaggacagtagccttcaaactgctggtagctctaaggctttcacttcctctatctcctctctggccattctctgggctacgtcctaaggggtatgtggctcttttttttgttttaatgaagcaatgttgtaattctcattctgaaactcggacttcctgcccagcaccttcagtgtactggtgacctctatagagggcaatggacacttcttgacacattaagctgatgtgggttactcttaggacagataacagtgatcttggcctttctctcctctgttctaagataaaagagctgaagacacactatgtgtatagatgccacatagttcactagcataccctaactttttttccttttttttttatttttttattttttagcagagtgaatacaggggctgtgttccaaccttcccttcaacaggtctctgcagttcccccagggcagctaagacaattattcctagggaatcctgcagggggagttccgggtcagggagtaggagcctttagcttcaccaactttggtagcccttggactgtgactcacacaatgcacctgatcttctaagttactactgtaaagagaagttaggaattcatcatgagttccttagacttaagaagattttacagaccccccaaatagacaaagtgaatctatttggaaggtgactcactgtttctatgcacattcacatagatttactccttctagcgtggtactcttcctaccaacatgacttagtgtttctgtgtaggagtttaacattgcattctttttttaagtcgaatcctgtgaggaacattctcaggagaattagtacagcaatttgtttgtaaagtacatcccacctccacatgtctctaagctggtttgctggttacccgaaaagtggagagggcaattcacatcgaaacactttaggggtgctcccagaaaattaaatagcccgatttaagatcagctatttagaatttagaaaaaagtattggggccatcgatttacagaatggtgatgaggtgaaaggagacaaggggaatttagtaaaatatttggaagactcactttcttaaaaaggatatcataatccttgttacatgcctaatttatctttcaatgttgaagaacaacacacaaacagcccttggatttgagctatcctgactacagacatgatttattttggatttaacaaagggtcaaagctctatcttgatcacactaataagcttcttataatgtttacctggaaatggaccaagtagacatagtcttttgagtacttaagttatttttagatcattattatgccacttctttggaggaggagggaagcatcatttaagcccagaagtttttcaaaattaattatagaaaatctatacctctatcccatcattcttgagagaatttcccactgtatatccaagcaagtcatttgaactctctgtctcaaatgcaaaagattattgtgaaaataccaggaattagcagttaagtattagtacagagcaaggtacaacatcagaaagccagcggtgctgtagcccaggttgaccctcaagagttggctgatataactggttaatgtgtggtaaaacagactggaatctggttttctgtatataaaagcagttagaatcagtcttcttatgtgagttccaggtagacttgaaatgtttgtgactttatcagagtagatatgttaaacatgtgcttctcaactgctgtaaagaaatcctggttttcctagaaaagagattttctatttttgaagatttctgttgtgtaaccacattccacttcaaagtgggaataccaaagacttatataaccttatagtcatgttttcttgtttagtctgcatacaaggcaggataatttgaagatttatagctgtctgagctatttggcttctcctcacaccaggcacgataaataaacaacttaattatatattttcatgaattccacaataatgtataggatttaataattatgcataagtttattagagcagcaagctctagtgcttctaattaggccagctagtttatgtacacacttgtacatacatgctcaggaacataagttttacatgcatacacacatacagagataaacacagagatacatgcgcatatgaactcacataaaagcttcaaaagatgtcaacaaaagaaataacaccatgaggaatattttttcaaaagcatcatataaacaccatacaacattatgctatgaaaaagcataatccataaaaataaaaattaataaaatagacttcttcaaagtataaggcatttttctttcctgtgaaaggcagtttaaaaatgaaaacataaattacaaattagaagaaaaatatcttcaaattgcatatacaaccaaggacttggatctagagtctataaagaacactaaaatctcaacaacaaaaaaacaatttttccctacctcacccggggatccatcccataatcagccaccaaatccagacactattgcatactctgaacaacgtagcaactttaatacaccccaagtgttcaaagccagttttgagaagctatatactgaatggtccatttctgttacaataggaaattaagttctagagatgttggtagctatgggttagggaaggagggaaggggccagaaagagtaagcatggttataagcagacagcttgagggagtcttgtagtgataagttttagtattttgatgtggtaacagtcacccaaaactacacacaaggttaaattctataaacatgcacacaaacacacacacacacacacataccccacatatgtgtatattcataacactacatggactcagaaggttgtacttacatatttattaattcatttatcaaggtgggtatgtgcaaaaataataatttttaaaagggggccatgaatttgaggtaggggttagaaggaggcgggggagtatgcacacactaatgttcatgtaactggtgaaatctaaataagttagtggactctaaggactctatcaatgtcaaactcctatttttgatattacattgtaattatacaaagtatattgagggacaaattgaaggatgagtgttctaaggaccttttaaacactttaaatgtttttaaccccaacagtaacgtttctggactctgtgtgctttgcttttcattcaggaaacaacttatttgctttgtatataaaaatgaattcccatgttactcatttttgtgtaattttgtgcataagcagtatttatatagtaatatataaatgaaaattaggagagttcatgacataattttcacatgcaggggtatcaaagagataatataggctactagatttggtttggagttccttgtgtgtgtgtgtgtaatcattggtatgctgtgggaaatagaccctaaagtgacttccagtgatcctaacctctccatgtttatgcctttgtatatcctttccccttcagagtaatctgagactatgtctgtattttctattcaacaaatcataaactatcactccattgataatgttgctagtaagtaatctagagagactctacccagttaattagccttgtataaataaacacccatgaaagaagtcaagttggggaagccatgtagcaaggaactatgggtaggttgtacaatgcaagcagggcttccagcatgtaattgaatccttggtgcagaagccataagaaactgaattctcctatctacttgagaaggcttggatgtaaatagtgtcacagcctcatcaccaaggagacctcagtcatgttgggcatttgattgacagtctgatgagaccctgaagcagatgactcactcgggctggacttgtaatctacagaaactgggacatcagaaataagagttacttctacgtttggagtaacatgttattgagaacctatacatcagtcctctgtagagtggagtcctccctagaatggaggccacaatcagtacagacctactaggactcctttaatcattttgagaaagaggacaggtcaaaaagagcacctcaacactttttggtaatcacatctgtactggctggttttgtgtgtcaacttgacacaggctggagttatcacagagaaaggagtttcagttggggaagtgcctccatgagatccagctgtggggcattttctcaattagtgatcaagggggaagggccccttgtgggtggtgccatccctgggtgggtagtcttggattctataagagagcaggctgagcaagccaggggaagcaagccagcaaggaacatccctccatggcctctgcatcagctcctgctttctgacctgcttgagttccagtcctgacttccttggtgatgaacagcaatgtggaaagtgtaagctgaataaaccctttcctccccaacttgtttcttggtcatgatgtttgtgcaggaatagaaaccctgactaagacagcatcctaacaaaaatgtcttttcttttttccatggatgtttaaattgagaccacagttaaattgtaatggaaaagaaataggatgttcaggatgttgtgcttatcgggtctcagtagtaatatgactagtgatgatacatctatacttaacttgtaaactgcctttcaatgaaatctggttgtgtgaccttgagtgactttgtaatcaactaggaaaacagcatacaacctcatatgtaagtaccccaacttaagcagagcggctgttggaagttgacaaatatccacctcacacattaactcttaggtgctctaagttgtttatttatgaaaaaaattgtcttgtggcagtaaaaataatgaagtgttttgtttaaaaagagattcaaaaaagcctctctgggagttccagtaagataggaatatattactgtaccattgatcaatgctatacccatagatcagtgccaaatttccataaccttatgcatagttccttgcaaggagatgtcagttttgtccttagaagaaggccattggggctgtagacagacagaatttccttataaccattctttctgcaataagcagagaaagttcatgagcacggactacatccgccttctctgtgctaattctctatattacaatcattgctttttgcacaactctagaattaattcacagttccttcatctgcagcaatgataaaatgatgacaactttaaaagaagaaaggaatagggttagagagtccgctcaacagtagagaacttgcctcccattctatgccccagtataggggaatgccagggccaggttggggagcagggggagggcagagagtataggggattttcggagaggagacaaggaaaggggatagcatttaaaatgtaaatgaagaaaatatctaataaaaagctccctccaaaaaaaaaagaagtgaaagaaagcccatttgtaaggaataccttaagcatgttcttgtcccatattgctgtgagcaggcagatggaattttgaatgtatagctcactccagttctcttaagactttcaaatctatacaaataaaataagagcatgcacttgccaattctcaatgtatatttagatttccctgtagcacttgactgataaagaagaataagaagagagtttgcagcctaggtacaagctcagtggtagaacgcctgctgatcatgcacaaggcccttggttcaactgcaaagaaaacaaaacaagattcctggcaagtggtttagtacaaatatatgacagaagctgttatgtagttgcaggcttctagggttggtccagccacattacagttaaaaccttcctcttcaaaacgttttctgtgtgataagatagtccttgtgacgtctgcccttactgcatttaactagttttaacttctcaaggttagactttaagtcatctcctcccatataattggccaggaatcaaaatatagcaagcgtacaagttctgctaggtaaattggtggcgcctcagccagggcaggttgtcctagttcccgagtctatgtttcccctagcttatggctaaagggatacaatagaggaggatgttttcaaatcaatcagcctttcaggtctgtgacaattttctttttctttctttgtacaaacatcagagagcattatatttgaaatgttatgttctaactttaaaaagacacaaaccctcatgctcattaactgttctaatgcagctttttcaagcctaacattcctttcaagttcacctttgttatttctacctaaatagatgttctctggatgcttgaggttctcctcatgcctcttggtagataatagtcttgatgaagacaacaagcacaatgtgcttctgtttccagtgatctttgttcttttgcttaagaaaagtaaagaatcacaaaaaaatgccaaagcgctgcaatctctggtttactatagagccgctggtcctgtactgatcagatataagttatactcccaaattaggaacaaacgctgatagtgcatggagccacaatacactcatgttctaattccagctccaaaagtcttactgtcacaatcccagaaagaacaaagaagcacatagtacatttctactccttcactctgcaatttcatgttgtatcctcatccttattagcactgggagttattagattgtttttaacagccaagagtggtgaggcttataagctagatgacgttctcaaggacacacacctaatactttaacagaagcagagtttcaaatccagacttatctgagttcaaaactctccatttctcttttagtattcctaaatttgttttgcctaaatataagtgcctggatatataaaaatactcatgtgtctcctgcaactgcaatggcttttaagagtcagttgataagaactagattcctagacgcttgaatacttttttcattgtcctccctggatgtgatttttcccccactcaatttgactttacacacattcatcacgtgtctcctctgggtaagttgtggtgctgtgggtattattcctgtcagacataactcagctataccctacagtataatttgccaagagaattgcatgctgattttgtcttctggacctgctacattttgacataatttgtgtcctgggacgagggactatccacaaagtcttaaatttggtaggaaggcattttctgtagtatttgttttctgttacattttggcttcccttgataaatcaaatgccaaatttccttgcaagaagacggcagcttggggaagtgctgaaatttgtttagattgtgctttactcttgagcatcaaactccatgacaaatgagctcctcacactaatctcttagagctccttaaactagccactctctcacccacaaccattcttcagttttcatcagagaggcatttggtatggcatgcagtgcatagacattcttgtaggctttggactcaggcaggcctgagttcaaactcatcactctttagaatggtgtatgatattagagaggtgaagtcatcactctgtgagcttccatgacttgcctgtaatctaagggggatgatagtacctcccagagctgctgttttagcactaatgaatacaaagtacctagcaggatatttccgaaaagttgtagatgtcagatgttcatttggtgagaacgttactcttacatgaataaagagataaacgggacaataaaagcacagtggagtctctatttctccatgcttcaggttttttctgtgtattgtcattagtgagtttgttccaaactggcctctcctttgctgcttctcttcttaagcctcatttgtaaatcctgttcccaattaaagaagtccttctccctctcctaggacaaaattgccaactgtttattttgtgtgtgagcaagattcaagacccattgttttcagattgcagctgataacagttcttttcccatttagtgcctgctgctttggctctagttactcaaagcagggagccgcccacattgattagggtataatctaagtgccgaacaaagggtggtatagggattgttcctggaccaataggaatcctctgcaacgttgatggaggagagaaataaacagctattgttttctgcaagtctatgtttgctgtcatccccaggtaaacctcccatgtaacagaaatgtcctagttttgtttcttatcttgggttcttcctcctattccagaactagtagtctagttctactgatgtacctcttcccccttcctctttcctaccttagcttttctatttttctgatcaccccgacccccccccccctttttggataagctattatgagtcgaatagcataaaatccaaatggtagtcagccttgctttaagtaagcctggccagtgggtatttgattactgtagtcattggacatttaggaacagccttaatctcttaaatacagcctggctaaagaggagtgggggtggttttacaaggtgtttgcccacagggagatgtttttataaagttgcagatctggacacagtgtttcataaagtgtgaaaaaggtcaaggtcgtgaaatggctcctgggatgggggcagggtagtcttagtcaaaggacaagcactccaatgtttttcagtaagatccttataggatgtttttgtgcattaggtacgtgaccaagttactttttaaaacattatgaggagtcatgcaaatcagagaagagtgtcccgctgggtgcagtatggcattactttcattaaccaagaggatgtctgccagttgcccatttaattaccttctacttctgaccagcagtgatggccgagaattatattacagactggtgagaaagtagaaatcagcatttgatctatgaattgctcatccaaatagtatcaaacacagaaagtataaaatatgaagatgaagtaaagagagacttgtatcacttggtcgagtgaccctgtgacttctgtgagtcacattcattcaaaaacaaaagccaataaatagtctctcttgccttgattgtcccttaaaattgatttcagagtcaaagatcttcaagatcagcctataagacattatagaaattaaatgatcacttaattacttcagcttttaatattaaaaacacaggcaacacaaagctaacaagctttgatttataccaacaattcttctatcagttgacttcagttatggtatcatttctaaatagctatttagacatttttcttcccctgaggaagtaactggtcatttgtgaggagttttagcttttctatttattaatccattagagaagttctttccaagactcagtgtgcccatctataaaataaaattaccgtaacatctcccttttagaattgttttcagggtcaaaagagataactcatacaatattattaacaaaaatcccttttttcatactaagtgctcagcaaaaactatcaattcttatttcttattatagctctgctcctgtagttggtactctacgaagcttgagactggtagcttggtttttccccccctagagactttgcttttgctacctagtcagtaatttatctggaatcaaggctcataataatcttttctttgacacattgataatcattgctgtctcctccctttcctttccaggtttagtgatctgtcaaactgctaaactgtgtgtaatgcaatttctttcatgcagggacagtcttcttaaagatgcaagactacccactgcttcactgcttccagatttgaatggaatatactttcatccatgtatattcatcaggcatcgtaccccaagatgatctcacctttaagctgcccttaaaccttcttttactctcacccaaactgatgaggtagaacaaagcatccaccttataattcagtctttatccattcttccctccctcctcactcctttcttcccttccttccttttctcctccttccattttagaagcaacacacacacacacacacacacacacacacacacacacacgcacatgctcaccacactagtgaattcactgataaaacctttcctacaccaccattgctaggagaagcaagtaaattcaaactggtttagcactggattctgtctaccctgttcataattattctcaatgcctgccacaccttaagactaagaaactcttgaaatgcaagcatcccctctatattatctagccactttatcacaggacaacttgtcagttgagtagctgcatgggaccagtttagcaataaggcaatcttcccaagtcagaagtaagcatttacttcccgaggacatgtgctcagatgatatggacttacaacctgcacagctgagagacatttaaagccatcattggataaatgagagcccagaaagaacacaagttgaatcgtcagtgttacgttgtttgagagagttttaaccagaagaagcacagacttgaaaggctccttcttggtcttaggttgaaagcgtatctaaatacctttaaaggccaaagtctccagatttagaagttcctaattggtctactatgttgctgcaaggtgaaaaatgaaaatatgtgaaaaattgggattgtgacattttagttacctcaccaaaggactgatttttttttcttccatttgtgaaatcattcatagaacatgatgataatttttcaagaaatttaactaaactccctgcaaggattgctggtccattcctttttcctttgaaaagaaaaagaaatggacttatgtgatcctcaagtttgatctgaaatctaaattgtatcttgattatatatattaaatataaattaacacttatattaatatataataaatataatattatttatatttaatatatttaaaatgtataatttacagttaatataatttatataatattatataatataatatacaatattacataatatataatatgtaatatatattattgtatatgatatataatttgtctaccctgacagataatatataatataatcagggtagacagaatccagtgctaaatcagtttattataaccaataatatatataattattacacataattatatatatttatttatattactacatataatttcctgaggggcaggcaagtagagtcaaacaaatcataattcccatcccggctctgatccccactcagactgaggactggtcacttaacctccttaagtctcaactactctgttcctttctctttttttccattttttattaggtatttacttcatttacatttcaaatgctatcccgaaagtcccctatacgccccccccactcccacttcctggccctggcgttcccctgtagtgaggcatataaagtttgtgtgtccaatgggcctctcttcccagtgatggccaactagaccatcttttgatacatatgcagctagagacaagagctccagggtactggttagttcatattgttgttccacctatagggttgcagatccctttagctccttggatactttctctagctcctccattgggggccctgtgctccatccaatagttgactgtgagcatccacttctgtgtttgctaggccccggcctagtctcacaagggacagctatatcacggtccttgcaacaaaggcttgctagtgtatgccatggtgtcatcgtttggaggctaattatgggatggatccctggatatggcagtctctagatggtccatcctttcatctcagctccaaactttgtctctgtaactccttccatgggtgttttattcccaattctaagaaggggtgaagtgtcagactctttccgtagaccttaagtgaaataatgtaaggaaagcaaagggggaaataggtgcttgtcagctagacttaactttctttctgtgggtgggaatggttgaactaaagcttaggaaagaaattgtcattcctactgcttccagtgagaaccgtcgtgtgagttccaatagggcccactggtcttaggagatatggttaagataaaagatgcttgctactggcaacctacagttagaaaagtttgggcagagtcctgagacaagcaggtgagaaactgtatctttgaaaggtgggatgatgaaggcaaaagcagttaggagcagatattgctttctcatcctgtataagtttataatactagagaagtaaattggtattccggcctctgtgatcctggagaacttgaagaccaagatccaaaatccttagcaggaagctacctttcaacaaaaacttctctacctcgaacccagttctctctctctctctcaataacattcttgaggtcaaaccattcttctgctagtcttctctcattggttcccttagttgcccttgtgtcctcgaactctgcccatattccaggagacactaataatgcagagcagatgcaatggctgtgcttacaggaaaccctcttttacctgaagcaagctgctaaggagccccagtcccactgaaataactccagcccaggttctcccattaatttactctttgatttggctttatgcagtcccacttacatcctgattttcatcacctccaacagggtaggaggggcggctaaaagtacctgttgcttagctcagaaagttaaaaggtggttttgtgttgagaggccagactttaaactctgtaggccagagctcacatctcaatcctgtcaccaaaccaatgatctgcttgactctacctgactcgacttacccatagtaagatggcttattcaaggatgcaaggcactctgcacaaaccaatcattaacacagtatgtcagtctgtagattctgctgagctctctctttccagttgttgctagacccaagccaattaccaaaagccaagtcactgctttctgtacttgtcaaccagggccaagattgtttaccttctcccgaccccttaagcaattagtggttcttaccctttttagaaaactccagtaattaaaaaacaaaggagcaggtttgtgtgtgtgtgtgtgtgtgtgtgtgtgtgtgtgtgagagagagagagagagagagagagagagcccagacttgtaagctaagctttcccttaacattatttcttttactgaatttcctgctccccagtttttagttaccccaaaacatctaagtgtttcagctttaaggtcccaatggattcattttatgctgcctatcctggatattcatcttaccgatgttcacgtgtcagggaatggcactaatacacagagaattatttaaatgtggtctaatggaataaaacctgaaatcattgtcaatcaatagtaaaccatatgaagaaaccacattctatctatgcaagaaaatgttctatacttgtaaaaaggaataaggatgctatgcatacatcaagcttgtaaggtctctgacatatattaaacctagaaagccaagaaacattgcacatagaacactgaattgcaccaagaacaagaatagatgtgtatcatacatttgcacatgtttaataaaacatctttgtagtgatgtgtaaaggactagttaaagttcttgctgttaagaaaactaagtaaacataaaactgccctattagcctggataatcctcagcatttcttctttagcataaaatgcagtagaagtatattccctatcgtctcaactagtacgaccaacagatcttagtttgtctctggctgccctgaatttagtgctgcaacttctggacaaaccgtggagtacttttttctcatccttctcatccttccctatttctcatccttctgctatagcactgagccagccatggctttgagattttagagttggtgtgactagagctatagcctcatccccagcaccagcaattcataggggacaagagactgagtggcagatatatgctctgcagggtatcctcatctaactgacaaggaaattgaggctcagagaggttaagtgatttgcccaaggtcacacagctagtaagtgctggagccagtctgtctgactcctgccaagacaacaagacactggagaatgtaaagctttcagaggaacagtgggtctggccttttttaaagcctaaagcacccacccagagttgcattttaactaaatcaaacagtgttgttctgaatcaactttgtcaggccagtgttgagaagcggatttcttcctattacctccacccctcagagcaaagagaatagatattctgggtttggagaccgaagaagccgtatacagaaagctagtctctgaagctggactcataatgagagtccagttcttattcggggagtgatcatccctcaactcagcccagcctccttcgcaagagcagtgcgagcaaataaaacagaagagtagctagctactaccaggtaccgatgcatgtggtgctgtttgcctactgtttgattgggtgtgtacgcaattcaatttggctatgtaataggggctcattttactgggaaatggtgaatgattcccccagagcctcacaagccacagaaaaagagacactggcagatatcagaggctttggggacttgggaggaagataagaaaaggtcaaggccacagctgtgcttgtgtttttctcaattaagaaaaaggcaggagttaattacctgtaggcaatcgggatcccattgaggtatttcagacgtcttataaatgaggagcaaaagaactgctttccattggtattggcaattcatttatttgtgctgagtctttgaaagtatgaggaagaaaaaaaaatcccctgtacttgggtgtgagagtaatggatttaggggctggtttatcaggcaggatacaaaataaaatgaagcaaagttttccattaagctggccttttctgtaggagcgccacaattttaattaacattttgtatgaacactgtatatgagcccttcctacctgagcattgagtcctgtacttctgggatttgaatgaaacttactgtatctgtggtgattgaattctgagactatagatggattaacaacccaaaccattcccactacagcgcagtgtgctctgagctatctggattttagtattacaaccggcaggaaagactgggaggttaagaagcatcagagggtgggtgagatggctttgcagtaaagagtctaaggaccactttaaccctagcttctgcctacttggtacaacacagatattcacaacagaagtatgacagattaaataaggaggattatgggtatgatccatttaatgaaatcgacggtgtgcctgtaaatgtggccaccaagcagattttactacatagagtcccaggcctaggtaccttttagaagaaccttacagatgtgttcttctgacaaaaattttagccccaggatgctgcaaatctcaaaagtgcaaaatcgaatgctagttaagaggaaagctgtcaaattagttgttgatggtgtctaaagagacacatatctaggaaaatcatttaaagaaactgtgaggaattattttcagcagcaacaacaacaacaaccaaaaataacaaagaaactaagtttataaatttttgcgtgtaggacagattcatgctagaaaatgctacactagtttgagatctaattagttttcagtcacccttggactgttatttaaaaaaaaaaaagcagaacttccttcatgctcaccatggaacactatgtctctagaatgataaggatggctagttgccccttgggggaaagctcattagctcagttctactaatgactcttcagagctgtacacgaaacacaatctaattcttagctatctgtggtctttgaggacaaagtttagtggggggttgggtggactcagcttccttctgttgtatacgtattaattaaccaggcattcccattttccttgtcgcttccttctgttgtatacgtattaattaaccaggcattcccattttccttgtcagagggagaaaaaacagagtccaaccaccatttttgtaattgcaggttgagaaaagtagtggagcatgcactagtcttcaggtttgctgcagagagagagcactgagatgtgtggtctgcaaaggcccgtggttcagaagcccagggaagtcctcctgggagctggcagagctcaccaattcctaatgtttatctgaaggatttgctgcctttgtttgcttctttcagtttccccagcagacttttgtttagtttgatagcagcagaaaagttgcctttaaggcaggtagttcacagacttgtagaaatctcttgaaaatttgcttctatctattcaatctatcacaccaaggctacttttataaataaataaataaacaaataaatagaaaagactgaaagagctgaagggggttggaacttcataggaagaacaacaatatcaaccaaccagatcccccagagctctcagggactaaaccaccaaccaaggagtacacatggagggacccatggctccagctacatatgtagcacaggatggcctttatctggcatcagcgggaggggaggcccttggtccagtgaaggcttgatgccccagtataggggaatgctagggcagtgagacaggagtgggtgggtggaggagcaccctcttagaggcagaggggaggaggggtgggatgagggggttgcagaggggagatcaggaaggggaacaacatctgaaatgtaacaaataaaatgattaataaaaataacgaaataacagtttatttaaaagtgatgattgggttcgtgtgttacatttctctaaggggaacagcatttagaaagccactttaagttcttagctatccacatttgagtattcatagatgttaaacagttgatatagagcctgtatttagacagtaagaaatccttgctgagttgttatctgtactgtacataaattacattaacattatctgcctccaacatggtaatgtgtgtcttacatgagtagacttcttatacatgaactctaaacttactgtaacctcctcagaagtgatagcagctataattgagaacttgcaaactctgcctggcagctagccatagctcgaaaactgttttctttgccttcaaaagcttttttccccactagctgctaacattgaaaaattgcaaaacatcatataataaaccaggacttgccattatggataaagcttctacgaacatttgtgtgcaaatttttgcagagatttaagtcttcagcatattagttatattgcaaggactgtgattgctggatcatacattgagtttgcaagaaactgacaaactgtctttcaaattgcctatagcgttttgcattcctaacaaaaatgaatgacagtttttattatagcacatccttaataccacttgatgttactggtattttggattttagacattctggtccttatatagtatatgtaggtataaaaattacaaagttactttcttgatgctggctataggattacaatatacatcttaacctatcataatccatttctgctttatgactacttacagtgcatcctatgaactactctagttctgttaactacaacttttgcttgggtttgaagagcatagatttccgtatagcttttctgtatctccattctggtttagccttctacaaccccatcattttcctatcctctaccgacttgctgcttgaagccccttcattccctgtatttccccactctacttttatttcctccctccttcgccttaatacatctgctcccagtggcccatttccagttgccaggacaattggcttttattaatattttaagttaacatatagaagtaatggacttcattgtgatatctccattcatatatgtcattatactttattattattaattctccactcccaacattttttgctttgttttttctattattgaattgattgtgatgctgaggattgagcatagggacttgggcgtgcgatacaagcactgtactactgagcaatacttacttagagtctcaaatgcaattggtgtagtcagatattccatctgaaggtggcagctgctacagggttctagctgagtgttgctatgcaagtacataggcctacttttgctagccattctgctttaaaaaataagtaaataaaagatacaaatcacttcatttttctggaaacacaagccttttaaacaccatcaattaacttaaacttttaagatgcactagttagggtaaataaaacacttcattagccatttagtagtaaattctaatttgctattaaagccatttaataggaaattagatgacagagactttacagtaaaaaggaggagttgatttggtaaacttaagtgcctcactctttgatcaataagtgtaggtttggttccagagttgtatgtgtatgagcacttatagcagtctttatgtttgttagttgtctgtaacataaccaagtatggcttccgtggcaaaaatgataataaatgataagtgatctctgtatccggtaggatctgtgtgttgagcaataactggaaaatctttggccagaccatgtgctaaataaagaaagcaatcggaaggtcattgtcttttggagttctttttatgctttgctccgtcaccagttcatgaatcccctgaaggccttgataaggaatttatatttggttctaaaaatattaggaagctattggaggctcgtgagtagtggagagacataatccaacctgatattctaagacaattctcctaaaagagctgattagaaggttctatctctgaccttagtagtttaggaaaatcagcttctattgaacttattagccttttccactgctacccgttctttctcaggattgtcatttttctcttcacacatacatgcttttctctctaccctgaccacaaatggaaatgttttccattgcttttgagcaatatatcctaagaaaatcgaaggatgtgtcattatgagtgttttatagaaagaaacccagtgcctttcctggtggaactaatttctgtgtgttcttgcctggcctacaggctagtagtattcatcagccatgtaggagagatagacttttccagataggtcattttctcacctgagagaacaagtcaacgacctcactattcatctaaccaacctactgctctgcttctgtctttcagaaaatactgaaggaaggacccctgctgaagaactgtaactccttcagaagatggaagcttagatactgtctggttcaagggcagaagctccactttgcacaccatccttcggtaattatggaacccttttatctgcaataatgggtgggtgcagagggggccaccattagagaagttaaaaccatctattcttcttttaactaatccccttgtacaaataggtggtagtattttcctttcccctttcctgtatctttctttgcatggattccctggttagtttctgtatccagaggtgcctaccgaattcgtcaggcacagcgcaaaatgaaaggacaggacactttattcaaaaaccaggaaaagtgccactaatggtactaacatgaaatgtttcatatttataatgaaacatgaagtgtggatttatggtgttttaatttgatatttaatgttattctaaaaagaaaaaaacagcatgaggtttgccatttaattttcttttctaccactctaattttaaatgtaaatttaaatttaaattacaattttaaatttaaatataagagcatttaacttatagaaagaacaaccatcattatataatttatggtagtagctcatacatgcatgtgtattttgttttcagcagaatacaaaactaactcttttttcttcacttttttaatattttcatattcttcctacactttgtggaaagggacaatagccggtctggactttccttttccttgtagtttgcctgggctttccttttccttcagtgttacccttttcagcataaatggttgcataacctgaggataagaacttgaataagaattaatagaacagggctccctggttgcttgtttcctacaaaaacactgtcttttcttcatgtttgtggcaagttctgaccccaacagactgtgtggattgtcagtatccctgtctgctcagttgtacacacaccacactttatacttgcattattactaggatgggatccactagaattctaagctcatgcctatgacaagtgcacttagtgtgccaagacagggggtggacatgcagctgatacatgtctcctatgcttgtgtgcacagcccatggtcttgttgggctttatttacaaaacgcaagcccaaagatcaaatgatcaggaataagaaagcattagtccaagtcctgggctattctgaacatggagtcttgacagcacaagttacatagtgatcaaacaaacagccttgtcctcctgatagtactgagttccagctgatacctgggcagcaactaccacatcaattataccaggagatacgggctccaaactggatgtgacaggcaagatagtcaaaggctgctaactcaataaatttaataataatttatactacaagttctttaggtaggctatattttgttatcttatctatcttaaatttatatttggataagtctcaactgaccagcccaagacttattacaaacccatggaaaagttgtaggcaaattgtattttaatttagtgttttacttgctatgtctacaaaaatcacattattatataaatcctagcccttaagacaaatactggttggatcataactgctaaaaatgtttgtcagtgtgtgtgtgtgtgtgtgtgtgtgtgtgtgtatacattttaatgtctatttgtgccaatgaatccaatggcttcttatcattctttccctatgtctttccagtttgcacactttgaaacaattgatctgtctcaagttgttttggctgaaagtagctgcagaaatctttgccatggtttttgtgtaagtaagaatgagaatatctgaatgtgcatgcatgggactgactgagaataagagtgtttatagcggtttggtccattttgtggggggcatcaggcttatggagtcttctttgattgcaaaatgttattatttatgtgaatttccactagcctagtgatagacaggacagtgagtactaaccatgttccctactaataggctgctataagccaaactgacttcagggacaaggggcctttgactattatagcattcagtgggctttgaatataatacaggtaaatgtaatacagaagtattgttgaaaagggttacaagacacgagtaagtcataggaaaatttagagtaacaaagcccatggcatcatttcctttgatgctatagataatcctcagtgagatctagcccacagtgaggttccagatgagaatgcttctaagaaaacagaggaagtgttcagggctttgtgagcctggaacgttgtacagctttggtcactcatgtaaatctaaaccaaaataatcactgaaaagtatcaagtccactagttccaaagactcccatctcacctctcctgaaattgtcttccccagcctcatcagtcggttatatcaggtttcttcttgaggctatgctatcccttatcttaatgaaagctcaggaccactgcacaacagattagctaagaatagatgtgaagtgaaggagtgactgtagtcatgttcccaaccagttcctatgcctatctatcaccaatcaagtgctatatgtgaaaagaggcagaaattatatgttagtctggctagcactagtttccatttgtggcattcatcaagcagggccattgaagcaatgactgatatcctagccaatcttgttttctcttactatctgggaaaagtctaaggtctgctcatggtctacgtcattaagaccttcaatactgagccagtgagatgactcatcagcaaaggagtttgccaggcaaactcaataaccagaactcaatcccaggatccaatcaaggaaggagagccaacacctgacaatcagccttcccacatggtctttgccacatgcacacctacactcacattcatacatgtgtatacaaagatcatatacacacatgtacccaataataagcaaacaaataaaccaagcagcaacaacaacaacaaaaagacattcagataggctttgatactattcctggctgagttctggcattattgcaaaggattaagagagactactgtcaacttcccttccatttatccctgtctgtgataaagaaagaaactggatttctttacatattgttttgcccacacactgcaagagaagcaccctgttggtcactttccccacttcacatagaacagcagtgagcaagtaaaaatgttaggcaagctcatgttcaaaatagatgacatgtagctgaatgcttcagagtgtggattcaagagccagagaatttccttttgttttttttaacttctgggtaactctggaaaaaccatttagttgtcattgtctcagttttcctggctatgaaatggggacaattacaatgcccatctcatgggactgtaacaaagtttgattgaagcaatatgcctaaaagtacattagaatagttcttggcacccatgaagtggcattaaaatcttaattattactattatagttattattgttttgaatagttattaaggcagctgggtagccctgaaaacttatgtcatattcaagaagtggcttggaatatgcttggtacctatgtctaatttcatagagaatttgcagattttggacaggggtctttgttggtgaaaatcaactaataataggatgttttctttaggttatcacaccacatcgaaaagtgtctctagttgcacccactcggcaagacatggaagaatggattaacatcataaaaactgtccaacaaggagaaatccgtcaggtaaggcaaatggtagcaaacatgcacaactctcatgagaaaatacttaattgactgcactgggaaatcagctcaaaaactagtaaaatagaagcagagactatccagccaggatgtgcatgtagtatcaattggaaacctgtttagaactcctcacaaataggagaaattcacttgggctcagaccttggtaaccatgttgcttagtcttttctgtatacatctggcagaaatgtcatggtatatccaatgaatgaaaggcacaggaagtttttgtgcagctaacttagacatccatgatgttaagaaagttgcgatcagcagtttaaattcctgcattcagaataaccataataacacttaaaggaaattgaggctgagaaagaggaaggaggcagatcaaggagaaataagtattctcttgaaaacaaaacaaaacaaaacaaaacaaaagagaatttggacccaggctctgtagtccataggcttatgtcattaactgctatatatacaagtccgcctctgttttctatccattacaaaagaaatttagaagaaaggacaaggacagcctgcccacagcttctcagggttcgtttctcttttactgtctctaaaacactcagtgctactattcagactgtgagatctggcctgaactggctcttctgtaaatctaccacaattataatctatataatttgtaagatgggaaggatcatgtcatttatttactcagataaaatgtgtacttcacggtgagttagataaatatttttgaaggaatatgtaaatctaagggaaaaatcttgaagtcagttttggcttagaatgaaagagagttcatcctagaacgaaattcttctgtgaaagtcttggaggcaaaggagcaacatgaataaatacagtctttaaagaccttgatgtcacacaatataattttaaaaaaaaacctcaatccagaagaaagtgtatcaccaaaagaatcttaaatgtcttgagtaactaacgagcagtagagattgttttgtgcatctaggctggagcagggtgctcagtaataatgaggcttagaaatgaaaaataaagtctttgagaagatccatctttcattatagatttctcaggcttctgaccactcagtgtcataactatacatttgactattcatgactctgatggaggtagcatgtcaatgtgattaaactggagtctccagcatatcatgaagccctcttacaggcttttacaatataatgctcaattgagggtcctccccatagcatacaataggttttcacatgacttagcatctagtatttaactgctttgctcttttcttcttcttttcctgatggagtaatatatccccaccctggcgatgaagccaacattagaggcagtaacaaagagttggtcattcgttactactctgctgttcttatcctcaaggagcaatacctttctcttgggttacttctattgaaactgaaatgcttcttccatatcacataatattttcagtttcacaaacagtcacatgggatattttgaattgtaattattagcctaggaatgcagaaatcctagagaaaattgtcagaaaatagatgtgtcattatttactccagtgaattaaacacctggctattaacaacccagcacatgctaaaaaagaaaagaataatgtgcctgtttactctcttggaagaattggatgaggaccaaattctaacctctgtagaattgactcagggacctaaatacattaaagagcactcccggctgctggacaaagccctcactatgagaaccttagcacttcatcttgcttaaagcttaaacaggcaaatgtttccctgtttcatgcaccttatatgtataacaatctttcctatcttctgtcaccaggagtgcctgacatttatggtgacaaaagattaatcctgggtttagtgacatattagaggactgacaaagtaattgagtaatctgttggaaactattcaatagatacactactagatgtttagttaacgttgccaaatgtgttgaaaaaaagtagaatcctacttcctgacccagtgagtttttaggtagttaggagacatgatgctagtactgacagttagttctcagaaaaaacaagtaataaagtagtatataggaatgcagaaaaggaaaggataagtatctagagccttctgggaagaattaatagacttgagactgaccttgagagataaatgggacttaattagtggcaagggtttgggctagcatggagtcctgaacaaggaaactgatataagaaaaatctaagacaagagaattttcttgaaatacaatgaaatgtggctggccaacatttaggaatgtggacacaagaagcatagccagagaggtgaagtaggtataatggcagaggtttttcagtgccagggcaaggagttaaggcttacaatatgataacgtttcaatggaaagaagattggaaagagttgttcagttgtatactttagaaataaagaacagagaagtgagggagatggcttagtgagtaaaacttgctaatgaacatgggaacctgaatttgcatcaccagcacccacataaaaagcctaccatggcagtgtattcctttaaatccaggactgaggccatggagatgcagaggcaggtgggttccaggagttaattggccaaccagcatagctaagattgcaatgtctaggttgagtgagagaccctgtctcacaaaataagtcagggagcaatacatgttagtatctcatggcctcctctacacttgaacacatgtatgccaagtgtgtccaggcatgtacacacatactctcacccacatacaaaacatagaatgtattagacaggggaacaatagaggctagaactccagggagttatatacacttggggcaaaacaaagataaatccttgtcttagttagggttttattgctgtgaacagacatcgtgatcaagacaagtcttataaaggacaacatttaaatgtggctggcttacaggttcagagattcagtccattatcatcaaggcaggaacatggcagcctccaggcaggcatgatgcggaggaactgagagtcatacatcttcatctgaaggcttctatcttctggattccaggcagctaggatgagggtcttaaagcccacacccatagtgacacacctattccaacaaggccacaactactccaacagggacacatcttctaatagtgccactctctgggctgagcatacacaagcctcacaatcccagtagaatgataaaaaaggaagacaaggagtaaatactaatttttagatagtggactgagaagagaagctagctataagaaaaagatacaatgagaatgagggccagatgtcaatggtagaacacaaactaccaagtgaaaggtctttggtttcatctgcaccattgaaggagtgtggtaggaaggaggttttgacagagaagtaaggttcctaatttcatggagtggacctaatgtcaaatcagtcattggttgactcctcccacaagctttgtgccaccattgccccagcatgttttggaggcaggacagcattgtagagcagtgattttatggctgggttgttgcttatgttacccttttgatagtgtgtggaatcccttcctataccaaaactactataatattagggtgaaggttctgtggaggcagcagcacagtctctccctgttcagtgagttgtgtgagtgtggtcttcagcaacggggccttgctgtcggtttgtggggactaacatgttgtcttggcaacagcctgggttgtttgagatttccatgggacccctttggccatttgtaatttagccattgtaatttagtccaggtgctggaagcttcctttggtgacaagatatggccaattaggtctacatcttcccctttatttggacactttattaggattaacttcttattatattttagaaactttccattggactacgtttccacaccaatcctcagatacccctcagtttaagctttctctcctcgtccacttgacctcctatttccaatacatctaccacccagttcatctctaaaatgtattctatatccccctataatggaagtgcatgtattcctgtgccaatgagttcaaggatattcctcactttctcttcaatcaggttcactgtatctggttttatgttgaggtctttgatccatttggagttgagttttgtaaagggtgataaaatgagtctatttccatttctctgcagcagatccatacagtttgaccagcaccatttgtcaaagatgctgtttgtctttctctagtgtgtatttttggtttattcatcaaaactcaggtgtccataggtgtgtgaatttgtatctgggtctttgattcaattccattgatcaatctgtctgtttttgtgtcataggaacttgagtatcattctttcaaggtctgtaaagtattgtgttgaaacgttttttaaacttttgttaggtccatttgtttataatgttgagtagctccagttctttgtttaatttttttttgtttggatgatctgtctattaatgagtagtatattgaagtgtcctactctcagtgtgtgagggtcaatatgtgattgatgtgatagtagtgcttcgtttatatacttgggtgtccttgtgttttgggcatagatgttaagaatcacaatgttctcttgatggattttttcctgtgatgcttcttaggtctatttgcctagaattcccagtggccatacctattatgcccacagaaaatttcctaccatgaaacacacagccatcacattctcctgaaaaagagtataaacagaaaccaagggggaaaaaaaccacccaacaaagacaaaaacagatatcatcgtctagaactataattataacaaaccaagatgttgagacaccagcatagggtcagtaacagccagagctgtttgtcttgttttgatgtttgagtgtgtgtgtgtgtgtgtgtgtgtgtgtgtccactaaagccaaaaaccccactacagcatgccctgaatattacaacatagttgaaacataataagatactttttaaagtccatacagagataatagaggattataaggaagaaatgagtaaatctcttaaagagatccaagagtatgtgcatgcttgtggtacactatagcaaattcagattgcctgtacatatactttatcaactaagcttttgtgtcctgtgtcaagtcatgaagaaaccactttaacatgtgtgtatacatgtgcatgtgcacaacacacacacacacacacacacacacacacacacacacacacaccaaaacaaaataaaaaacccagtggacagaaatgaataaaactgttaagtggacatagaatcagtaaggaaaacacaaactgacagaaatctggaaatgaaaaatttaggaattggaacaggaactacagaggtaagcttcaccaacagtatacaaaagatgggagagagaatatcaggcattgaatatatgatagaaaaatgaatatgttgttcaaagaaaatggtaagtctaaaatactcttgatataaaacatccaggaaatttgggaccctacaaacagaccaaatttagcaataataataaagagaagaaacacaggtagaggcacagaacatattttcaataaaggatagaagctgaagaagtacatacctataaaggtacaagaggcacataataatcaaaacagtaaatgtactgaacagggaaagaatattaaaagctgaaagggaaaatgacaaagaaacaaataaagggagacctattataattacacttgacttctcaatagaagctctaaaagccagaaggcccaggacagatgtattgcagactctaagaaataaaaaaaaaatcagcctagactgctatatacagcaaacctttcagtcaccatagatggagaaagaaaggcaccccacaacaaaaccaaatttaaacaatctacaaatctagacctataaaggatgctagatggtaaatctcaacctaaaaccattaacaatttccaagaaaacacagggaataaataatcccagactagacaattaaaggaaaaacaatagaaacagaccaccaacaacaacatcaccaccaccaccaacaacaaagtaaaaggaatcaataatcatttgtctgatatctctcaacatcaatagtctcaatttgtcagtttaaaaaatttcagattaacagaatggatgtgaaacaggatccatccttctgctatatccaagaaacacccctcaatatcaagaataggcattaccttggtggcagaggttgagagggtggttggaaaaagatattccaaataaacagacctaaagaagcaagttgctatagccattttaatatctaacaaaatagacttcaaaccaagaatatttgtttcttaaactttgactacagaagaaaaaactattgtaaaatattgcatagataatttatttattttctttgttttattttacagaacaggtattgcatctaggatctctctctctctctgtctctctgtctgtctctgtctctgtctctctctctctctctcagttgaggtctcctgggctttcccactctgtattaccatgtctactgttcagctcagggccaggcaattctggtgtggctttatgggtgtagcttcttccactcctgggaaacacaatctcacaacacaatccctgttcctttggctcttacaatctttcacctaccccctctgcaatgataatgtgtatatatgtgtgtaacaataattaatggaaagagaagctatctatctgaaaaagagcaaggaggggtatatgggagcccttagaaggaggaaagggaagaaggaattgatagaaatattttattccaaaaaaggaaaagaaatgagtagtttaaggtttttttgtttaaatcagaagcatatcaaattgcccaggctagccttgaactcattctgtagtctttgaacttgtgtcttcctgtacccaaagaaactgatattagatccccagtctcagtaattctaacattatgtgatagttctgctttcaagtttttgatgaatccctctactgttttttcataatggttatattaatttgcactttaataaacattttcaaaactccttttgatctatatcgtttccaacactttgtacctctcattgttttcttagcttaaaaaaattatttattcactttaaatccccctcactgccccccttctgccttctactcctctttttaaaaaagatttattttatgtatataagtacccagtcactcttttcagacacaccagaagaggtcatcagatcccagtacagagggttgtgagctaccatttggtggctgggaattaaactcaggacctctggaagagcagtcagcactcttaaagactgagccatctctccatctactcctcttttgtgtttgttttttttttcttctatctagcctgtttggctgtgtctttttattagggaattgagtccattggtgttgagagatattaatggccagggattgttagttcctgttattttgatgttagtggtgtgtgtgtgtgtgtgtgtgtgtgtgtgtgtgtgtgtgtgtgtttgtgtgtacatgcgactcttgttttttgctggtatggaattacttatttcctatgttttcttggatgcagttagcctccttgggttggagttttccttctagtattttctgttggactggatttgtgaatagatactgtttgaacttggatttgtcttgaaatttcttgttttctccatctttggtgattgagagttttgttgggtatagtagtctaggttggtttccatctgtggggttttttagaggttgcaagatatccaggcccttctagctattagagtctctcttgagaagtcatgtgtaattctgacaggtctgcctttgtatgttacctggccttttcccttgaaacttaaatattctttctttgttctgtagatttcgtgttttggttttgatttggagggaggattttcttttctggcccagtctaattggtgttctctaagcttcttttatgtttataggcaaaaatgctttctgtagcttgaagctgggactcttcaccctctattcctatagtcttaggttaggtcttttcatggtattccagatttcctggatgttttttgtcaggaagtttttagatttaacattttctttgattgatgcatcagtttcttctatggtatcttctacagctgagattctctcttccatcttctgtactctgttgctgatgcttgggtctgttgttcctgttctcttccctaggttttccatctccaggatttcctcagcttgtgttttctttattgcttcaatatctactttcaggtcttgcagttttattcattccctttacctgcttaattgaattttcctatatatctttaaggcatttatttgtttcctctttaaagacctctacctctttgattgtattttcctgtgtttctttaaggtacttattcctttcctctttaaaggcctctatcatctctagaagattggatttaaggtcattttcttgtgttttggttgtgttgggatatccagggctagctgtgctatgaaggtgtcatattactcttgcttttgttgattgtgttctttggaggccctttagccatctggatggctttggtccctggatgttcctcttgtagttggtattgggaggaggattaaccttgatagccctagtgtcacaggcctctgatgggtatccttgaactgtatggttccggttcagcaagtctgatgaaggtgggtggagaggtggagggagaatggcgatcccgtggggagagcaggctgctcagggtggcttgacatgccccagaggactcagcgagcagggtagatcctctcatctcttttgatcagagtattctactaggaaaaagatggtatctcaccatggttttgatttgcacttagtgattagtgatactaagcattttcaattgaccttcatgaaaaaagtctgttcaggcttgttgaccttttaaaggactgtgtgtgtgtgtgtgtgtgtgtgtgtgtgtgtgtgtgtgtgtgtgtttatcagtttgcttttaaaaattaaaatatttaaagaaagaaaacatgatgttaagaaaacatcattttctccccttctccttcttcccgccaaccctccttctaaaaatagtggcctttttttctttagttgagataacacacacacatacacttcaaaaattttaggattgcttgtatgtctatgatttcaaagctggctaattggtattggataaccaattaggggctcttctctgcgaaagatcatttcctctgttctcagcacttcttacctccctgtatgtcttaggttatggtggaactctagatttccccctcccatgttagcatgcctattggtgctgttgttgttcaggtcttgttcaggcagccgtattatagaagcatcatggatgaccttccctgtaatttctagaaaatacagtctctcaacagatttcctggtcctctggctcttaaatctttccacctcctcttcctaaatgtttgctgagccttgggtatagaagctgtgttgtagataaatctttagagttcgacactccatgatcagtggttctctacattttaaccagttgtagtttactgtaatcatctatgtcagtttgcaaagacaagtttctttgatgggggatgggtgggcttatatctgtggatataagactagatctttagactacaataaggaattatgctggtttagtaaagtagcagttggaggtttacctctaagctatgactttcactagccctgaggagttagctaggtttctagcactaggcatgttttttctctttttttaagcagtccttaagtccaattagaaggttgttgttaccaccaagatatgggtaccactattgcattttttaagtttatgcagccatgctagcattcttggttcataggtgtaatagctggataggactggatagttgctttcctcatgaaagctagttctaaggaggttcgcaggtcagatcctgctcagatcctgtgtccaataaagtgcagggtgatttcaacaatagagacttactcctatcaacctctaagaagcaatcaagggcaatagcaatagcctatattgttttagaagtttcttgaactcccttgagcagcaactcagaagagagtttctcatgcctggtatttggaattttgttaagctataactctggtggggaatattgtttgctcaagaaggataacttcatttgaatatatattcactatacataatttaaataatttaattttaatgtgattccgtatggcttttcagacctccttagtgttactgattctccctcccccttttcttctgtactgaactcctccccccactgcaattaataccccccattttacccatttccccctccaagtcacttttatcattttctattcctctctaatgaaacacttgtttttgttttcaattgaatttcttatatattttggatattatctcctcagatttgcaaatattttctcccattctgtacactcttactctgccttatttattttgctatgttgaagctttagcttactatcatcccattagcctatgtttgctttctgatacctgtgctttcaacatcatggaaggaaaaaaaatgtccaaactaatgtcagagacaagattatgtcttctggattttaggaatcttacaggtttgagtcctttatttgcatctttaacttgttgtgacttgatttttgtgtataataggaatgtcagatttcattctgcatattgatatacagttttccctgcagcacatgttgaaaaaagatgtcctctctccattttgttttctaaaaacctttgtgaaaatttgtgataagtttatgggtctattttggggttctctgtttcatacctttatatattattttaatgccagtatcatgatgttttgattataatcagcttatattttcaaatcaaggagtatgatacctctggttttgttctttggttcatttattccatgtttacgaggatggcatggggattgtgttgaatctgtagactgctctgcatattatgtatattttaatagtactaattcttataatccaaaaccatatacctttcaatttctttgtgttttctttctttgtgaaagccagtttaatactttttcactatgtagatcttttccatccttggttctatttacatttaagtactgaactttaaaattgcttttacaagtaggattatttccttaatatttctgttagatcattatttgcatatagaaacacaagtgattcttggattctgattttttatcctactactttacataagacatcattttaaatgtttttttttctagcctgtgggaaatggaatcctaggatcatctcatcagcaatagagacaaggttttttgtctgttttgttttgttttgctgttttatgtttttcttttctattagaatggttctttattctttctcttgcctaatttctctgctaggactcccagtcctatgcttaaaaggagtgacatttggcatcccattttgtccttgatcttagacggaaagctttcagctcttagctgttgagaactgtgttatctatagattcatcataaatggcctttgttgtgtttagataaatttcctttgtttataacctactgagatctatctggaagggatgttgaattttatcaaatgctttttctgcatttgttgagatggtcctgttaatttatacttgattttgttaatgtgttatattatgtttattgaattatatatgctgaactactttgactcccagtgacaaattccaattgagtgtggttatcaaatttagtttgctgtatttttcaagtatttttacatctacagtcatcaggaatattggcctataagttaatttatatttttgtaatagtctttaagaatttgtgaagaaaaaacaaaaaaaagccgggcagtggtggtgcacgcctttaatcccagcactcgggaggcagaggcaggtggattttttagtttgaggccagcctggtctacaaagtgagttccaggacagccagggctacacagagaaaccctgtctcaaaaaacaaaaaaaaaaaaaaaagcaaaaaaaaaaaaaggaacttgtggttctgaggcacaaactcagtacctcatgcactcaaggcaataacgttaccacagagatacaatcacactcctttcttctttaagtggaagaattaaacagtgatgctacctttgcctggaatgttcttcggtgaatgacttttattattgattcgatctcattacttgtcattgttctgctccgattttctcatcattcatgattcaggcttagtaagttgtatgaatcttgatatttattcatctccttcttattgggggtgaaggtactgacaaattcagtgtctaacaaagacccactttctatgccaaggacggctatctttgtgctgtatcttcatatgacaaatacaagagtgagaagggtttgaaggttcttatatagaaactattattattcattatggctccatcctcagaacataatcatttctcaaaggctctctggtaatagcaacatactgagcctagggatttcagtatatgagtggggcattacacagacataccctccattgcaaatgaagaatctgattagagcaatggagtgtgtattttagagattatgaaaaccaaacacaagtacccaactattcggttctggatgctttaggccaactgacctgtcttcaaacttgtatgcctactacagttttgaatctctcttcaaatttgatttttaaaaatctgtataagcaaatagacaggcctgtggtgatatactatgccagttcatggctgctaaaacaaagtacctgaaaatttgtgacttaaaacacacaaatttacaaagtggatgtaatttataaacccttatagtcttatcacttaagaaaagttcaaggtcatccttagctaaagagcaaatccgaggacagctggagccacatgaaattctgcttaaaacaaaaccaaaaaccaaaaccagaaatgtattctcttacagtccttggaggtcaaaagtctgaaatcaagttgagagtagaaccatgtttatgaaggccttatggaggaattctgtgcctcttcctaggctttggtggttactagaaatccttgctgttttggggcttgcactataccattccagtctctgccttaggcatcacaaggtgcctccctgtgtgtctatttgtgttgtatcttcccaagctattcgcttcctttgataagaataccagtaacataccagcaaaactccttgtgtgtttctctctgtcctctgtctatgttgctttcgaggggcaatctttttcctcaaaaccaaattttctacccctaaaatcctgtattggaagaggagaggactgatactctcattctgaaaaactaaaagggctactggtctaaagaaaactgaaacccagaaagacaagttcccttaggtttataggcctgcaactaattatctatggctaagtgttgtcttccagcatcactctctcagcctaagtggcatctctctctaagtaaagacgtggtcccaccttctggaatgaaagaggcagtgaaatcttccaatatgcccacactcatgacaattttgagctcctcaacagcatttctagtctcctgaccatcattggaacccattattctattttcctgaaggaacaacacatgttcacacctgatagttttatttgtcgctttcatgctgtcgagtctctgatgtctagcatcctcctttcgatgagtctcatactgaactttttaggccacaaaatcatgtcttatacttaatctttgtagaaaaatgttgtctaactataccatcgatatgcacttcagaacacactattttgtgcttgaaatacagatggattgagaatggagatgttgagaagttgccagatctttaagttctggcaactttttatttaatagatcgtttgtgagctgaactgtaaccctaccccaaactcatacgttgacaattcatccccaaatgtgactatgccaagaaataagactccaggggggggggtggttaaggtcaaatggagccatgatggcagggaaccaaatccagttaggctgataacctcatgagaaaaaccaagaaatatctccttctttcttcgtatgcatgcattaagtaaaagccacgtgagcagatagtgagaaggtggccataggcaagccatgaaggaggcccttgggaacgacattggttgactgtttgctcttgaacttatcactttcctgctgctttttctgtaagcagcagaaagaactcagactgtacccttatactccacttggaagttttgtcagctaagggttcacatttatcattcaaatagtctaatgccaattcaacagaaccattctgatccacgcagaaatgggcagaaaagtatcacctttctgcccgttttctagaatgtttcttgtttccatgagaaacatgaaccatataccagaagtatcttatatttctaataatattctactcaaggcactatagtcctttaaatattgtatatctcaaaaaccatagtatttatatacttaacaactataaaaagcagttccatagttttaggatctcttacagaaacatcgacatcccaatccccaaatctatattcattttctaggattgctgtaacaaacaagaaccaagtgaactgaaaacaggggtttattctctcatatttctagaggatagagatttggatttgtgttcatgatacagtcagtctcttcaaaggctctaggaggatgatttgctgcttctcctcctcctcctcctcctcctcctcctcctcctcctcctcctcctcctcctcctcctcctcctcctcttagtctggcgattacagaccaaccttgatattttctggtttgctggtgcattgttgaatctctgcccccactgtcacatgatattctcacttgcgtgtgtgtgtgtactctatattatcacaaggtgttctattctctgattacatctctttccatattttcttattcttataaggacaacagtccttgaattaagtcccatttgactgcatttgctaagatagtatttcccaataaattcacattcatggacaccaaaggttagggatttacacatgcttgagaggacacacaattcaaactaccacagttattcgtccaggactggatgcatcaaactttccttagagaataaaatgaacacaagggatataaattctgtttccttaacaactgaacccaagcaatgtccatagttactgcataatcaagattcccaaccagagttctttatttcttctacttggtcatatagagccttgcacattctttaaacaaatattttctacatatgacaactatctctttgagaatgtttcctccaatagacagagttccttgatatctatgatgtattgatctctatagctccagtatttagtatgttacctgacatatagttataggttcctagtgatttgggaagaagagaaggaaatagaaggagtaaagatgtttatttagttgtagtcagcagccttgggaatagaaagggattgtaagctcagagtgccaatgtcaagactctctgctttctattccaatggtcccaggcctggagcttttcaaggtgtcagtatacactaaaattccaatcacaaagaaatgccaaattgtcatttcatcatagtagctttttctaccaagaacaaaacaaaacaaaaaacaaaaaaaaaaaaacaaaaaaacaaaaaaaaccaacacaaaaaccacaaaaaggttctatccagcagtagtttaacacataaccagcatgcccatgggaagtaaagatcagagagtactctgtgcaggctatgtcttggatgagtaattccagtaaatggattaagtttgaacttaagtttgagctctcaagagcaaccgctttaatggtctgctgtcaagttacatctgggagaatgtaccattcttttaaagtcttcccatgcctttgcacacataacccattataaatgacaagaataagaacctatgtgtgtctatgtctaaactcttttttaagaggcagaggaaaaaaactgaaatacccttgctaactagagaaaatatacacagaacaaaatctatacaactcgaatcattggtgatacatgaaagtcaggctgtgctatgcaaatgctatgctgacaggcatgataacaaaaatgacaacttagtatgaaaggagacaccataagggcaaggactgtatcttgttaatgattgtatctcaaatgccttgaaaaagtaccaggcatataatagcaattcagtaaatatttgttgactagcttattggatggattaaaattattaaccaagaaactgctgtaggcaatcaaagcatggtgttgttgttttttaaattcctgagagaagggtttcaagctctttcaagtattgtcctggtaaagcagtgctcggctcactaggcagcagtgttgggaggaagagcaggcaggcgctccttagttctgcctgtgagccctgccacctgcctgcctttgtttgtcagagcatttggatggccctgaatttccgactcttggctgcttttctttgctgcctaattaaagggacccaagaccgctcagaacaaattttgcttcagagcaaagaatatcaagactgttgcttctgtcttcagctcctcttcgagattatccccagttctttctctctctctctctcttttcttttccttctgaagctagtcctaaaagaaaattagaacaaaaagtggtgactgtggctaactctcagtcctctccttcacacgctttgacacctacactgtgagccattttagccccagcagcagattttctgctctgccctgtgccacctctgtgattaaccgtccattctttcttgtctttgtttgactttagatccctgcagccgaaaacaacccctttcttgtcggaatgcactactggtattccagtagtaatccccggagtcacttctgcaatgtttgtcgagagaacattcctgctttatctcgagatgccgtcacctgtgaaggtgcctttcggattgttttagaaagcagagctcaatggatagagataggcatgaagaattccgtatcactgacccagtctaagcctttgattcttatggggagttaattccaatggagggaaagccaaaagagaaattagtgtgaaggggtgttctcacgaataaaaatggagggttggatatacgaagatgggactatgtggccataagaattgaaaactcagaaataacatcttttctactattaattgtaatgtaaaatggatagtaggaagcttagttagcaagaaattggttcacattagaaatgggcctttggaaatgggtcaaaactatttagaaaaaacttgaattctaacctctagagaagcttagggaaggggcattggagtttacattgtcaccagatttacacctctttttttttctccctcctttcacagtctgtcaggtgaaatctcataaattctgtgctttgagagcaaacaaagactgtaaatggaatactttatccgtgactgatgaccttcttctacccgctgatgaaatagtaagtagcagccatatcccccccacccacacacacaccttttcaagtcatgacacacaggaacactagacagatagaggagtcacttctaaagtatctaatgacccaatagctatcaatgagttaaactctaactcctacttttcattagtcaatggcattgagggcatccatgggactgtcatctaattacatgggtagtagaattatcccagcttttccttcttttatcactaatttctctcccttgcctttttccctttcagcaaacaatgccgcatcagtgggtagaaggaaatatacccgctggctctcaatgtgtcgtatgtcacaagagctgcggtagtcatcacagacttcaggatttccgctgcctctggtgcggctctacggtaagactctttccgtatctttgatacttaaatttatttctagagaagagatagattggagattataactatgtaaggataaatagatcagtagatatgtagatatcaattccatagtagagagcccagtaacttggcctttcatagatagttatggagtctttgggagaaagatttgagttattcataatctgatgcttcttaactaatgaagcaatcttggaaatgataaacgctgaattctaaactgaaaatatgagcaattagaaatagattctggagcctatccttaagaaagaatagactcatgaatatttcctagaaacttacagtctttattaatggttagtaataataacaagctatcattgctactacatagaaatatcttctattcattatctcaattcttagaacaacattgaactaagcctcattgtccccattttacagatgggtaatgggggggctcagaaaggtcaacccaaggtcatatagccagccaaaaagaaactcttgattaatatttaattctggctgggcatggtggcgcacacctttaatcccagcacttgggaggcagaggcaggtggatttctgggttcaaggccaggctggtctacagagtgagttccaggacagccagggctacacagagaaaccctgtcttgaaccccccccccacaaaaaatatatatataattctgataagaccgtgttcctaactataataccaccacatctctttgtaacactggccctcatatgaggataatttgtgctctagaagacatctggcactatctggagacattcttgatggccaaaactagactagacaggaagcatgtaactggtatataatagattcttcaaaacttacaaagcacaggatagtatcctatattatgaaattataacattataaaattataaaatatgtaaactataatatataactatatgttatgaatataatataaatacatatacattctctacaactactaaaatatttgggggaatgtttatttgtatatgtacatcaaagagccaacaattagtcttcaaactgtgatatatcacagagattgagactttgatcttgactttttaaagcttttagatgtttttctcaaactgagttttctaagacaagaagaaaaagaaaaagaaaaagaaatgggtttcttcactgaagagcctgtccactaacctccatttcattgcttttgaatagccctgccagccaggcttatgtccctagtaactatagttgtttaggatgtggtacttaaaaaaggtcaaagatctaggaagaatggcaacttgtggggaagactgcttcagcacttcccagctatttgaccttaggtaagaaagagcctttacctctgtgagcctccacacatactcatttctaaattgagtgcaatgatacttttcctgccacataacagctgttctaaagattgacagataaacaccttatcagtattaggactttggaaatgcaagaaaattctcccttcagcagcctaccaacattgtgtctgaaggctagtgaaatctcagtatgtgtagaggagaaccttcagaaagacacctttttgaagggccagagttctgcatgctcagggagactgcagtttcacagtagatcagggtgggtggtgtcaggcaagttagggtttttcagaaaggtagatttgtaatattaaggatctaattcttgggacggaaccagaaactaatcagtgtttttctttctctctccccttcctttctcttttgtgctcttatcgtttcaggtgcacggggcctgccagaagcggttttccaaggaatgttccttcggaagtcgtcgctcgtccatcgtgccaccaacggcactgagcgaccctaggggcgatggtgagtacattggcttttccttcagaagcactgg

SEQ ID NO: 475 - DNA, 118599 bp, mus musculus; identical to SEQ ID NO: 474
  misc_feature (2990)..(52989): n is a, c, g, or t
  misc_feature (54627)..(54726): n is a, c, g, or t
  misc_feature (56365)..(56514): n is a, c, g, or t
  misc_feature (68121)..(68220): n is a, c, g, or t
  misc_feature (72092)..(72327): n is a, c, g, or t

SEQ ID NO: 476 - DNA, 10886 bp, mus musculus; identical to SEQ ID NO: 52

SEQ ID NO: 477 - DNA, 19795 bp, mus musculus; identical to SEQ ID NO: 53

SEQ ID NO: 478 - DNA, 38966 bp, mus musculus; identical to SEQ ID NO: 54

SEQ ID NO: 479 - DNA, 38966 bp, mus musculus; identical to SEQ ID NO: 54

SEQ ID NO: 480 - DNA, 797 bp, mus musculus
gtgtcaagatgaagctgaacatctccttccccgccaccggctgtcagaagctcatcgaggtggatgacgagcgcaagctccgcaccttctatgagaagcgcatggccacggaagtagccgctgatgctcttggtgaagagtggaagggttatgtggtccggatcagcggtgggaatgacaagcaaggttttcccatgaagcaaggtgttctgacccatggcagagtgcgcctgctgttgagtaaggggcattcctgttacaggccaaggagaactggagagaggaagcgcaagtctgttcgcggatgcattgtggacgctaatctcagtgttctcaacttggtcattgtaaagaaaggagagaaggatattcctggactgacagatactactgtgcctcgtcggttgggacctaaaagggctagtagaatccgaaagctttttaatctctccaaagaagatgatgtccgccagtacgttgtcaggaagcccttaaacaaagaaggtaagaagcccaggaccaaagcacccaagattcagcgacttgttactcctcgtgtcctgcaacacaaacgccgacgtaatgctctgaagaagcaacgtactaagaagaacaaggaggaggctgcagaatacgctaaacttttggccaagagaatgaaggaagccaaagaaaagcgccaggaacagattgccaagagacgtaggctgtcctcactgagagcttctacttctaagtctgagtccagtcaaaaatgagtctttaagagcaacaaataaataatgaccttgaatctt

SEQ ID NO: 481 - DNA, 797 bp, mus musculus; identical to SEQ ID NO: 480

SEQ ID NO: 482 - DNA, 750 bp, mus musculus
atgaagctgaacatctccttccccgccaccggctgtcagaagctcatcgaggtggatgacgagcgcaagctccgcaccttctatgagaagcgcatggccacggaagtagccgctgatgctcttggtgaagagtggaagggttatgtggtccggatcagcggtgggaatgacaagcaaggttttcccatgaagcaaggtgttctgacccatggcagagtgcgcctgctgttgagtaaggggcattcctgttacaggccaaggagaactggagagaggaagcgcaagtctgttcgcggatgcattgtggacgctaatctcagtgttctcaacttggtcattgtaaagaaaggagagaaggatattcctggactgacagatactactgtgcctcgtcggttgggacctaaaagggctagtagaatccgaaagctttttaatctctccaaagaagatgatgtccgccagtacgttgtcaggaagcccttaaacaaagaaggtaagaagcccaggaccaaagcacccaagattcagcgacttgttactcctcgtgtcctgcaacacaaacgccgacgtaatgctctgaagaagcaacgtactaagaagaacaaggaggaggctgcagaatacgctaaacttttggccaagagaatgaaggaagccaaagaaaagcgccaggaacagattgccaagagacgtaggctgtcctcactgagagcttctacttctaagtctgagtccagtcaaaaatga

SEQ ID NO: 483 - DNA, 17428 bp, mus musculus
acggaagccggaaggagtgtgggagacagttggttgctctggtttctcctggcggcggcgttagcgacgaagctgcctttggcagcatgaacccgctgtgaggcgcaggcttcgcggcgcggggggcggggggaagaggaggacgcctcggcgaagttctccgccatgaacctgaggggcctctttcaggacttcaacccgaggtgaggcggttatcccggcgacgccaggttggggcttgggttcgggtagcggctgggagcggcgcggcggccaaggcactgcagtctgagcacccaggcaccagcctgaggctccttatggctgccagctgctctcgggaaagctgtgttggcctcagagtctgtccatccgcttcttcctccgcaactggtaccaacccgccgtggcccaagttgtcgaggttggagaagtgtcctcccagagggaagcccattgatctccactcgtcctttttcattggtatttcaacttctctgtctcgatttattttttcttatttttcttctcaccgctccgcctgcccccgttttctatgccagggccatctcacttgaccctgacacccccagccaccttcgcacatgtttcctctagtttcagcatttgggattttccttggatttatgcctgtctgccgttcttcgcttatttgtcaaactgatgtctgagatactgaaattttagagtcgttgccagggtatggtaaatcttacataatgcctttgggggtgaacctgatcgcctccaacgcattttcttagccttctctatgtaagtttattcgcaggaagtagatattgccctgcttattttccagacttgaaatacctagtgggcagtgtggagaaaacactggctaaagtatataaatctcggtccttgcacttgtcaaactgttgtaaaagtgttccctctgcggcctgtgagctcccaaagcagaaaccacttcctggttgttcccttgcacatcacctcccacccatctgtcatatagtagacacttataaaacgtctttggaactaaactgagtcaagactgaggttgggcagtcaagtgattctctactttagtaagctgcaagaggagttcatttcactgatatttttcaagtccattactatttaaaaggaatatctgctcattttatttctaagtggtaagacacgcactcaagtaagctagccttcctccgtacgtgaggtcctaggctaggcgcttgcaatgcttggccgtcctagcctggaagcaatgggaatatgaacagataagtagctgtattgtgcactcctgaggatgccactttcttggctgtttgttggagacaaaggaactggggagagaagaggggactatttagagtgcagtctccttaagaatggtaaaattttaaaatttaaagcctcctctggcctgggtgctcttactgtctttgtgtttatagtctggccttgttccgtggtcatcatcaatggcattgagccttcttaacggagaggagttcatttagaggaactaccacagagccaaccatagcttttcttctactgctcctggattagggtttgtctataggacaactgtgttggtactgaagctggacaggtcttgtgtattttcattgtttggagagagtgacaagaaacagaaatagaggctgaattttttgtgttcttgggtaactcacttatctgtttcatctgtagaatgagtataattgctcacaaggctattgaacctgaattaatggctgattgcacaatgtgttacaaatagaaatcgtttattatgggacagatagtccagaagctgcaaggtgatctcccagttatctaagagttgtgaaagcaaaaatagtggtcctctgataacacccttagccagtttttcctttactttttttcccttccaaatactaaagtctaaaatttataatgagatacttcgaagagatttataatgatcatcaacacatttatttgtgcttaaattctaagtggaataaaatgcatctttccctgaaaaaattaaaagtcttttgtaccccaccattgtcctggttcaatgtcattagtgggaaggaagagtgttaccttctagatgttccagggatacaatggccaggtgatattaagaagtagatttttcttagctggcgatgtttcataaactgtggatgatctagtttataacactgtatcttaatcttgcaccatgctgacgaaagcctttcagacatctggagagcaaacttgggggggggtgttgacaggaaagcaccctgtgctaagacctcagatctgtgcttttgtctaattatctgtttctaattctgaaccagttcacacatggccctcttacttcaggactttatcatgctctgctcatttaataggacagctccttctctccttgattcaggtcccatttatcattgaaatatctgttcatttggtagttgctgaagtaagttgttctggcttcctcaacctggtccattcctccctgcatgtacaatctctgtagaatatcatagtcttctttagaggccttatctgtgctcttgctctttttctctgtttatttaattgatatttctctctcctactgaaattcaaaccatgtgaggctaaacccatagcttttattgtcaaaatttatatccatgagataatggctggcacagtattagtgaaatgaatgataactcaccctagcctgtaagaaccgtctagagctccttcttgtcaatgactgctttcttgctggtgtatgaactatttattttccctctctcttcctgtgccccttcagagtgtaactgttgtattgacaagctgggaaagaccttaacagtacgcacagggcaatgtgctttcttgactctggggaccattacagcaacagccattggtattgtctgctggctcccacaccatgcactgtgactccaggcctcctctcataccttgcaaatcttagtcactgagaattcactgcagtttgtcagttttctagaaatagtagtgacacagaatgattgaaaagtgtttagcacccagctgtgaagggctgatagctgaccctatacctatttccatctaccacagatctggttgatcacgaacttcttttcagaattgccttttagttacaaagttaaacttattaaaacatactgtgtctaccaagaatccttcttgactgcctgaagcctctaatagcttgattgactaaacagactattagaattgactaaacagaattggaaaactgattccagaatgtccctaggaggtggagatctcctccacctttaatacacggctttaataggcaacctgactatatcacaaggccttggataaagttgttatttgttagagaaggcccttcagccgttggtagccatactgcattggaagactgtgagaactctgtttagtctaccagctcattagcagtggactcctgatgggagggtggtccatctcttgggtattctagactggaacaatgagtaagaaatgccttactgggcttgtgtatgtggacatgtaatactaatgaagtaaattatgtttgcagagttcctgtatgctccatcttaagccattctttagtctttgtaagctgtgttttattttaattttttggggaaatactaatctgattgctggtaacctttcactaaaggcctctgcaggcaccaggtacatatgtggtatatagacatacaggcaaaatacccattcatataaaataaagtaaaaaatcctgaaaataattatttaaaaagaaggatgggtatgtactgcagaaaatgtgtgtagtgttttaaagataaatgatgttgagcttagggtatagttcagtgctatggcacttgtacagggcattaggtttgagtctccagcagagtaaaaatgacatcgtgttgattactccaagtactccttaaagattgtatttttcaaagcaggccactgatctgtcagtatgagtgtagtgtcagtattgataatgaattactgtgtgattgattgtacatctgttgttgggaaatatagagctactggttgtcagaatattgtcttgacttttactgattaattgttgttaatggctatggcttatttgcattcaccatgtgtcaaccctcacttggcagtttggttttcagtatccttactcttaacaatagccctacaaataagattgcagccacattttattttattttctaatttaaacacattttaatttattgattgtggagatacatatgacacactgtgcttatggaggtcagaaaacagctttcaggagtcagttctcttcttcctgcatgtgggtcctcaagttatccattaggccagtggcaagcgcctctagctactgacccatctctctggcctcagtttcattttagagagtcttggagttctctaaagtcatacaggcagttatgaaccactccaggattctaatccaggtcaggttccttctgaagttttttgcttcatccttcatgccccttcctcctgtgacagagtaaatccagtatactgaggagccattctagctagtttttggtcacattgacatcagatagtcatttgggaagagggaattacaaatgagaaaatgcccctcagcagattgcctatgggcaagctggtggagcagtttcttgataaacaatccatataacagggctcggcccattatgtgccactttctgccctgccctggctatgactttctatgattgctttgcttagtgatggttcataagtgtacatggtgagtaaattttcagataaaagtactgaattctaggtgtaggtgctgtagaactgatactatatgatccagtagtgagaaaagtgatcaccaaataaacgtctctctttaataatcctacagaaataatcggtagaacacttattatttccatcatgtttccacttaccgttatcttaatgaatcagtatacgaaatcagatgagataaatgctgtaaggatggttgagtgtccatcttctttacaatgatttgtttcctctgcattttgtgcatttgtatatattttttagtcagatgctcttaaacatttgtaccttaataaaacaagttaaaatttttactaaaacatttttctgtatggtaataaagttttatttagcctaagaggtgcagtccttttaataatttgtgaaaatatccatagtttgtcagctggagccagtctctaaagtcataaacagaagtatgtcacttaaagtatggtatatgtgtacggggctagcttacttgcattcatatagacctatatctatactctaggcaatagattttactggagaaacccaatggctctaaaaagagtccagctgtattcatgtaatttagaacttttatataatttatatatagtttttaaacattatttagaacagtttagaacttttatagttagagttttctctttggtgagtatccatatgtatatgtatacacacacacacacacacacacacacacacacacatatatatatattttagaaaggacagtagcttttatgcctggcccatggcacattgcccagtggtaatgcacttatgctgtgaagtcagatgtggatgatataactccattttaaagatacatctatggtttgaatatagaatcaaaattttgtgttttggaaacataattctcacattagtatttttagaaaaattactattttaattttgtatgagtctcttgccttcatgtatgtctgtgtaccactttgcattcaatacacacagatgaaagaagagggcataggagaactggagtcatagaaggctgtcagttgccatgtgagttctgggaacttaagctgaggcctctgcaagaacaaaaggtattcttcactagtgaggcatcttttcagccctttaaattaaaatcctaatggcaggagaggcaacttgagagattattaggataccatatacttgtattttaaaatgtcagcttcagaagcaggaaaaaacacagtaatttcatatatcttgacatctgggtacaaaattatttcatactccatgtgatgaattgggaagaagagccagtctacagtagattggtaaagcagtggtcaagtggaggaaaaagcactgctgtgcccaattttcatgggattggaataatttaggagaactaacaggtgagcctgattatttgttttagggtctctgtttctccaattgcctctggaaccagttccatggtcaccacttctctttttcctactgcctcaggcagatcccatactttcttttcctagctcccatctcactttgtccatactaccatttatacaaatgttacaccacattataactgtggctttctgtgtagacttctatcagaaaacccttggaagcaggagacttaattactcacttttgttttctcaaccccaatacagtatgtgttctacatggaacttttaaataaattgttatggaattagtgagtgtaaaatgtatttttaccttatcttatgtgagtattttgccagcatgtgtgtctgtgcatccagtctgtacaggatccctgcaatccagaagatgttgtaccatctcgaactgaagctgtagtcaatcattaactgccttttaggtcctgaaaactgcacccatgtcctctagaaaagcagctagtgatcttaactgttctcatctctccagcctagaattcatgacaagtctatgaactaaaatgtttctgttatttctcctcatttcactatcagatatttgtttaaaatgaactctttttcacattttgctttccttctagtaaattcctcatctatgcctgtctgctgctgttctctgtgctactggcccttcgtttggatggcatcattcaatggagctactgggctgtctttgctccaatatggttgtggaagttaatggtcattgttggcgcatcagttggaactggagtttgggcacgaaatcctcagtatcggtaatgctgctttataaaacccactggtctatatcttaagagaacaaaatcttgatggttctcactagagataacataaagtcaatttctttctatttgaacttttatgagaactgcagtccaacaaatattcctcatcaggattttgaaaacatagacacttgttatgtattttcttacagaacagtgttaatctggatggtttaatgcctagaaagcctacaggcgtagcaccagacacccaaatatagaattgttttgccataacagactaaaaagcacagaaacactctgtatctatagttctctggccatgtctaccaggcatctgacttgggtagtttacatttagaactaggctttcctttctcctgctcctctattcctgttagttatgccagggagtgaactcgggccaaaggctatgagtccctcaggaactggagactgaggtaaactaagaaccagatgttaaaaaccaaggtagagctttgggagtcatggaagttgtgacaacctagtgtggctggattctgtgggagttgcatcatttcctttctcaaagataagggacgagagaaaaggagtggaaagagtgagagccattagacatctacagcaggaagatgagtgcaggtattcctaataggacagtgagatacaaacagctgttcatgtgaaagaatataaaagatggggatacttcagctttaaaaattcttgatttaacaacttttaaaagatgctatagtttatagactgtataaagtgcatatctcataagcatgtagaactttcaaagagctccacacaacaaatactagcaaatgaaggacattaatgtgtgaatatgtcttttctttttccctctgagatcataatatgccaggcagtagtggcatacacatttaatcccaacacttcggaggcagacagaagcagataaattctgagttcaaggccaacctggataatagagccagttctaggatggccagggctacacagtgaaactctgtctctaaacacagagagagggtgggaatgaataaatgaataaatataatatttgaatacttatttttattattattcatatgaatgtatatcttatgtatgaggatacccatggaggcaagaaaagggtgatgaatccctggggctgagttataggtggctgtgagccaccctaatgtgggtgttgagcactaaattcaagtgttctacaagaatagcaagcagtctttaccactgcaccatttctccagcccttatctgtggttttatatctcttgtatatatctctctttttcctcccctcccctccccctcccctcctcctcctcctcttcctcctcctcctcctcctcctcctcctcctcctcctcctcctcctcctcctcctcctccttcttcttcttcttcttcttcttcttctgtgttttgtttgttttgtttggttggtttttttgttgttgttttggtttggtttttttggtttatcaagacaaggtttctctgtgtaacaggcccagctgtcctgaaattcactttgtagaccaggttggcctcgaatgcataaatacccacttgcctctatctcccaagtgctaggattaaaggtgagcgccaccatgcctaggttttatagctctttttttatgggaaaaattcagatatctagttcttgtttctcaaaaaaacattcactaattgattcttaaaagttatatgtaccttttcctcggttttgacatttttcaagtaagaaaaacagttgtgtttgtggctggctggttgtatggtgtgcacaaacacagttattcccttgtgtgtggtattcagcaggatgctagtgaagtctacaggaattgcctgtaaccttcttttctctttgttctagtctctagaatatttatcacccatagggcaagcgggtcacaaatctttatctgtattttttaaaaggtttatttatttattatatgtaagtacactgtagctgtcttcagacactccagaagagggcgtcagatctcgttacagatggttgtgaaccaccatgtggttgctgggatttgaactctggaccttcggaagagcagttgggtgctcttacccactgagccatctctccagcccccctttatctgtattttgaatgaacattataggcctttcaaatacattgtaaacatttttcattttagtttattaatagtttatatttatatttatacagctaattaaactaatatttgagcaaaacttttaactttctttttaatttacaggttttaattcattatcatactaaaataaagattaataaaagttattttattttatttgcatttaaagtagcacctaagaagattgccatatcttattgaatgtaacctacacttgcaggtgaagcgagaattatatttatagaattgcatgaaatatgatttgtctagtttttaattcagtgagaagtgaggatcttgagatgtggcagaagtaattaatacaataatcttagaagtaactgatagttgattaaagttaggaacctaagtgttcctgaatatttgcaagattattaaagataggtttaatttagctttttacttcatcttttgttttgcatatttacagttgaaagtcagaatgggaattgacttggcatttgctgtgcactattgtgggcacttggactgaggattctgaatgtgtttttttctttctcttcttcttccatccccctttagagcagaaggagaaacatgtgtggagtttaaagccatgttaattgctgtgggcatccatttgctcctgctgatgtttgaagttctggtctgtgacaggattgagagaggaagccatttctggcttctggtcttcatgccattgttctttgtttccccagtgtctgttgcagcatgtgtctggggctttcgacatgacaggtcactagaggtgagatttgtgttttactataatgtcagtcccttacccttcatcaggaacagactaatcattaactctagattgtggtttacaagagaacaaagaccttcagctttctcccagtgtcctgtctaataagctacctgtgtttgtcaatcctgttaagcaaccattagcatagatagaaacatagctacaaagagagagactttagggaatgtatccacatggttgtgaagctggcagcctacatctatagaatagataggcagcctggggactcagcaggagttgaccctctaggttgcctaaatttcctcctttccatgataaagcctccaactgtttgaatgagggctacttaccctacagtatttaaaaacttgatgctgtcaaagtaacacataccctagtatttaattcgatatcttggtaaaatagtccacctgaattgatacataaaatttaattgtctcactacctcataccctatgctgtcactccttagctgacctctagttgccttatcctgatttacccatatatttattttttaatcaagtatctatatatgtaagctctttaggcccaagaagagaacatatagaattaaattaaaatgctaagactagtaatggtaataaagaaatcaattgtggataatatttatagtatccttaatctgtgtcaaacatttggatgttcacctcacaaatagcagcaacttagtaaatatttacaacagcctgtgagagaggtgcagttctttttccaggcagacaatttattcatgaccacacattaaggaaaaaggccagaattccattttagtcagaccaaatccaaagccagagcaattaactagaaaggaactgaagccacaaagcaatatactagtagatttagaggagaatgggaagcagtagagggacctcattcaggagatagtgagctcacttggcgatcagttcaatgccaggtgcttctaggagagccatgtggcaactgcacactggacctgttattcagcagtacggctagcttgcaggcacatttcagaactaatcactaggcaatatgttaatctgcagtgttgctgaaactttcctccaccccagggagtgtgaatgagtgtgtgtgattcagtgaaagggatgtctgtctgaaatgctacaagtatagccatttacggagtggatagaacgggagcccaagaagaacttctctgagtgctcacagcatgccaagactggacaatatgactcttgaaactcagttattagtacaagaaggaaggagatccaccttaaaatgctctcaaaatagcctagtaagatgtagataaaagtattctgctgcctattagtattgagggccttggtaaataggagttgttggtagcttagaatggaagatgtggcaatagggccttatgcagttattcttgcctcacaaagctggaatgtacccaaaaagtgggttaggccaggagtgctgaatcacaggagatgtgaacttacttgtatttggacattttgggtttaatgggaaattggcaattagtttctgattgggaaagggcaggagcacagtcaggattaatgctgcaacaccgaatctacaactgttggcttaagctgactaggccctcaaagagctagaaaagaaggcgtgggatttacggcagagtcctggttagaagtagaagcaagttttagggtacctataaatcagctgtatactgattattagcagaagcagaaaggaggcttggaggaaatctattatagattgccccttttgtctttcttctttcaaaagaaggtcattatccggccaacattcaggtcttaacaaaacagccaaggcaccaaccagccttaagaatgaaacaagacacatgtgtgcaattcccctcatcaagaccccactgtgcatttccgttgctagaacagtcagaagcttccagcatcatatcattcaagttttacagtattcattgcttaggagtatgttaaacgaacaaccactatgttcaatgcagcttgtttaactgattctttcctttatctttagctagaaatcctgtgttcggtcaacattcttcagtttatattcattgccttaagactggacaagattatccactggccctggcttgtacgtagccttttaaaaatcttaaacaaatcttttattataaaagtaattcatatttgtgtcaaaaaatttggaaaaaaaagacaagcaagcatgagcagcagctactgatcacagtaccaaccctgggagctgacatagtagtggcctttactcccttgtacatggatagttgacattcatttctatccagcttttttattttaatataacttaagcatttgttcttaacaaatatcattgtaaagatgacacataaggcttcattgactcataagttgcatttatgaaacatgtctaaatgtttcagttgctgctcatatttgtgatttttaaatgtgcccgtttgtatatctgtgtttaagttttctaaatttgtaacgataccctacttatatatgtttatgaagaacagtagaacctttcattttgtgttttgaatatgtaataatcaaatcagtttcattaccatattacctcagatgtttatcatttattcatgcatggaattttcaaaatgctattctcttttagctattttgaaccatttaattattatcaatcataattattctgatgttctaaaaacattacaagattttatttttgtctccaacctctggtgtatttttgtgtataaaaaaaaaatccttgtttactattttaatgttttcttagaaagtattcaagaaaatgtattactgagttatagataatttttaagtttttgatattttattatttttatgtgtatggatgttttcctgaatgcatgtcattaaaacctgcaaatcagtgaaacattctttatacatggcaccaataatatgagccatgagatgaaattataaagttagacttcataaaataaaataaaataaaataaaggaaaagacaggtcactgactgaggaataggttttgcaaatatgtattaaaactttgacttctggcaaatagcacagagtcaataaaaaataaggacttactcatgtgctcagacccacacagacacacacatacacatagataattgagggagtcagtaactggtgttcaataactccgagtgagaataaacatacagaagtgagtgcttgagtaagtctgagtaaaggatatgagagcatatgtgagcaactgaatgagagggaggagggcgtctacaagggaatgccagaatagggctgtgggaggaagtgtgagggaaagttgacagaatgagaatgtagcagcgaagaataattcttagaggagcagctagacagagtgagcacgaggactatttgagtaaggaagtgtgtgaatgagggccatgaagaggtgaggatggatatgagagtaagtgtgaagaactgagtgtatgagagcgaggagtgaggaagatgcaagggaggaaaaggggattccactcttctggattacatacgtggggactcagtgggggtaggagagaggagtacatgggcgatcatgggtgagggagtgagcggggtgacatgagtatgtgaggggcagtgaggacatgagtgagcaggtaagtaagacgtgtgtatgtgtgagagtgaacatgtcagtaactgagttagggagcaagacactgcgagtaagggagtaggaactgagaatgaaggagtgtgtgagtgactgagaggcaggaagcatgggaatgagtagatgacaaaatggggggcttgagactgagggagtatattcagaagaaacttaaaatatgccgtgttggaggaccagatggcaggttgttgcttgaatggaagacagcctaatgacattatttcctgcatggaagtcctctggtgaatgtggtgtttcccatgctatctccatgacagtcctggacagtaggactgtctgtagtcctgcttccccttgactacctgaacagagccagcaaaatgataaaggcagctgccagagctgcagggaagctctcaagacatcgtgtttctactcctctccaggttgtgtgtgtccctctgtggattctcatgtccttcttgtgcctggtggtcctctattacatcgtttggtcggttctgttcctgcgctctatggatgtgattgcagaacaacgcagaacacatataaccatggcactgagctggatgaccattgtcgtgcctcttcttacttttgaggtaagctttctacaggaaatctcttgtgctcccacattctacctttatctgggacagcatctaccatagctagataggtacactgctgtccttctgggagagagacagagggaacttggaacaatgagaatgtacttgcaggactcacagagagcagtatgcctctctacccatgaggcatttggccacatccagcttctactctaaaaggatgttggactacccggttttgtattgagttcagtagggaatactagatataattgaacaaatttgactcctttgaacaaatcctgggaaggatttctcataaaactggcagtggggatctttcagcttgtagactttagtttgaccctgggggaggatgcaatatttcccatggtctttttttttcccctggatggatactatggtggccttccctcttctcagatatgacagagggagggattataatgggaacagttacacatttggttcattttatgatgatggattaataccaccttaactttgtctttctctagatcctgctggttcacaaactggatggccacaatgctttctcctgtattccaatatttgttcccctgtggctctcattgatcacactgatggcaacaacatttggacagaaaggaggaaaccactgtacgtccacaaactaagaaaccctgtgtgtgtgtggtctgcacatgtgctgctctttacaaaatgctaagactcagggtcctgaatgctcctcaatggaatggaatctttccaatttggtagagctagagtactgtgtctagattactctgttctatggcatgtgctttggcggtggtctttgaggaagataccattctcataaggctgtgagcgccacttcatataacccagagaactgcccaccttcccgccttggaagtggggagtgtacagtgcagtgcaggctgagctgttgtttttatcctgggagagccagcactaagctgacagcttattgaagcagcacagctcagtgacctagtttgaggggttcccatgaggtcagactcaactttggccaattccttcttgtgtctactcagatttcagatggttccaggagtccttagcttaaatatcactgcatcaccagttagtttaacctgggtctagaaaatgggaagaaggtgctatgctctaggttttgccagtatttgagaatccctttcctagtcagtggttctatagctccagcttctatctgaatcaatggctagccaggtaaagctgcactctccagcctacctcaccaatttttcaaccaggagctctgattacaggctggagaatgaccacctctcactggtgatgctgccagtgctagcctgggctctcactcggggagctgtggagctggaggtctccactcctgcttattgggcagttagagcctggtcaagctttacttgtgaggaacctgggtgaagtgatacatagtgccagtagagctccttgttcaggaaagctgtgtgatatgaaagcctcgagtttgaaagggaaaattcttatttttcagggtggtttggtattcgcaaagacttctgccagtttctgcttgaaatattcccgtttttgagagagtatggaaacatttcatatgatctccaccatgaagatagtgaggaaacagaagaaaccccagttccagaacctcctaaaattgcacctatgttccgcaagaaggccagggtagtcatcacccagagccctggcaagtatgtccttcctccacccaaactaaatattgaaatgccagactaaaggacgccaccagggccgccggagtgtgtgtgcactgagacacacactcctacttcccttgcccccaacctagacctggaacctcggaccaccatctgaagcctcgtttgcatccagtgtcaaccagccactcagaacagaacataggtggcagggactaagggtatcttatcaatgtggatgccagtgacacatgagcaaagaacctatttctttcgtatgggtacctgaaatgtgttctcattcctgtgatacccacccagggatgactgctgcctaggcccacagaaagcacatctgtggtctgggcagattttctagtgctaaaattcctatcaaagtattgaatgatgtggttcctctgggaccacttccatctgtggctcagctgtgctgcttatgggtagccagtagggactataagtaggtctgtacacacctgctgtgttcagatacagcccggccctgctttccttgtctctgctgtacagaaatttagctttagccaggatgacagcaggtttgcagggcctcatcagtgagcccttcccaatggcatgattccatgcctatatagtatttatacagctattttagcactgtaatatacagtgtcaaatcctagttctgtacagcatattctctgttaaagtatttttttacaagcttgtgctggagatggatgggttaagccatgggagaagcagatagctcagactgctgtatctcagtcagatgccccacctcacttaccatgcccactgataccctggaatttctgccagcacagctactacaatcaaggaaagctctgtgcttttccaacatggggtgtgggagaaatggcttaaaagcccaagaaatgcccccttgagaccaggacactagagaaggttgccaaggcaggccagaatcagccaggaactcctgcaaagtcgagagcattctgcctacctgcaagaagaacactgcatactgggcatgcaggtaccaccacctgtcagcagtttctccaggctctgctggtatagccagcccagaacccatcataccagaaaataaccttcagtctaaatcaaatgattcattcatggtcacctgatcagtggcttcagtcacacataattgaagtctctaaccctagtcctacccttggcacaggcctccagtgagcctgttctgtttcagaagaaaggggaagcagtgtagcattttttgtttggtctcttaaaaatgtggttaaatccactattttttgctcctgtagttcaataaagtggttcattttacatgta

SEQ ID NO: 484 - DNA, 12278 bp, mus musculus
ccggctccgcgccgcgcgcccggaaggtggagtttcgggggtttaagttactgataggcatttctcactgctgtgtcactcggggaggaggagacacgcacgccgcacactcacacaccctcacactcacggcgacgagcagctctggtcttaaaggagaagctgcgctgccctgcctgcgaccccaccagcctcgagccatgaaaggcagggttttcaaaccaagatgtagccacaagcagcctaagaactgatcgcccaagggaccttccaaatcctccagacactttttaatgaggaaaggaacaccaggctagaaacgcagtgacagcctcctttctctgttatggctactgatgcagctgggagagaccagagaagtggaaagagtgagggtacagttatctggaaggctcctttgcaggtgaagggtgggtggcttgtaccagcaaagtcaagtggcttgacttgactgtgccctgatggggagaaacaacagcagagttagaaaggaatcctagtcataaatggacagagccacccgagagccacagaagaccctgctgggcttggcggcaggggggggggggggaggagagccatgttccccagtttaacttttccaattagcttggaaatgaagcaagcgggtggctagtgagggttactgatgtacagaataatgagagtgaggaaaagccagcacttagctgtgataaggtgaaagaatgttccagattgaagacaggatgaaagacaaccaagagaaaagtgacaaagatagatagaaatgatgatgatgatgatgacgacgacgacaaggacagtggtggtggtggtggtgaagcaagcaaagagggagggagaccccttctcaaatatcagcagagcttgctgctgaaaccagtgctgccagctccctcctctccttcaggtaagggcactcacctgcaatgggtggcagatgcactggcggctggcgactggtctcactctccatgtagggaggcaatatgtctgtaggctcagcaacagctcatacctggatggtcaaacaaaccgaccagcagtgactagcccaggagggacctagcctctcaaaggtcagctattaacctacatgtcaccgccccaaccccgctccccgccccccacccccagcgaacacgcgccttttccctccttagtgttcctatccttaccgccccccttctcccacctcctgtccttagctcagaggctggttgttgtcctggctgccagtaagattatcccggaactcagaagcgctggtcacagtctctattgactcttgctttctctgggtccagggctagggaagaccatgctagagctaggctggactagctgctatggtggagttgatcacaggaccatcacctgtggcttttgcagagctgtgagttccttgtaaactgcccggtggatggtggaccagtgcgtgctctttacctgctcaggctggagtctctctctctctccctctccctctccctctccctctccctctccctctccctctccctctccctctccctctccctctccctctccctctccctctccctctccctctccctctccctctccctgtccctccccccccctctctgtccctccctccctccctctccccctctcctccctggtagtaggctgcaccccttctttaaggtacctgacccaggcacgttactaacctgaactttccctggtggtagctgcagcccttgctgcagtagcagtagggggatgtgtaactactcccacagttcagctatctgagctcctgcaggtacatgccgcttatttgcctgtttgagggagtccagggccataaaagggtggggctgccacccactcagccccttctttcatcccctccctagcccaaaaacctaggctggagggagggggatcaaaacttctaaaatcacaaaaaatcccctggtgggcttctttggtgctacatagcagagctgtctcttctaagctcttaaggaagttcagtggtgacctagcttgtctgggcccaaactcaaggcacagatgctagatactggaggcatgaagcatccagtgggcgaagggggtacattcctcagcctgcccctttggtaggaatacgttgtagctgggtccagtcctttcttctttggacctgcagttgccagcaaaggctatggattactagtgagtcagtctagggtacccaccctcggggtttacatagaggagatttcacccaggactcctatggctgagagagcttgaggatctatctcttaaagagtgtctgatcaaaccgagttaaaaggaggatagccaaccattgtggggcattgtccaagggatttgtcttctatcttttaaataagctgtagccaagaaggtagaaagtaaagttctactcctggtgatataccactcaagccccaagtcactctgcttcccccagaaaggaagggatgactattctttcaatgtgtcttgggatatacagatcacagctgtacctgtcctaaagctaactgcctggcactactagttatctaaaactacacatgaacccaacttagccaggctcctgctggacccttagcatgtttagccatagctcaagatcaaagctcaaggccacacatttccttggaagcttcaatggttcttttctttcagccatactccctatctagccccacagaaattctgacttcaaaacaaagctacaatctcaatcttttctgctcctctgtggatatcatgtgcttcctgtgcctcctgaatctcctattggctcactccaggggcaagcttgcctgggccctttcctctagtagacccctctgctttctgctatgcaaaatgctgtattggctccccacagcactgtacaaaactgaaggcttctcatggcaacatgggacacattatcctacctcctccattaccatgaatcaccctgaaagagcctcctgatccttcttcaacaggctaggtaccttctcaccttagggcctttgcactagctcttctctagggctggaattcacttcccctagacaggccagctccctcatttcctttattcttgatataaatgtcacctggccacactgtttaacgtttcaaagtcctacgcccatctctggcacttcctctccctttccctgctttgttttctccctagcactcagcagcagctggcctctgtaagttacatcccagtagggcagccctgagcctgctttatgcacctctggggtgtccactctgactggtatgtcatctctactgagtgactgttcatagattctgttttcctggagctttctaggaagctgggggaggggaggctggccacaggattgtgcataccctagaaaagagacacatagctgtcattacatttttcaggaggactatggcctaaacaagtgttaagaaggatgaagattaagcaaagagcttgatgttagtaccatggaaccttattgtcatcaagggacacttgagcccagatacataggtgactgtcttacaagtaaccataggggtacaatgagtacttctatcagttactgttggaaacatgggttcattatgattgtcatctagggtacgttcaaggttgattaaaaaggagagcgttgcagggcatggtggcgcacgcctttaatcccagaacttgggaggcagaggcaggcgaatttctgagttcgaggccagcctggtctacagagtgagttccacgacagcctgggatatacagagaaaccctgtcttgaaaacaaaaaaaaaaaaaaaaaaacaaaaaaaaaaaaaaaaaagaaagaaagaaagaaaaaaaggagagtgtctttctcttcactaagtagatgagtgaagacaaccagggttcttttgtcactcacaatgcagtcctgagtcttaagctagcagaatatttccatccattttcctagatactttctttgccttacctacaggaatatatgtgtcatgttgtagataatgaaatgctggcttctgaaacataaaggcatgcactcagtagcacacatcttacagtggcagagcacaaagcaattttatttcaaagctaggtaggtgtgtggcttagtggatacagtcctggcttatgagtatacatacacacagagaggaatcccatagaagtctcaaggaactgggaccctcaccaccaggaagctcctggctctgctactgagaggctgtcaaagcctcaagaatgagctattggagtccagaggctctatgccaaggcatatataggccctgccttaggtttgacccaaacctggaccttcatggatttgaaaacaatcagtagccatccgttattcagtcaggttcctgtgaacacatgccaagtgtttgaaagttcacatgacaaatggtgcggggaggggttaactgggtagcctctggaattctgttttgggggtggggctgcccaggtagagcccagcaaggagtcacatgttgactaaaaattgggaaccatacctggttgctctgtccatcttccctcttttcttcccttgcgttttacgaatcctactgctgatggcactaaatgcaaactgtaccatctcctgagtctcccagttttgtttgtttgttttctgtaaaactaaatcctggtggtagtttctaccttgttttggaatggtcaagttccctcatgcctgtgggacacccttggcagggaactcagctgttatgatttgaatctgaaatttcctccacaggttcatggtttgaatgcttggtccgcagttggtagtggaaactttaggggatcgggtctaggtagaggaagtaggttactgtgtggagctgctagagatgtactatttctacttgcttactgactttctctgcctcctgttcagccacaaagttaatcgttgtactctgtcaaacattccccctatcttgaggtcccacccaagcacaaagggacaaacaacctctgagtgagttaaccctaagctaaaatagtcttaaaagttgtttttgtcactcatttcatcatagtaaacatgaatggagctaagacactggcctagagcttattagccatcaaataagaaggggtgctgttgtgattattatcctaaactcacaaagagtcgggagactggggttgaatccaacaaaatgcagcacattcaagtgacaactcagactctggctggaagtccaaacccctgatgatgcctggcttctttgcaagtgccctggatatctggaaaaaggtgaatctatgccaggtgaaaaggcagagtctagcactatggtggacatctcctattactacagtagaagaaagtccttaggaaatgaattgaattctttctcttccctgaggtcttaagcaattttaattttctcttgaatgtcgttaatagtaagcatttctaagaaacacagtggaaacaaataggaaatagttaaaatattgattgtaattttctggctactcctccgatttaaaaaaataaaacatttagctttttattaaagtctacattagcaagcgaacagttaattaaggagctgtagaatagcttgcattgatttcaccgtaaagccaggaaaaggtggctaaaagtcatttttccttctagtccttgcttaccatgaatccagcttcccagattgccataggtaaatcattaaagcccagataaggatgggaaacagcctttgaaacaggcatgggtaaacaatttagggaattaacatagaaccagatggctggaagctatcctccagcaccatacagaaaactgaaagatattgttaaagcacttgtgtagacaaaattatgcagatggcttactaattattgattttcatgctatgacattttctccaacagcgcaggcactacacaggccccacatgggaagacgctctttctagtgctgtaggacccttcagaccattgtgattttgtgataaaaaaggaaacaaaacagcacaacactggtctgtggctgtcttggcaaccagctgagctgctgctgccccatcatcataaccgtgcagaaggttaatatgacccaacatcgggagaaatattgatcaagaagtctggagagaaaatccagacatggtgccccagatgacccaaggcaaatcacaaccagaaggagatgaagctcagagccttatgcctctcagctggtgagctcactgagacccccaacagcttatttcagaagtaagcaaactgaagctcacaaagattgtcaccatggaggcaagatttgaatgtactaagcattgtgggatagagcaggctcaatatcacttggttagcaaagctccctggggaggagatgaggaaagtgtcacatttcacacataggctctgtgcctggtgcttcaatggctggcctgccttggcttatgacaaagggctctcccatttgcagaaattttgccatctcattgattgagaccttggtagcttgaaattggctgtagtagaaatagttactccaagaaatggacatttgctacaaattagagtaggctggtaaacaccagctaagcagcactgatgagtaactgtggcctggaccagtttgctagcatgtgaaatggagaaaacagtagtgatcatcacatcaaagcattgcagtattgaaatacaataatacattcaattgcttaggacagtaggaccatgggccatacaggtctgtgaaagacccaatatacagcgtgtctctggaagattatactggagctgacagttaatgtcacctagaaacatcaaaatcagcatcaacactggttcagctccttgtgtttggggtgatgtgcaagcaaatgtactgtattgccagacatagcaaagtggagaaagttaaatatagtataaaatatttgatactacgtgattggacatttattatattttttgagagggtctcatgtggttcgggcttcaagctttatatgtagccaaggatgatcttgactttatgttctgtgttcctgttttccaagggctaggattgcatgtgtgtatgtaccaccatgtctgctttgcatgtggtgtttttggtctatccaagggttgtgtgcatgttaggcaaacatttcacttaaatctatgtcctcagctcccatttctcatacttttaattgctagtttagaatgtactacttataaaaataacagtttactgtaaaaaaaaatctgtcacattatagcacttcatggttttgctgtttttcccaattcttgatggcatcattttctcttgtgtttgattttatgctgtgatgattgtcatggccttagggacaacacattatatcgtatatccgtatcatattccttaggggattaggcgatataggtctgtgtaagtacatttcataatattagcagattgatcatattgcctaacaaggcatttcttaaaatgtatctcagttattaaatatcacatgattatgtaagtgatcagtttgtgctacttgtaaaaaacaagtatgccaccactgttattaaatactatggtaattatacttaggtggtcatgcatttcttttagattggtggttctcaacctgtgagttgtgacccctttgcggtcgaatgaccctttcatgggggtcacttaagaccatcagaaaatacaggtatttgcattataattcataacagtagcaaaattataattatgaagtagcaacaaaaataattttatggctaggggttagcacaacatgaggaactgaattaaaactgtattattctataaactgtattattaaagggtcacagcattaagaaggttgagaatcactggtcaaagtaacaacatcccaactagtctccctagcttcagttttgtctcttccaaagtagcctttcatagatactttgattaattaatttttataatactgatctttatctgcttaaaatatatcaatagcaactcattacctttcaggctaaagttccacctctttatttaacatgtatactccatctaatggggtccttttgcaaaataccaaaatctcttaattttctaagacttctgcaacaaaagtaatcaagtctggggtggggtgggggtttccacggttttagaggcttggtccatgagaagaaggtagtgttcaggtcaattcattccaggtctgcaaggaagaatctgcttcacatccctctcctggcttgaagatggctagattctccctctgtctctctatcctttttcttcaaaattcatctgtgtgttcacatttcccatctttataaaagacacaagaaatactagaatttggtaaggactatccctactacaaataggttcatcctaactgactacatatctaatgacgctatttccatgaaggttatatgcttaagttctgaaatgaggttagcagtgacaacttatgaagaggggaggcaaaattcagtctatactgtcctaccccttggttctcaagagttaatgtctttcttataaagcacttcattccaacatcttccagagcctcacctatctctcttagtcctaacttttgtccaaatgtcatctcaattaggcaagggtgagatttggggtacagtttacccatcctggacatttgttaatctgtgaagctaagtagtaagttacctgcttctagaatgtaaaggtaggacaagcataaggcggcctggtcagccatcattgggaagagaggccccttggtcttgcaaactttatatgcctcagtacaggggaacgacagggccaagaagtgggagtgaggtgggtagaggagtgggggtggagggtctgggggacttttgggatagcatttgaaatgtaaatgaagaaaatacctaattaaaaaaaaagaagtgggaaggacaaaagaggtgcttgcttgtgagaaagtctaaaatccagtaggtcaggtctcatcccatttcatagtttgagaaataacttctttgactttatgctctgccctccaggcttgtcctcagccttcaccaagacaacccacgcgatggacacagcaaatctcaaattgttctgaagcaggctgttcttttatacatccatgctgtgcacaagttgttctctccaggcatcaaggggcccttctttctcagataactgtgtcacataactgtaattattgagtcctgggtagagccttagttccacatcctagaggttttctttgaccccttccttcatctgccccagaagaaagagctccctggtttgtgaaaggtacttctagtacctgtgcagttgtcagggtacccactatcctgcttaaaactcctgctccctctttagaatgggtgctccttgaatttaggtacaagcaggtcttgatcatgtcttggttacaaaggactgggtaacttttaatgcttcattatctcagtggtttgacaaatgcacaaaggaacgtttcctgaatacctacaatgtatagagtattagacttagattttccattcgtgtatagatgagggagaatgtaaaattatatcactcattagagacagcttatgccaaatgcttgagatctggaggggacctcctagtcataggtattaacacctcacagtttttagcttattgcacaatgatgctgaccttatgtaagagaacagtacagtgaaaaagcatatctacaaactctaggctttagcacttagaaaatatgtgacctcaggtatacttacccttcctgggcttctgtttccttagatgtaacatggggctacatcacaaagttagtgtggaaaactcaatgtgttcatagctgccaaataatggccattattcagagataggcataacttgactaggcattccagtgcctactgctgctgaatcctgcttgtctggcctagaacaagatttcagaaaagcatgtttcattcttgtcttgtccatggcatgacttcagtaaacacttcaatgcatgggaagtaggtgaatctctaaatggcaagtggtgccaggtgtgaagtaatggcaagatttatggtctggaggcgagtaccctgggttcttgactctgtttttccttatggaccaagacctctgtctttctggctttttctcctgagaaagaagcaggtgaagtcagaagatacttggattcctgtgcgcatactctataattagtacctcatcactacgttggtgacttgagattgggattcaggaaagcctttgtgcttctgagatttttttgtcaaagcacttgcaaagtggcagtatacgggaaattccaatattgggcagtagccaagaggaagtgtgtacgcaccttacatgggactgaaatgtccctatggttcagagaaaggagattcagagaagaaggtaaaatcagtgcctttgctgcagccaaatttccatctcaatgctgtgtgcctgcaactttatgcccagtgctagattaaacaggttggcatcacattgcaccggaagcaaagcaaatgggttgtagtaatcaaatcttctggactgggtaggtggcaaatgcctacctagctaagaggaccttggttcctgatctgagagctgtgaaaatcccgctttgagagggtgtcacactgacaattgcactgaccatctagaaaggcttctgtttactgtttgtcttgctcctgtccctatccttgacccatagatgttcatttcacttcctggcctgtctgtgaagtgacagccacacactggcttcctgttcttaaagagtaagcatggcaacatgccatctcacaagaaaccctgagctgggctaccccgagaacttctgatgactaagagagtcaagaaataaaccttacgaagcttctgcgagccgaagcccaggctggagggtcagagcagaagccacaagtctcttcagcagggtaaacagcagacagcatttcctaccctcgacagagcctggaactttctgtctcctgccaaacttcatgccaacgtcacttgctctctactcagggcttgtttctattaatgaaatggtaatcctgccagtgtagcattacttagcgatttattagtgattattgattttcaattgtgctttcccagggttgtgggatggagcaaatcaaaggtgtcctgctatcggagttctatcaatttgcttgaggccagagagctcagccgaaagtagctcatctatgaccaaccgcacctggagatgaatgaaatggggccttagaaagggtgtgcactacaatgcaagctactctatcacttgacctagggacaccctacataaaacagtgcagaaagttttgtgtggagtatttgacaaactgcaagaaagtcaagatgaagcctcccaggattttgcagcatcacagttcttgtggcagaacattgttctcttattataagacacttcctgagtgtctactaggcgctggtagagaattagtgcttgactatagcaccccaagtacaagattgtaattgctcattgcaagtcagataatcaaacacattaagttataaggtcagtcacttaatattaacaatctattgtattagaaaaacagaattttcactttggatacaagaaagattgatagggtcaagtacattatagaagcaggtagacatatgccacctgcatttgttaatatatctcacacttatgactttttgaggttttcctatggccaacttatagaggaaagaataatttgggcttggttctcagataaattagtatagcaaatggatgaaccaagatccatcgttattatcacattccagtctcttttctgaaatggcctaaaggagagtggtaaagtgaattacccttctggggtagcattgaaaacagaagtgttggagaccaactagttatagaaggagaaatggtctctaaaaggatgctccactggacagcagtgattggctagcatgctgtcatagaacagattatacctatttcttcaaatccacaggcccaagccttaagctttaatacctgagaacatggccttatttggaaatgtggtcactggtcatgtaattagttaggacaagctcattcaggagtaatatgggccctgactcaacgtgaaaaatgtcattataaaaaggaatatcgggcacagatgcaaatttagaagaaagacaatgtaaagagacacacaggcataagatggttacctatgagccaaggagaaagaatgagag

SEQ ID NO: 485 - DNA, 12278 bp, mus musculus; identical to SEQ ID NO: 484

SEQ ID NO: 486 - DNA, 3613 bp, mus musculus
cgctggccaatcaggcggctctcgtggaggcagctagcgcgaggctggggagcgctgagccgcgcgtcgtgccctgcgctgcccagactagcgaacaatacaggtacgactcgcaccgccctcgcccgccgccgccgctcctgcagctgcagcggcgcccgcacaactttccgcccgcgcctccgcgagcgcgccgctaccactctggctgtctccactcccgcgtccttgccgccccctctccttctctgctgctaggtggccaagaaggaagacgcaattcaggtgcctcaacttttccagtgcctgcgctccagcctgctgcttctcaggtctcggccctctacgtggagccgcgctcggcgggcgcccccaggggcagcagcctggcggctcggcagcccctggccagatgttccgcagctgcggtagcgtggcgagcgagaggcggctgcgggctctggcggcgcgcgtcccggcgacggcgggaagggtgctgggcgcgccccagcccgggagcgactccgcagggagcggccgtgcggctggggacagaggcgcgggcaaagttcgcgggaaggccgggccggacacggtgcgggtccgcgggctgagccggtggctctgcgtgaacatggccgtcgcggagcgcccgggggcgggggggctgggggcaggtgccgcctgcgcggcggcgggaggagtacggttagtgcggactcaggcgaggccgccaagggagctggcggcaggctctgccgcggtgctggacagcattcggggccgggggcgctgccgcgggccccgctgcgcggagcgtcatggctgcacgggcgcctttgttatcccgaagagtgcggcccgcgtcgggggcggggaggccgggctggcggctccgcgccctcgggctgcccgcgtggggcggggcggggcggggtgggggccggcgagcgggcgacggtggcggggcccgggccgctttgttcaccgccgtcgccgcctgcgccggccgcgcgcggatcagccattttagtgagcggggctcggaggcgcggcgaccgcgactgtcgcccgccgggccccacgtccccccccccttcccccgcgccgccgccgcccccggcaccgcgctcggcccgggggtggcagcagcggattttacagacactttctttcaccccgaggctttggacaaaatggaaggtgaattatgggtgtccggagcaacggggacgtggcccgacacgggctgtctgctgccggcctggacgcccgggtgcgggggcccgccccacccgggataccgcggctgggctttaattcagccccgcgggcctttgatgccaaggggaatgctttagttttacatgatgaccttgggtgtgggaaaaggaaaagatggcgggaagcgggcgggggtgggggggacagggaggatgacacgccacagctgcattttatttggaaactttggagaaagtgttcctggttagacctgcattactgcattacacaggggaaagactggtccttttgatgtcccttcccccttttcctggtgaagaagtgacaggtttcaagtattattatgaagatacctgcttgctttacagatcacgagcattctaaaaagccatttttataaagcagatatatcagcaaccctggcatttcacatctgtttcaatttacgtttcctttgatttcccatttaaacgtaagaattaaagggacaatcacctagctgaaatgaattctatctcctgttacctaccctgtctacaaatgtgtcttcccattagttctttatagacctttgattgtagaaactacagaatagtagcagttcagtaatgtgcagtgctcagcaccccaccttatgttatccccatttggagaacttagtgatcgctctagagaagtaacttgtaaaccagcgcgcttcatgctggtcaaaagttaaatgacaagcaacagtgaagctgatttcttcctccgcctagcctactgctgccaccggtgtcaggagctgggggacgagaggtcctactgagaaccttaagtgggctttgcccttggtttctcttttacttctcatctgttcttcatcgtttttttcttctctttgtcttctatgcatacatcagtcaggatggctaaaggtgaccccaagaaaccaaagggcaagatgtctgcttatgccttctttgtgcagacatgcagggaagaacataagaagaaaaacccagaggttcccgtcaattttgctgagttctccaagaagtgctcggagaggtggaaggtatttgggtctttgactcgtaggctagtgcttgcatttcacatttgggatttgctcacttgcacatttgccccaattggttggctggtttttttttctctgcattaaaaattaagtacagagcgtttctttcttcttgcaagggggttctatagcttccacctgaattacaaaaccattgggttccattgcatctaggaatttaataaattctgttttttgcagaccatgtctagcaaagagaaatcaaagtttgatgaaatggcaaaggcagataaagtccgatatgatcgggagatgaaagattatggaccagctaaaggaggcaagaagaagaaggacccaaatgcccccaaaagacctccgtaagtgcctataggatatggaataacagttgaaagctttccttttgcttgaaagaaccttaaaacatggtgagacagaagcttctaaatactccactttggattcagagcttgtctatagttaagatttcattgggattacagaggtagccacctggtccttcctacttatatacaccagagcccttagttgtattacttttcctttaacaagcaattggaagagaaagacacactgtactttgcatttagtgaatgttctaaactcttctgatgtagcattgaatgcagtgattctatgcctgagaggagaaaccatggcaagaagtcgttatatttcctggtggtttatttatgcatacctaccttatatgtaaacctagcacttgggctggacaattcgggatggaaattttaaatcgggcttgtgttacatagatagctataagaagaaagggggtgtatagactctagattttttttttggtacgtactttattgatttatataaatttctgtccaaaggtctggatttttcttattctgctctgaattccgccccaagatcaaatccacaaaccctggcatctccattggagatgtggcaaaaaagctgggtgagatgtggaataacttaagtgacaatgaaaagcagccttatgtcaccaaggcagcaaagctgaaggagaagtatgagaaggtaagggacggggctgaagctttcctgtgtggtgctgctctgctggaggagactggccggtgctcaccttggtgctgaggtccagttctccttaagatagcaatgtgtgctgataattttgcttctgacagttctctcaccctcccctcattaaaccccactcctctatttaaaactagaactgtaaactgctccctacccttagtggaggaaggctttgagttcttaacatgactgaaagaacac

SEQ ID NO: 487 - DNA, 3380 bp, mus musculus
caggcggctctcgtggaggcagctagcgcgaggctggggagcgctgagccgcgcgtcgtgccctgcgctgcccagactagcgaacaatacaggtacgactcgcaccgccctcgcccgccgccgccgctcctgcagctgcagcggcgcccgcacaactttccgcccgcgcctccgcgagcgcgccgctaccactctggctgtctccactcccgcgtccttgccgccccctctccttctctgctgctaggtggccaagaaggaagacgcaattcaggtgcctcaacttttccagtgcctgcgctccagcctgctgcttctcaggtctcggccctctacgtggagccgcgctcggcgggcgcccccaggggcagcagcctggcggctcggcagcccctggccagatgttccgcagctgcggtagcgtggcgagcgagaggcggctgcgggctctggcggcgcgcgtcccggcgacggcgggaagggtgctgggcgcgccccagcccgggagcgactccgcagggagcggccgtgcggctggggacagaggcgcgggcaaagttcgcgggaaggccgggccggacacggtgcgggtccgcgggctgagccggtggctctgcgtgaacatggccgtcgcggagcgcccgggggcgggggggctgggggcaggtgccgcctgcgcggcggcgggaggagtacggttagtgcggactcaggcgaggccgccaagggagctggcggcaggctctgccgcggtgctggacagcattcggggccgggggcgctgccgcgggccccgctgcgcggagcgtcatggctgcacgggcgcctttgttatcccgaagagtgcggcccgcgtcgggggcggggaggccgggctggcggctccgcgccctcgggctgcccgcgtggggcggggcggggcggggtgggggccggcgagcgggcgacggtggcggggcccgggccgctttgttcaccgccgtcgccgcctgcgccggccgcgcgcggatcagccattttagtgagcggggctcggaggcgcggcgaccgcgactgtcgcccgccgggccccacgtccccccccccttcccccgcgccgccgccgcccccggcaccgcgctcggcccgggggtggcagcagcggattttacagacactttctttcaccccgaggctttggacaaaatggaaggtgaattatgggtgtccggagcaacggggacgtggcccgacacgggctgtctgctgccggcctggacgcccgggtgcgggggcccgccccacccgggataccgcggctgggctttaattcagccccgcgggcctttgatgccaaggggaatgctttagttttacatgatgaccttgggtgtgggaaaaggaaaagatggcgggaagcgggcgggggtgggggggacagggaggatgacacgccacagctgcattttatttggaaactttggagaaagtgttcctggttagacctgcattactgcattacacaggggaaagactggtccttttgatgtcccttcccccttttcctggtgaagaagtgacaggtttcaagtattattatgaagatacctgcttgctttacagatcacgagcattctaaaaagccatttttataaagcagatatatcagcaaccctggcatttcacatctgtttcaatttacgtttcctttgatttcccatttaaacgtaagaattaaagggacaatcacctagctgaaatgaattctatctcctgttacctaccctgtctacaaatgtgtcttcccattagttctttatagacctttgattgtagaaactacagaatagtagcagttcagtaatgtgcagtgctcagcaccccaccttatgttatccccatttggagaacttagtgatcgctctagagaagtaacttgtaaaccagcgcgcttcatgctggtcaaaagttaaatgacaagcaacagtgaagctgatttcttcctccgcctagcctactgctgccaccggtgtcaggagctgggggacgagaggtcctactgagaaccttaagtgggctttgcccttggtttctcttttacttctcatctgttcttcatcgtttttttcttctctttgtcttctatgcatacatcagtcaggatggctaaaggtgaccccaagaaaccaaagggcaagatgtctgcttatgccttctttgtgcagacatgcagggaagaacataagaagaaaaacccagaggttcccgtcaattttgctgagttctccaagaagtgctcggagaggtggaaggtatttgggtctttgactcgtaggctagtgcttgcatttcacatttgggatttgctcacttgcacatttgccccaattggttggctggtttttttttctctgcattaaaaattaagtacagagcgtttctttcttcttgcaagggggttctatagcttccacctgaattacaaaaccattgggttccattgcatctaggaatttaataaattctgttttttgcagaccatgtctagcaaagagaaatcaaagtttgatgaaatggcaaaggcagataaagtccgatatgatcgggagatgaaagattatggaccagctaaaggaggcaagaagaagaaggacccaaatgcccccaaaagacctccgtaagtgcctataggatatggaataacagttgaaagctttccttttgcttgaaagaaccttaaaacatggtgagacagaagcttctaaatactccactttggattcagagcttgtctatagttaagatttcattgggattacagaggtagccacctggtccttcctacttatatacaccagagcccttagttgtattacttttcctttaacaagcaattggaagagaaagacacactgtactttgcatttagtgaatgttctaaactcttctgatgtagcattgaatgcagtgattctatgcctgagaggagaaaccatggcaagaagtcgttatatttcctggtggtttatttatgcatacctaccttatatgtaaacctagcacttgggctggacaattcgggatggaaattttaaatcgggcttgtgttacatagatagctataagaagaaagggggtgtatagactctagattttttttttggtacgtactttattgatttatataaatttctgtccaaaggtctggatttttcttattctgctctgaattccgccccaagatcaaatccacaaaccctggcatctccattggagatgtggcaaaaaagctgggtgagatgtggaataacttaagtgacaatgaaaagcagccttatgtcaccaaggcagcaaagctgaaggagaagtatgagaaggtaagggacggggctgaagctttc

SEQ ID NO: 488 - DNA, 4551 bp, mus musculus
aggcatagaggaaggtggaggcggagaaggtggaggggaaggtggaggcggccgggaaggtggacgccaccgggaaggtggagacagcagggaaggtggacgccaccgggaaggtggagatcgcggagggtccgggccgcggggctgagctcaagctggagctggagcaggagcccgagccggagcccgagccggagcccgagcgggagcccgagcgggagcccgagccggagccggagcgggagcccgagccggagccccagccagagcccgagccggagcccgagcccgagccccagccggagccggaacccgaacagaagccggagcccgagccggagcccgaacccgagcccttacaggagcctgagcctgagcctgagcctgagcctgagcctgagcctgagaggcagcccgagaaggagccgaaggatgagaacccagcgcagagcggtgttggcggcagcggcgacgaggttcctccccccacccttccctccgaccctccgcggccccctgatccctctccgcgtcgcagtcgtgccccgcgccgccgaccccggccccggccccagactaggcttcgtaccccgccgcagcctaggccacggcccccaccccggccccggccccggcgtggtcctgggggcggatgcctggatgtggattttgctgtggggccaccaggttgttcccacgtgaacagctttaaggtgggagagaactggaggcaggaattgcgggttatctaccagtgcttcgtgtggtgtggaaccccagagaccaggaaaagcaaggcaaagtcgtgcgtctgccatgtgtgtggcacccatttaaacagactccactcttgcctttcctgcgtcttctttggctgcttcacagagaaacacatccacgagcacgctgagacaaaacagcacaacttagcggtagatctttattatggaggcatatactgcttcatgtgtaaagactatgtgtatgacatagacattgagcaaattgccaaagaagagcaaggagaagccttgaaattacaagcgtccacctcgacagaggtttctcagcaacagtgttcagtgccgggacttggggagaaatatcccacctgggaaacgaccaaacctgaactagaacttctggggcacaacccacggagaagaaggatcgcctccagctttaccatcggcttacgaggactaattaatcttggcaacacgtgttttatgaactgcattgtccaggccttgacccacactccaatactgagagatttctttctctctgacaggcaccggtgtgaaatgcccagccctgagttgtgtctggtctgtgagatgtcgtcgctctttcgggagctgtattctggaaacccatctcctcatgtgccctataagttactgcacctggtgtggatacacgctcgtcatctagcagggtacaggcagcaggatgcccacgagttcctcatcgctgcgctagatgtcctgcataggcactgcaaaggtgacgatgttggcaaggtggccagcaaccccaaccactgtaactgcatcatagaccaaatcttcacaggtggcctgcagtccgatgtcacctgtcaagcctgccatggtgtctccaccactatagacccatgctgggacattagtctggacttgcctggctcttgcacatccttctggcccatgagccctgggagggagagcagtttgaatggcgaaagccacatcccaggcatcaccactctcacggactgcttgcgaaggtttacaaggccagagcacttaggaagtagtgccaaaatcaagtgtggtagttgccaaagctaccaagaatctaccaaacagctcactatgaagaagttaccagtagttgcctgctttcatttcaaacggtttgaacactcagcgaaacagaggcgcaagatcactacgtacatttcctttcctctggagctggatatgacaccatttatggcgtcaagtaaagagacccgggtgaatggacagttgcagctcccaaccaatagtgcgaacaacgagaataagtattccttgtttgctgtggttaatcaccaaggaaccttggagagtggccactacaccagcttcattcggcaccacagggaccagtggttcaagtgtgatgatgccgtaatcaccaaggccagtattaaggatgtgctggacagtgaagggtatttactgttctatcacaaacaggtcctggaacctgagccagaaaaggtgaaagaaatgactccacaagcctactgaagcaccacacaggcctacctagaatggaagatgacaccagtactacaccaggcatcgagatttaattgatctatgtgactgaggccgatgggccttgctgagtaagaattgaacagtatccagtgtcccaaaaagtcctgatcagaagagaaataaataggaggggagggagaagaggctctagcctaagcagtcatgtgaaggaaattaagtggcaggagtgttctggatggggaagggtaggcagagcagggaaattgtgacactggttcatatcctatattcctccaaaagattgtgtgggaaggtgtaggggggaggggggtggtgttggggtgtgtgtgtgcccttgtaactgtaaaacatctttctccatgggtgtctcagcttcaattgaccaatcatgtaacagccacatgtttgtggggggaggggaatgaaaaagtttcttaaaatgtagcccattgtgtacatggggatgaaagcagagacatggaggaggcgaggatatctcattgacaaacacctttgccagtttctttgtattcgtgatttttgtgctatgaaatgcagtattaaaaacaagaaagctcacctgggctagcgaaagaagaaataaccaggcttatggaaggggagcggcagatgctccaaaagtagagagggctagaaatgctgtaagataagcaattaacaaggacaggcctcagctgacagtgtaggtgtgtgtgtatgtgtgtgtgtttatgtgtgtgtgtatgtgtgtattttttttaaagctgtatgatgtacttgagcaaatcagtgaacctctttgtgattcttttctcatctgtatcatgcagataattcctaccttaaagggtcgctgttaaagataaatgatatacaatgtgtcaaagtcaaaggcttggaactttgtagagactcagtaaactgtttgttggctctgaatctgaattttatttggactgggccagaatgtatcggaggtgaataccaatcccacctgagacctgtggacagaaatgacaccaccatgtcacatgcagtcataaacaagatcaatcttaattctccccagggcatggaccccactgttgtgtataggccaccataatcagtgtcatacctctgattgattgggggcagaggagcacaactatcacattttgtccctttagaaagacaatgacattgttttaatgactcaggcatccacccgatagtgtttggtggtttggggtgttttgttgtgccttcagaaagcattgtgagcgtagctccagtatttaccagcaagcagagatcagaagacttccaaaattcggggctccatcagcttagcgatgctggcagaatggcttgctccactggacagagcagcctggagagaggtaagctgaaacagatgggaagacctcgggatagggaaaactctgtgcatcctttcctcagccctggttacaaaaagtagctgttgcctggaaagtcctgggacttagctcaatgtggatcagatgcatgggcattggatccattgtctctaataaaaggggtggggttcccaacagcttcccaagtttacttagtggccaactcatttggaaatacaggcttagatggttgtgggtagaatccattgatctcataatttttgtttattttgatatagggttgaacccagggccttgcatgtgctaggcaagcactctgcccctgagctatatctcctagcacatctgagtccttgtgaaggcaggagcagcggtttcttttggatcctgggttacatcttcagcccctggcacatagttcctggcatataacgagcaggtacttaaaacatttactggatggatggatggatggatggatggatggatggatggaacatactccttccttccattattatccaaatgcttttaataccacagtccttagaagaaaatggtttgctgttatttagggtgtttttttttttttttttttttttaggatggggaggtaaatgggcagtttcagataccatttggtcagttatttggccaatctagggggatgggattggtagccctgttgaggaagacacagctatgtccccattcttcatttctgccatgtgaagaattcactcagatgtgtgccagcagattttgactgcttgcacagaaattgtcctttaacatttccaagtgtttaatttggaaacaaattcaaactcacagaaaatgtataaaaataataaaaacacccttttgcactc

SEQ ID NO: 489 - DNA, 2118 bp, mus musculus; identical to SEQ ID NO: 2

SEQ ID NO: 490 - DNA, 28557 bp, mus musculus
gttctcgggcgggcggagcccagtccgtgcctcttcgttgccccgcgcgcttcccactgcgtaccgcttcccgcgcccgctgacgcggcccggctgggttcagtgctgcccacccgagggagcccgcgcaccacgcctgtccgaccctctgcccgtcacacaagccgggcacctgtaccaggtagggttgttgagtcgccgtcctaaagaagtggctcgaccaccgggaggctacaaggagcacccagttcgtgtcctcctggacacaagccagggcctcagtttccctaccaataattcatactcgctccaagcatccctcttcggaatcccgtcagggaggcagtgccctcggtttctgcttttcaccgcgagtgaagagacaggcaacgttcctcagagtgtccaacaaaagcaggtggctctctggctggtctagtccctctgacctactcatttgtggatgagaccgattgttagtagactgccagcggggatggggcagggtgagcctagaattggtgtgttgcaagcatcacagaattccacatccttagtaaaatgtgcccattttatagatgaggaaactgaggtacagaggcaagcttactcaataatcccctcactggcctggagcccagagcaaagggacttaatggtggtttgtgatagacatgtactggtcactgggcgacctcagggctgggaagggagctgctcatactcagacagaaggcgccgaatcaagtgtcactgtggtgttatcagcgggatctgctgtgcacagtctctgtaactggattgtttgtgtgggagcaggggagagccaatagcctcatcctctttgcaactgcttagtgatagcttggcctctgagaaaggttggaaacgcagatcctcctgtcggccatgccacttccttctgtactgtggcacctggcagctccactgagtaaaaggagaagcctatcaggcccaccttcccctccaaggctgtggagtctataaagtatgttgggagttgtgttctccacaagccattggtactgactcttgacattaaggtaggtggtgacacctgctcttggtcttgtcttgctctcatggttctttggatttctagtcatgggcaggaagcaggtttccacaggctgataaacctgaataatggtgaggggctctgaactggagagctgcagtaggaagcttatgaagttcttattttcccatggcctcaactggctcttctgcacaaacagtgccagtttgggtgggtgccaacagatctccagggtacaggtacaacttactggaggcctttcgagaatgtgctgtccatcgccttcagcccactcactacaagattggaaggaacagaaccatcccatcaattatcagtgctgaccgaggctgtgcactcagtggagcagaactgatagaaggtgcctaggtcaaagctaagtacacagcagatgctcaaaatctgttccttttcctcctctgggcactcatgagtcagtgacaaacatggctcatgaccacagagggtgctgcagctttgaaggtgaaaagtgttagcctggatcatggatgcaacccaagatggaaagattaggaaggctccctggaggagggaacctttgaaagttgagcaggtcaagagggataggagagaaatcagcccttcattttaccaagaagtctctagagataggttactccagaaagagctgccatctggatggtaataggacaaaaccctcccaacttagtggtgagagtagtggtcccaggaacaactagaatgtagcaacgtccttcctcaaagtgctttaggccttctaagacctggtagggcaggaactctggtttcctagcgctcgggacctggttgaggtgggcactggtacctgttccctgaactgtgttcagttgtgtgccaagaaaacacccccaattttggctttgatgcagaatcctgtttgatgaaagccagaagcctgctcttctcctttctcattgaagcctccatatgtgatttatccctttagtttagatgttgcctcaagccataccctatattgtgctgggtcacacataacacacattttctttctgcttgctaaacactgaggcccccttcattgccagccctatagtgacatggaacaggatcattgatgggggtctggggtgtggtgctgggagaaacttctcgtattacactacagactttggacacccatggtgggtacttggcctgggtgcagacaacttgtctggcttctttctcccaaactaggccccacttcacctcttgctcccacggccaatgaggaggcaaataccatcctaggttaaacactgtccttgtatcaaggtgcttgaatacaaggtgggaaatcaaaaccataagaggttgcgtggtatgctcaggcctgtccaagtggatggttacttaggctgggctctgaactcagtgtggcctctgggcctttctcttacccatggtgctggaaagatactatcttcactgaccacacaccctgctacgggcgatctgttggatagttcctcctcctgatctgccgtcagttcccttagcacacggccctggtcctggtatcagctggttctccattggcatagctggtgtcagttcatttttcccaaagagaaactgaggcacagaatggaggccctttaccttctcttgtggatccacgtgaaaacatttggcaggtcttttcagctcactgtccctgctaggatgaccaaagtaaaagggtgtgggcagggaagagggagggggtctgggtagaaaagaagctggaaaacgaaagacccagaggccctgggcatgttgttctccagggcttatgtgcaaacttaaactcagaggtgaggagggtggacatagagcagttttttttaacctacttgttaatgcctacattgtagcccctcttcttgcacagctgcccttgaagttactgctggtggcctggggaggctgtggagctctggagacacacccaagattcagagaagacttggcccctagggtcagtagtgagcaaacccaagctactggtggtggctgttggtggtccctgtctttggttccatctgtgggcacacatcaggcatgaggttcagcccccttgggctgtgatccctgtggtggttggctcagaacaccactttctgatgactaagtcactttcccagagagcttgatgtggcagaaggttgctatggagagaggaggccccaggattccagtcacacgaatggggatccctgttgaaaatgctgacatcaggcattgcctggtttaacctataaagagaaaaaacccacaaaaccctaaaagcagaccttgtttcaccatttctgagcatgcgcacactcagctcctactcattctttcatagtttaggacctggtccaagggcacatccttgggaaatgcagcactctggcaggggcctcggggcctgtctgttttcctctgattcttgtctatctccccagcacccagccctgactgttagctttctatggaagcttgttgcagaaaaggaaatgtgaccttgggcaaatgcatacttctctcctggcttccatatttttatcccaaaatgggggtaattgtagaagcaagggtggagtgaaggggactttgggcttgagatggacagggaaatacaagagagtatagagggattgatggggagaaggctgtaaagagaaacatttttttttggtgctagaaaagctggtgggtagttctttttttcattctcagtagaggatcactttcaagatgggcaaaagcaatttgaccaaaattagaagcaagtggggctgagctcctgggatcatgtgtgctccggaaaaggtcaaacaggtggcagttgtgaggacttgggatacacatgaaggatggaggaaggttggttccaggattcccagcccctttgacctcatgacatgtccatctgtagatggatacagcatctctgagcgagtagggctggcttgagactttagatttcagtttgcagaaataaccgttgtgatgtagagatatgagagaggtgcctaggactgtggaggaaggcataggagttcctccgtgccctttcttgtgggatagctgcagaggtaacaacaatagtaacaatgtaaatagctcatatggggaattggagccaaggtcttgttgggagcaagatgctttccactaccctcagcaggctgccctcatccacatatctcagggcatatctctaagagctcttcccagctgcccttagtggtcctgtaggccaaggtacccctgaagtctctcggcatcttcaatcatttttaaatacatctctctgagaaccagaaaatgaatacatgagagtcaggggattctaggatcttagaaatggaagatagctaagagaaccccttcccccttggtgttgcagctccctaccccattgaaaaggacctggcctgcctcagacatcttcctcccaggattccactagcacagacgccaagaagtctagaatctggggtttggggatgggatggtgggaggtgaaattccagactttcatgcagaagtcatttacctgtaaagcacatttacaaataccactccctcccaccatgcttgctttttttccatattacattttccctctgcaacccaagtctcttccaactctttttttccacgtagtatacctccttcctgctgccttgttggcttgccggcgggagccccagggagtagagcattgcagacaggccacacactcctgccagagaggcccagccctcaattcctgggacctgtacactgagcagcagacttaggagctcagaccagagccagctgctgctcagcctttgctctggcagagccagcgctgtctaaggtctctaaatcacttgcatagatcttagtccctcctggaccagtgatagtagtgtctctgctagctccttacggttggaaagcaatccatctgctgactgctgctgacactccagtgcaggacagtgagaatccgaatgcccagggttacaaaacctggccacagggaacctgtttcacaaatggaacatttcatcattccagtcttttgggcctggaaagagaatcaagttggcagcatgagtggtagtttaggtcagcctgggtccagtttgtgggccaagtgcattccttgagaagggattggactagtagagctaagtatgcggaatatgagtgggggtgttgaggttgtggttcctaaattttagcatttcttggcccctcatcctccgggtcaagtatacctgctcatccttgcacttccttatgaagcctctagagggagactgccacagccgagattttcactactgtgctggccttccatcacatacaaagcagcaagctcttcttgggctccattgatgagcagagaagctgctctaaagcctctgctttccccacaggggggaaaaacagatataagggcttgggtgcattttgataaaagggcttccttaaggccatccttgcatctgttggcataggttggattgggcaagaagggaggagtggaagtactctggccaaggagctacctaatctgactggactctggagctcagaaagtttggattctcagagttttggagctcaaactaagctcttgcaggacagctatagaatcaggggcctgtttcccttgcagattttgattttttttttcaagtttggtcctgcacccatacatggtggtaagggaccaaggtgctgtgtggggaggagggtttgctcagggtgagagcaagtatgaggatgctcttcccacagaccaatggactctctgaggctgcccctgatctcaagcagtgcccatccaagagattagcgttaactgcagccttcatccatctttgatgagtgaagtttctgggagattgaggctgctctcagggcccctgcctggcaaagccagagattgatgatccctgcaaaaggtctgcatgcttggagaggtggagttgggcttcctctcctctcctctgcataaaatatcacagtttatctttgacagtgaagctcttctccctcctacctctacctcttacttgttttgttttgttttgttttgttttgttttgttttgagacagggtttctctgtgtatccctggaactcactctgtagaccaggctggcctcgaactcagaaatccgcctgcctctgcctctcgggtgctgggattaaaggtgtgagccaccactgccaagcttcctcttccactcttacttgtactcagacccgtgcctagcacaccaacatggaaacaaaccccatcacctataccttaggcaccctctcattgtcacaccacactaaaataaaaactgatttttctcagttggtggagtgtttacctaccacgaagctctggatttagtccacagcactgcataaagcaaatgtagtggtgtacatacatattcccagcacttgggcaatgtagacaaatggacaaaaaccatcacacttggctacatagtgagttaaggccagcctgggaaaatgaatagatggatggatagatggatggatggatggatggatggatgccagcctgggaaaatgaatggatggatggatagatggatgccagcttgggagaatgaatgaatgaatgaacgaacgaaaacaaaataatgttaaaggctttgcttctttctcactcccagttaatttctattgacatctagcaccaatttcagtttctaagactgggagcaaatttggggtatcttgatctggctcttccagtgagctgccctagtctgcattctatttcagcagtgatctttttctttattgtttctcaatagagaatctgaaataacccagactggcttgaacttgctgtgtagccaaggatgaccttgtacttctgatcctactgcctccacctcctctgtgctaagaatgcaggagtttaccatcgacctagttgtgtggtggtgagagtggaacccagggccttgtggatgctcaacaagtactgatccaactgcactatatgcctaggccctttcatgtttactgttactggaaagagaattgtatttctgaaatgtagtcagatctgaggggaagctggtgatatggaagcaccagccccagttctttctggcacatatccttgatcctttgcctgtattaggaaacttctagacaacatggctattggatctatcaaggggaaaactcacaagttctgggtttaatacaaggcctagcatgaatgcagctgctataatggggatgaacgtcacctgcttgcccagttcctctgtggaaaccagtggccacagtccctggggtcttggaaaggagtatgtccttgaggtaccttacagaaaataagttaagatagcaaaaataaaaaatggcctagtacaatttgagggaccaatgggcggcgcatttgctttcatgcaagaggagagggactgtccaaggttttcatatttaatagcatgaaaagacctagggctgaaggctcaggctttagtggtctgcatacaaacactgactgaatcatgcactcaggctcatgtagtcactacacatttctgctaggatgcagacaattgagtttatgcaaccataagagcaactgaacactgatgtggcagcttcagtgccataatgaggttccattcctggcatgtagaaggttcagcctgcctggactgctcacttggtagtttatgggagagcaggctcttgctgatgtggctaatttagtttggtcttggcctccttcccttactcttttagtgtatccccgatttccacaaaaacatatccaggtcctgccagttggcaccattactgaactggtcaaagtgtagccctggagggacccaagggggtggcagaccccagggagaaaggtctttctgccttatcactgccagggccttgctttttgtcctgttcacacctctgaacctcccagactctctttatgtccaaaggagccagtttggttattaatatatccaaaatatccaaacccacagtctagtcctttcctcttcctcagctttgggtctctcagcctggcgaacagattataaagaacctggaacctgttgactctgaccagtctcctcagctgatgccgaggccactccttagcctttggtccctgtgaggaaacaggatgaggagccaacctcaaatagggctgcaaatatccactttgtcctgcactggttggagaacactagctgagagcgtttcctccagctttcccccagcaaacagatttaaagtcactatgacttggcttatggccagctgccaatgatatgcctgactttacagcagtccagaaatgtagatcgtttcactttcatcttacaggtgataaaactgaggcaacccagagagattaactgatttgcccaaagcatgacagctagtgtaagaaagatgattgagtcctaaagctgctggttccctgaacccttgccctacctccaaatctgcctgccctcaaaggtggtgtgtctgaaatgtgcttccttcaatcctactgtctggctcagtgccatactactctccatgacactgttggaacttccgtattactacctgctcccttccccagactctttccattagcactctctgtgatccacccttaataactgactagaacagtcagttcttgactacccacatgttttcatattctccaggtgagcagccatggctatacaggtaggtgtagcacccacggtggaatgtgtgcttagtccttgatctctctcatacatttggaattccaccaattcttgtcacccctgatacctgaaaggaaacctgcatgatcttggtgtgctccaggttcatttctcttttatgatgccatatgtgagactgggtgctaggctagagaaaatatatttatttacttctagagactcaaggccatagggggtagcatcgccttgattcaagtaaggatctcatggctggtggcattacagttttgggcaggagaacctgagtttgtgagatggaaagccagggagaaaccagagctgggccagacttgccttttgacaacaaacactgatgagaactaaccagtttctctcaagacattaattccatcatacagaagctctcccaattatctatccaaccttattttgtgtgagggagtggggatgggaatgggtatggatgtgtgggtaaaggggctaagtatggatgcacatgtgtatacatgttcatatgcacacgtcaaagtcagaggtcagtatcaggtatctctatcactgtttgccttattttatgagatagggtcttctagactggctggccaccaagcctcagggatcctcttgtctttgccttcccagtgctagagcataagggtgtgttatgatggccagctctgactgagtaattttcccattcccccaaatttcatttcttaagtgtcccctcttaatactgccatattgggaccaagcttccaacacaagagcttttaggggacaaaccacatccaaactctaatggtgacccacaagccattacaattcatgtattgacagatttgtctttgtctttgttcccaggagctcactgaatccactaattaaagagctgaaagataaacatcatgagtatttcttccttaggaagtattgggaaaggtgagcctgggtgccatgtctgcctgaattatcccaggcaaacccctagagggcttatgcatactgcccatgcagctagtggatgacctcataatgggtgggctggcaagagccctgggtctaggggctgtggttccctgtataaagctcttagccttgcctctgccagggagaactgtaccatctggtgaagaggagcgcaataatatcctaagacagatgaaagtacggactacactaaagggtgaccagagctggatcaccaagcatgatgactctgaggatcataccatgtaagtccaggacagaaagccagaggggaaggctgcaatagtgagggcatgtgacccagcccttcctagggatgctgaggacattccaccatttacagctcggtcaggttgtgtgtccactggccagccaggcgacattaaaacttgaaaagctgtacacagccacaaatatcgcaatcctatgtgctgagaggcatgtgtaaagtgggtcaggaaaggggaaggtgaggtgcaatggcggtacacgtaaggctaactttgtgatagagccacaggagtggtggtggtgaggagcatgggagccactatcttcagggcctgtctttctgcagagagccactctcacgtcacaaccgagccacatccttctcatcagtcagagacgaatcaaatgccaggtaagaggtggtacctagctgactcttaagtggaccccaggaactcttctgcaaagaagtgtagatctcacagaagagatctacatgagaagggcatggaggacctttaatgagtcatttgtaatgttctttgaactttccttttagtgtttctggaacttggccatctccaagaatctgctaagaacaaggtttataggagtgaatggtagagttctgtggtactagtagacctgcccagagcactcatatgctgaatagaacaactcttggctgagtccttgtcatcttgctttctgctttcatacttccattgccacttgggagtgagtgcttcaaggaccagaggaggaaacattctagaggagtaggaagggaaggccatagagatttaccttccatcagaacatcccaggtttgggtcagcctgggctctgaccaaaggactttcagtctgatccaggagagaacagattctgcagtaaatgtccagccataaagcaagcctggcctggtacctgctgtaggttaggctatgctgagcatggctgtggaggagtcagacatcgcagtgttcctggaagagactgaaggagagataggtggagcagagtgggcacctggtcacagtattaggagatcagctgttgtagttggaaataggatggaataagtggtctgaaatccatagtaaggccacgattcccttgatgtctccttttttcttgtcaggtctccaaacgcaagggctccagctggttacataatccggtaagtgacttctagaccctacctgcatcctcatgccactagagccactagagccacacccagacttctcaataccttctggtgtctcttgtaggggagtgttcacccgaacaatagatagctcttctcactcccagcatcgcccctctaagaccaacggagctccaagaaggtacatcctggttagatagtcaataggaaggttgggagagccttgtccagaaccaagtctgagaaagggctagcaaagtaataagagaatgtcctgtctggcttattctcagggacagaggctgggagagggagatcctcacccagggagagggactctggacagagatgtggattgtgcccacacatcttcattttacttaccccttgtccccttggtctcacagcaagcaccttgcacttgctgaaggcactgagccatgcgcttagttcacctttccagtatgacaaggcatcatgttacccaaacaccttgataccagtcaaaactggggcactattggagaagatatggaagagagcccagtgggttcttttctacccagttgggtctgccctattcagaatgcctggcccctatcctgtctctcttgggctgtgttggtaaacctagaggcaagaggggacctgtggttgggcagatggaaatgacttgctcttctagtgcttctgggcagctgggagcagctaattctggtcatcctcttcagtcgtctggctataagatgactacggaagattataagaaactgtgagtatacagtggtgcccgatactggacctactgaaggcaggtagacacttacctctgagcacaacctggggagagctattctagtggcttaacaacccctgccacttatagatgtggcctggagcaaaggatgacaaaactctagaaaaatgaatgctcatgcccaataccctccttttaggaggcaaagactgttggaagcttctggaaggagcatatgcgtctagtcagtggaccatgagccatagctatggggggttcactctctgggtttcctagatgaactcccttccccattcaggtctcaggttcttgggctgggctgggctgggctgagctatgctttgaggcatgaattttcttaggttgccactgtccccgttggctattggtgtgggtattttgtatctaaagctgagcttcccttgaggttccttccaaggaaccctagactggaaggggggttctagacagatgtctggattgtgccagtacttcccagtagtccacatcttcatacagcttattcattgcccccatcatcctgttttatggcacagctggcagtatttctagggaagtagtgaaactgcaattggctgagggtggtagcctgtagcagggaacaggaaggacatggaggaaaaagagtcatacctgcatctctcccccacagagcaccgtacaacatcaggcgcagctccatatcagggactgaggaagaggaggtgccattcaccccagatgagcagaaacggaggtgatggtgtttgttatgggcatacccatgggcagggcaggggccagagtcttcacagattgctgaaaggaatcatacaagccagagtacaaaatgcatgacacataaatcatgaggacaccccatgtctttccaggagtctaggaactatctctcagtgctaggccagctcaggaggcacttctgagaaccttccagggatagaatctaggaaacacaggtccacaaaaaaaggcttatgtgcagattcaaaaggtcccagggaacttgaaaaatatgcagggcaaagtgccctaggaggggcgtctgcagtgttctttgagttcaagaatggatccagaatttcaaatgccctgtgcttacaaagaaggaatccagactaaaggccaacatctgccaacccatatgctttaggaagcatagtgacaaccccttgctaaaggccctgtaagggtgtccattctgtgcaaaaagaccacagttgcacaaggcctgaaatctggatagtgcaagggacaggcaaatgaataagctctgatggtggctcctactgaatgctgttctgtcacctgcttaagtgtgtgaatttagtcaaatcaccagagcagtggccaggctcagtcagtaatggagtatgtcggcacctacttgcctgggttgggagagtcaatgaaccattgtgaagatgtctgcattgctgagcagggcacatgctacatgctccctaaggaagtgtccttccctccatgtccattgtccctctgaatagttcttagagcagtgcttccccatggtgtgctcctgagtcagacagtgaacatcccaagctagactgacagagaggctagactgacacccatcaaatgtccccctttatactaccccaggtcccaggctgcacttggtgttctgaggaagacagccccccgggagcactcttacgtcctctcagcagctaagaagaccactaggtgagttgtccaggaatgagtccctgtgagcttgagcctgccttggccactgctgactccatgttctgggctccttctttttttcttggggcttcagctttcctttgactggtgaaagaatgagttgaatacctccatgagaattctagcttgagctccagggttctcagatgcacttcttagaaagataaacagactaaaattaggtaaggtcctgagagttggaaaggttcaggcaactggaaatgttcaggaccctatagggatgggggctaagatgacacctgcccttgaactttttccaacatgttccccattctgcttcctttctagcagtccgacccaggagctgcagtcgccattccttgcaaaaaggtaagtatcagtcaggaaagccagatagcaagcctgctgtcagtagggatgctgggaaaaagaaggaagctctctctgagcaaagagagtcatgtgatgccaactccggcgtctttttggaggccaggcaaagacctaggtaactggtgacacatgtgtcccttttagccagttctgtgcagttaggagcctggctgagaaaatgcttttgcttaggggccttagcaaatgtcctcactccttccacaagctggtaggcaccaagaaaccaacatagcaagactccttgctcttgccctgccctgtgctcttctatcacccagacctaggaccagaatcaccaagagaaactccatgggagctgactgtgatgttactgattggtcctatggggcaaacagggtgaaagagggaatgagtcctatgtcggtagtctagttgagtgaggtaagggtctcattatttgacacaggtcaacatctctagagatgcaaacaggggaagatgaggtcatactaaattagggtaggccctgaatccaatggtagtgtcccttcgagaccaaggaaattcggacaccgacacaaagaaaagtccacatgaatgaagacagtggcctaaactggaatgaggcaaatacaatttgttccaaccctgccaacacctcaatttcagatttctgacctccacttctggggttttaagccattcagttggtggtaccttgttctagtagccacagctaagaacacactattctctgttactttgtctatggaggagcaaggtgctgccaacccccgtacctttcactgcttattgtattttagtcagctactgtcatgtcacacagcagtatatctacttctgggcctttgcagtggctaggcctggggcttggaccatttggagtgcctgttccttgttgactttacacctacagcttaccctctttgcatctctcaagaacgtatttctaacgaagtcagactcatgggttccagggactattccaatggttttatagtcacctgactcatctggacactggtgaaagcacacccttcaaaggccaaaaagcaccaaggtaactgagaagaccacaggtgccactttttccgcccacagggttgatgtggtagatgaggacgtccttcctgagaaaaaccaggaaccacctgctctggcaagacctgatcctggccgaagcaggtaatcagtcactccccttgggctgtgagagactggccactgcagcagtagcaccccagtgttaagcttgcacccggacttctataacttggccaagttcagcctacctgggagacacacttgtctccaacacttctcacatctgccttctttgccagtgtggatggaggtaggacccaaatatctcaggacattctaattgagtgcatgctaaacatgcctagcccctctggaagccaggaacatgtcaagaatcatctctagtatatgagctggtaatatggcttctcactggcctggctggctggctctggcagccagggaaggtctagcagtggggttacagtgcagggctgttattttcaggctgctaccccaatgacctttctaaaatgtcagattgactgtgtcaaaccccttacctccacttcaagcccatttgcagcttccccttaccaggcacatctgctagaatgcccacctagaagccccttcattgcctgagagtagcctagggttagctctgggtgggagactggaaccaagaaggcttaaggacgaagaaaagatgaggaccaggagggagaggtatgggtctggttatcacactgcagggaggccccagaaggaggacgcccaaagatgctgacacagagtgggaggggaagcctctcctccccccacacattgcccaggctctcctttggcctacagctcgacaaccgagaagattgcccatcggcagattacaccccccacagcagaactccacctggtggccccagacctggaagccctgaggtactgaggccccattgctgtcctgtctctctttagcctttctcaacatgagagagaagcaggagactggtttgtaacaggtgtggcaaacctggcttctccatcactatcttatatacatttaaaataattatataatgaataattatgcaatgtaattttgtgaggtcaaagacctggccttgggatctaatcatgattgggacttcctgggcaagaactattgacttcatctgatgaaggagacagatagatgctaatatgaacgagatcagcctataatgctggccatgccatgtacctccatgccctcagaaagtgacaagactggtcagcagagctgggtggggtcaatgtgtctgtgtaaccctttattaaaaccagagtgttaattatgttgcttataggacaaggcatttggaactgggtggagttcttgggtctgcctccatagttcacaatgccacagtgccctgtgcttggtataagaatggatgaaggggctgcatccatcaaggagcacaaagatccaagctccttttccttggggtgggcacgcaggagacaggccagctctatcttcaaactctgtgtcatctttcttactgtcccccctcccccatgctgccttccacacatctacctaaattgatagcatgaaagaacagtgagtagcctagcaggttatgcagactgggaataacacagaagcatgaatgtttcaaggacagattgggggggggggataaaaggagaccagaaacatgtggccaaggaagcagaaggtttcacaggattgagggaagagagatggtaagtctgggggaagagacccactggtgacccaaaataatgctgaaactgacttctggacttggtaacaaagggctcctgatgacctcaggactgactgaggggttaggacaggaactcagaagaaagccttgtcacttgtggaacttggaacacaccactcaggccttctgagcatcaggtggctcatctggaaaaagggcatgtaacgatactgaagtcgatgtggagaattaatgtgtggaaagttggaagaacagagcctggcccctagtcaacaacggtgacgaataatgaggatttgtgagttggtcagttcatcattagcatattttcagctctttcaaggcagctgtcatttaaggatgaggtaactgcctccatcagagtgtgggtggaggagtaaagtcatttcttacctccgcagctcttcccaaaaagccttgtgcactcagcctaaaggtttctggtagcctgggtccaatgttagcagctgacatacagaccagcactatactactgttgcatatctgaaaaggaagaagtagagctagagagcgtgggtctagggggagcagaactatatttcaccagaggcgcaccgactccagaccaggctatccctctcaaagtccttgggccggcactatgttgtcatttgggagccctagaaccccctccctagagtgaagtgatccctgggaatgagggaaggggagcttggatgaatgggaaaggttttgacttctctctctggcttactagcagcccagaattcctcgtgtcttgctctagtgaccattgaccatcaatgtggctacctccctctgagttttcaccttttgtttccattcttgtttgaaagctgttaaatctgaatagcaatgtttgcctagagtccactggaacttggattggctctgatcacaataatttagagaggcaaagatttctgctcccaagtcatctaaattacacgaggtcacagcctaatgaacgtgctgaaacaggcattggtgcaggaaaaaaaaaaaaaggtgagatgccagtgcttcccaccgccattaccagtaccacatcctttgcccatgcatgttttacttcttgttggattttcttcttctccagacttagccactactgaacccccatcattgactctccaattcctgcagaacaaatccaagtccctaactcatagctataggcccatccctcagcaaggaatggcctcgggtacaatgaatgtgtggggaaggcagaaaaacaaaaaacaataacagactaatgaatgacctaataatagaggaatctctgccttcttacaaagtctgccttccccacatactcatctgcataagtagcctttgtctccagggatgcctctgttttagtttggaaccatgttggaattggtagaactgtcactttttttattattattattgttggtctgaagagagctgaaactgctgaagggccagcccatcctcatgacctcctgaagtccaccccacgtggatccatcccttgaggacacttttctaggtgctttcccagctggttctcccagcagcaggttcattttctcactaatctacctagttgcagcgggtgcctggagacagataaagtaggccccacctcggtaatctctgttttgaagaggtctgggaaaggccattaggccagggactcggttctttgagttgctactaatgtaactttttgctatctttgcaggcatcagaaagatctttcccaaataaaccacaatgtgtttatccccctctttcaacttctcaatggctctctacttccttgaaattaagccgaaacccctgtctctagctcctatagttctgcatggcagtggggactccctatccagccttttctttctcctgtaccacagtgctgcaaactgtttcagagtgctattggctattgtagaagacatctgatctagtctggctctggtggctttcttttggactgttcattggcatcatccttccatttgttttacatgaagctaaaccttaaactcatttgcaaaataacatgaagtatctttctagatttgtaggatttagtgcagtctgttacagttatctcacttatactagtttgaagtttgattttgtatgtatatgtgggtgtacatgtgtatgcatgtctgtgtgtatgttcacatgggtatgctcctgtgtgtgtgtgtgtgtgtgtttatgtgtgtctgtgtgtttgtgtatgcgcatgtgtgtcaagaccagagatcaacttctagtgtcattccttaggcaccatacatcgtgttttgtgagacaggatctcttatcaggacctaggatttaacatgttccaaagcatagagtagttgaagactaatgagtgaggagactggatcagggccgtgttccatataatgaaattttatcaggttttaatccaaagaagaacggctgtggtttatagacttaaagatgaataggtatttgaattttaacaccacactacagtcaccttttacattaaatcatatgctgggaggtggtgtggaaaatggatctgtaagctacaggccttgttatgcacctttttttttcttttaaattttactaacgattagaactgaggaaaataatagctgatgatagctacagtatgttgtttttatgtactttacagttgcctcaataaccctgtgagatgggtaaatggggaaacaaacaggttaagtgatttatccaaaaccatacccgtggtagctgagagctaatgaacagcctcaaggagaaaccttctgagaaacttgagcaagctagttgatgaaatgtgtttgaaggctaatgtctccttccagctggtgtacttaatctggtgttattccccaagccaagaaagatttctgattgtgcaatttgatagaggagaaaacttgggtccacacatgtgatgagcaaataggaataaactctaaatctgccctactgcagagctcaggcccagatagtaacattgctctaatatttacccgtttgaaaaatcaaagcaaacatttctgatgacactgtttaataactggctatgtttggattgttttttttcccatttaaattaaaaaaattatatgtataagtgttttgcctgcacatgtatgtttttgcacaccacccatttgccacgtcagtggtggccagtagagagaggacagtggatcctcggagactagagttagagattgtttctagctgtatgtgggtgcttgtaataaaacttaagatttctaaagagtacacactgctcttaactgctgaaccatctttctagcccttcatctggggaaatattaataacaagagttcttgagatttttgtttaatttcctgaaggtatgtctccagcgtttttcttaagcatttcaatttcctctcttctccagtatacactggagatggcagctctcaatcagaggtttgtcctgcccacccctaccctcttgcgtcatacagtagtaaccgaagattttttgggttgccacaaccgagggtggcttctaaaggctaaaaatcatggatgctgctaaacgacctatagtgacaggtgatattagtgcctcattctcaacacacacagtattattatccagacaaaaacgttaatattaatattgacaagccttgctctagcaacttatgttcacttgggggaacacacacacactgaggagtgtgtcagcatagatctagtcagactgccgcagacaggcaccacgaatacggacgcatgcacccgtgactgcagcagatttctgttgcgcaggcagatttggatcgctcctgcggggggggggcggggagggaaggggggagggggcgcatgcgcatgagtaagctagccagctccagggtaagaatacacctactcgcgcggccatttcctgcagccgctagctcaggctgaggtgcccgctatgaaaggagagtacaaaatggctgctccagagaccagcttctaaggggctcctcctgaggcagtgctagctccagccacgagatggcgctggaggatcacaaatggtccctgttgcgccagtgcactcccgttacccatccccctactagtaatgtcagagggcggttgactacagtagcctacttaggagtgaccaaacccaaggatagtcccctttcctttgataaacagtggttgatgggcttgaggacagacccaggtgacaaagttaatgtaaatgtcagaagccttaggagctttacccagtgttcatttgattgtgcaaagtggactaaatgcagggattcttgagcttgaatttaagcccaaggtaactttatgggacccttggatcactcagctcttacatgaacaataatggaaatagtttccaccatagacagttcaaagagttaaatgggtttacatatgtaaagcatgcaggacactgaggagtgtgtacaaaatattatcaaatgctacatttattctttattttattttattttattttacttttaatttattttttacactccatgttccattccctgctccccccatccaccctccaactgctccatatcccatacctcctccccaccccactctgtctccacgtggatgtctctaccccaccccacctgagctctaaactccctggggcctccagtctcttgagggttaggtgcatcatctctgaatgaacacagacctggaagttctctgctgtatgtgtgttgggggcctcatatcagctggtgtatgttgcctgtttggtggtccagtgtctgagagatcttggaggtccagattaattgagacttgctggtcctcctacaggatcgctcttctcctcagcttctttcagccttccctaattcaacaacaggggacagctgcttctgtccattggttgggtgcaaatatctgcatctgactcagctgcttgttgggtccttcggagggcagtcatgataggtccctttttgtgagtgctccatagcctcagtaatcaaatgctacctttataaaaccttcaagatagataaagttctgccaatttttttttttgttgtttattcagtcatttgatagcacaccgtcttacctttttccttcaaagttttggtatcacatgttaaatctaagacttagattgttttcttctttgttgtgttgcaagtgtggattttttctagtttgtatttgacacacgaaggtgagtgttagacatgtactcagtgctggcaactgtggtcaggcagcagattacattgcgtagaaagtggcattgtcttcttgtgcagtatgtagttaggtcaaaaattggcagtggttgccttaagctaccagagtctgtgaaggcttcagagaattcaacagatatcacatcctatgggcctccttctctctccccactccagtttagcagtagctgaggccgagtggcaagaaattaagatactcccttcaggatgttatagtgcacagaaaggcatcctgtgagggtttgaccaatatctttttcatgacctataaaggttacagctgaaactgcagttgccctgcttcaaggcccagggtttccccatattgccctgcctccgagcggctctttctgaagaaccttgcctctgtttactcagcactacttcctggcagagctggaaccagcagaggagtttagtatcctcttacctgaggctgaaaacttcaattagttttacaacctagtccctgaaaagcatggccatcgcacattctttttgttctgccagcttagagcctcccagggatggtagtcactgataatgggtttttattctgtccttacctcaggagttcccagagcactgcagggaggttctaagatgataaaataaagagacaggagtagtgatgagagatgagtgcaacaccttctactgtctttcctgtggcccccacctttgagaggacattgcagacaaactgaggaagacataccctcctcgatggcctcagatgtagctcgagctgtttatgtcagtgcggtagcttgtttttcttactccaggccactgcctgggttctctgaatgtgctcagaatgttgataccctggtcctggggcggtgttgactgctttctcgggtttgagatgttggaatgggactgtgatcaacataagaagtctgcatgtttcttggtgcatgaggcaagaggcaagtctgtttcccagagcgtacatggtaagctgctaggtttgctgaggactacttttctttatccagtggtggtgtcaaagtatgacagggagcatgagtgacacggactgtggggaagagagaaatggaatgaaaaagacaaggaaggaccacgcttaagaaagcaaaagagagagtgaagacagtttgtgtgtgtgtgtgtgtgtgtgtgtgtgtgtgtgtgtgtctgcacgggaatgatggatactgtgactgtaacgaaaggtaactgtgaagtatgggcagattttcaaacctccgctctcatttgtggttcggagattttaaagggtacataaaatcaatgacataaaattagaaatggaaatatctaggggaacaaagggaattagttggaggtgtgtgtaaaatgagagtcaaggtatatgggggaaatatgttcagtgtacaaaatgcttgttttaaattgtccttatgtaacataacacagtgtaccaggtacaataagagacacaacaaaaacattttaaaataaatttttacaagaacagcctacggatgcaggagaaagttctgtggtgtttgggggagtgaggttgaacttaggtttgaaggctaaggaagatttcccccaaacgacatgctaatgaaggcattgcagattgaggaaaccagagacccgtcaaagagaggtatatggtgagtgtcttagggttttactgctgtgaacaggcaccatgaccaaggcaactcttataaggacagcatttaattggggctggcttacaggttcagaagttcagcccattatcatcaaggtgggagcatggcagcatccaggcaggcacagtgcaagaggaactgagaattctacatcttcatttgaaggttgatagtggaagactgacttccaggcagctaggatgagggtcttaaagcgcacacccacagtgacacacctactccaacaaggccacagctcctactagtgccactccctgggctgagcatatacaaaccatcacagtgagtgtaaatttagagtgactataggaaagaaaagctaattggtgcccttgccaggaagccctgaaaggaaactaagcagtcacttactcatgagctggtgactgcaaactatattctgaagagctgaaggaccagcgatgcttttcaattaggagaggagttcaagaggagttgcaggactgtcaggccagggaggtgcacagcagcacgaggcaggtggcttgtaccgaacctgcggctcagactgagagtgacctgataaggctgcaagggttgctgactttaactaaagacaatagtgatggaaaagtagtacccagggatgcttccatatttctgtttggggtgacaggctggatgttgaaaggaactagctgaggatgaggaagttagaggagatgctgtgcagatgtgacaatattaaggtcattgggccatgttgactctgaagcgcctgtaggagacctaggtgacaagaagcccactaggttagagttgagttaagatctgaccactgactagagacctgagggttgtcagtttatagatgacaagtgagaggagggtataagagcagtctggaagccagtgcatagatacatccctgagggactggtgcatgaagaaggaacataactctttctctaaaccaggaacatgcttggcataagccatgagcttgtgcaagacctcctgaccccaactctccaattttctttatcttctcaattgttggtggtttaacttaggacactttcaaaactgcttgctttctgggaattggggggctgcttgcctcttgagatgggtctcccagtgcccttgggaagtaacattcagattccagaggtcagcaagggtcaagcctctgctcttctctgtatatgatatacaatattcattctttctcagcactccagattcttgtgaggagaacaatgcagcccccaagatcatcaaggaaatacctggcaccctacaagatggacaaagtgacccaactgtggcttctcagcaacttgcagatctcagcatcctagagccacagggtagccccagtggagccgagcagcaaatcaaagccgaggactgtactaacatgtaagagcccacactaccttcttactgccccgtcgcagctgtcaggggccacgatctaggaaaaacacttacggcacttacagcacaagcctatttctcttcgcagctatgagaggctaaaaagcagaaggatttgagtgcaggtggtctcttggagtcatttgaatgagagcaccatgttatccaccaaccagttgaagtgggaaaactgatgtgggttggagttacggatatggggtgttttacaaccctattcatggggttgtaaggtctgagaaaagtagagcctgctatgaatgaggttattatagtattgccatcactaaagctgccagttggatgagttctttcactgttactactaccaggatggccagagaaggcaccagtgagtcaataattgacctctgtggtgctgacctaggcgtgtgtggcaactgaaataggctaacagcaggagtttgaggaaacaagggtcatacgttttctgtgagagtccaaaagaccagggggtaaagcagtaggaaatagtgtttccccttccactcttctgagagcaactcaggcctcccaccgtgtgagccttctgactcctagcctcagaagtgcagggcctgttcacaccaaggatgcttatataatattttctcaaattatagtatgattgttctccgttctattctgtcaatttttatttataaataaaatccattagaggctaggattaaatcagcaatcctccgtactctgtaactttcattttttacggcttactctaatgatggtttttaaatactttagcctctcttttagcccaccatccaccagaggtagtgggaaagaaaggatattgaaaataatagatttatttttaaaagttctttaaaacaactcttgtctatattgtctaaaaatcaacaatttaattcataggttaataatgatagttcagtccattcacaaacactttatagatagaccaacagtttaatttgatagagttgaaataagaaacacaaatgaacagagacagcgaggcctcagcctctgctcaagtcaagagatacccaaagagatgccaggaaaacttctcaactatgtctctatcaacaaaacgaaaatgaaccaagacacaagaccaacaaatgttatccaactagttgtataaacaagccaagtttacttactctgtcactgtctgttaagttgtttttatatgccctctaaacatcacgtgtcctgcaccagtcttgcacatgtgtctgtctcagttgacatcattttgtcaagcaacccaatacacaaaagtgacaaaaaactaacacaccaccaaaagcttcttactatgtttctctctcccaacaaatagagctccagtacacaatgtaagacagaccaatacgtgcatatggttaccaaagcagcctttctcttatgtctgcttcagctaaacattcccttacgagtctgtcttagtctttatttatttatttatttatttattacgtattttcctcaattacatttccaatgctatcccaaaagtcccccataccctctgtcttagtctttaacctgtgtctattaaaaaaaaaatactccttcccttgtttgccccaactaaacaccttccaacataactgactttttaaagaagccttaagttttcactccagtactcctttctttcttgggcttcctggcttcttctgccactgtcttgttctcacctctgcctttccatatctcagttccaagagtcttagcaggaatgaggatacagttggagcccagagagcgtactgttcaccagcagactccgcacactgtttttctgtttgtaataagccaagaaaaattatcttgtaatatgacatagagggacgcaggcaaagtgttattgacgaggaagatctgcagcagctggaaagaaagaccacacaaaaacaaggaaccaggaagggcccataagatggaccctgaggttgacaggaatggagtaaggggaaccggggaacagaaagtgggcttttgtagctcagggagaggagatcattgggaagaacttgggatgtttccttcccgctgggtatgaagaactctggaggcctcttgctacctacattgcaggtctgggggtcttctttttcttttttaattttatctcttcagtgctgctgttctctctctctctctctctctctctctctgtctgtctgtctgtgtgtgtgtatctgtgtgtctgtgatgtgtatgagacatgcttacccatgtatgtgtatgagtatgtggagaccagaggatagggtcaggtatttttatcagtctccaccttaataatgttttgggtgggtatatgtgcgctatgtgtacatttatgcgtgtataggtgcatggtgggtattggtgcgtgtatgtaggtcaaaattggcatcaggtatctgataattttatttttattgagaccaggtctcttgttgaacctggagcttgctaatttctgctactaagctagccagcttgccccggggatcctttcacggggcctacctctgcagtgctggggttataagtggctgctgcattgcctagatttttatgtatattctggggatccaaactccagtctttgtacttgtgagctacctagggaggggggtcagcatcctggatcagggccatgtgtcgcagccagggtgactgcctcctcaataatctactctccgcccatggcctgcagttctccagactttgatattgggtgaggaagttagtcctacaaaaagattgttttgtctgatttcttaactagcaaactagactgtttttccctgctcctccaccctggctgccacagtcccagtaacctgacgggcaagttaccaacaccaataccctagcctgcagtccagaattcagagtaaaaattggaaaatggcagtctcacgcatgagtcattcaagagcaatgataagggatttgcaccgactgttcccaaaacactggcatgcttttaaaggtcttgaagttgcaaactttggggttagggcagaaagttctatttgaatcaagaagtagagacatgcttactcttttttcgtttctttcaggctgatgagcccttcaagctgcatggtcactgttaccatctctgacacctctgaacaatctcaattgtgtgttcctggtgtctcaagcaaggtggactccagctcaactatgtaagaagggccatttagcaagtcttggtgtcctttagcatggggt

SEQ ID NO: 491 - DNA, 27 bp, mus musculus
ctgggccgccctctcgcccccgcctgc

SEQ ID NO: 492 - DNA, 2747 bp, mus musculus; identical to SEQ ID NO: 58

SEQ ID NO: 493 - DNA, 2747 bp, mus musculus; identical to SEQ ID NO: 58

SEQ ID NO: 494 - DNA, 937 bp, mus musculus; identical to SEQ ID NO: 60

SEQ ID NO: 495 - DNA, 31409 bp, mus musculus; identical to SEQ ID NO: 61

SEQ ID NO: 496 - DNA, 194 bp, mus musculus; identical to SEQ ID NO: 65

SEQ ID NO: 497 - DNA, 801 bp, mus musculus; identical to SEQ ID NO: 66

SEQ ID NO: 498 - DNA, 801 bp, mus musculus; identical to SEQ ID NO: 66

SEQ ID NO: 499 - DNA, 411 bp, mus musculus; identical to SEQ ID NO: 70

SEQ ID NO: 500 - DNA, 954 bp, mus musculus; identical to SEQ ID NO: 72

SEQ ID NO: 501 - DNA, 1004 bp, mus musculus; identical to SEQ ID NO: 73

SEQ ID NO: 502 - DNA, 7511 bp, mus musculus; identical to SEQ ID NO: 74

SEQ ID NO: 503 - DNA, 3304 bp, mus musculus; identical to SEQ ID NO: 78

SEQ ID NO: 504 - DNA, 6883 bp, mus musculus; identical to SEQ ID NO: 79

SEQ ID NO: 505 - DNA, 3287 bp, mus musculus; identical to SEQ ID NO: 80

SEQ ID NO: 506 - DNA, 15645 bp, mus musculus; identical to SEQ ID NO: 81

SEQ ID NO: 507 - DNA, 22662 bp, mus musculus; identical to SEQ ID NO: 82

SEQ ID NO: 508 - DNA, 14463 bp, mus musculus; identical to SEQ ID NO: 83

SEQ ID NO: 509 - DNA, 207 bp, mus musculus; identical to SEQ ID NO: 87

SEQ ID NO: 510 - DNA, 207 bp, mus musculus; identical to SEQ ID NO: 87

SEQ ID NO: 511 - DNA, 783 bp, mus musculus; identical to SEQ ID NO: 89

SEQ ID NO: 512 - DNA, 783 bp, mus musculus; identical to SEQ ID NO: 89

SEQ ID NO: 513 - DNA, 2815 bp, mus musculus
caatcactgacgccaacgatcgatgcctcagaaggtagttatttgctctggtgctttctgaagatggcggcggctaaggacggatgcggcctagaaactgctgctggaaacgggcggcggctccacttagggattcctgaagcagtgtttgtggtaagaaactctttctcagcgtcttaatctgatattggagattgctttccagtcacttcccaggtctgggtcgttgggaggaacagagctaaagggtcccggaagggaatgtctggccttttgcctcttcctgcatcttggctttttaggcctggcgggcgatagctttgaagaaaggtagtccaaccccggcccagaagagggagcagggaggagaactgggtagctggagacggatgcgaggcggattggggcgtggcgtcccttgaaactgaccagttgctgcctgttgtcgcctaaagaaaaacaaaaaacagcagcaacggttattgagctcaagaccgcagtgatgccggagatgtagatgggtggacatttagcacagagagcaggcagagcagctgtttgtagggtgtgggtactgagtggcacccagtcagcttgagcacggccgtggtccgtttccttgggaatggaagcagactgctgagaaaagtaaacgttagcacaaacgttaagtccatgtgttcttgcttttaagaattgaggcttatgtaatgggcaaccggctgttattaggtttttgaaaccattttatatttgcttttagtaatactatttaagcagtttgtagacaacaaattttatgcagttgtgaagattgtgggaaatgcaattggaaggtttcatgtaacaggaccgacccaagttaaatatttgtactgaagcatataaaatcttagtcaaaatttccttgattcttttttggtatgtaccaaaaattatatatattctgtcttattgctaacattcttcaaaagaccctttttttcttttacttaaatcacattttatattgtatattttaatgtgctggtggaataaatttttatgtgtattctcaatgttctgtgcttttaaaaatatttttcaagtgatctttacatgaagtaatattttctgaggttcagaaattttcttagaaaatttgcaaaactttatgagggagttactgttgttcaaattttgtagatgtagttgatgaaacccagaaatagaggtatccagaagtagcatttgagcagtcaggagagctttagaacctctttggtcatgctctgctacttagaggtgaggaaattttgtgttatttctcctgatcctattataatgcctgatatataaggatgtaaatatataaatttccattctgtcttaaatataacccgatagcagtaacttcagaaatggaattaatgaatacaaactttatctgagggatttaccgtaaaataaacttttatttatttattttatttatttatttttttgagacagcccaggttggcttagaactcactgtttggattaggatggcctcaaattcatagtgcctgtcctgcttctgctttccaagtttgtaggttaaagacagacactgtgacaactggctgtaaaattttatggttaaattttataccaacacgatgtaataagcagtccaaactttatataattatcttgatgttccaaaactaatggaagtggcatgatattttaacaacataaaattctatgtctgagagtatttgaatcctacccaacttccatcttgctgcttagtcttgagtttctatgggtgacaatatttatggacttattttgaaaaataaaatatgtattcaattgaattaaatcagtaagaaaaatgataactttggcacacaatttgctcaattctttagtgactagggcacatgagtaggcagtgtgcttcattgctagcaattttcatatttattactagagccacatgagaaatgtataaagcaggcaagttcatgtgtcttacattaaaaacagaaaaataaagaataaattacctacataatgtatgtaaactgtccgaaatggtctttcttgaactttttttttctttttttgagacaaagtatgttgtccaggctgacaactttggatcctttcgcttctacttcctaagttctgggataacagacctgtagcatcatgtctaacttctctttaacttttcttctgccagtgctggggataacctagggccacctgtcttgtaggcaagtggtataccactgagctccagggcagccatctttaactctttatagttaggtttttaattaaaaacaagctttcagaaaagaaaaattagttctctccagtggagtctcactaggtatattagccatactaacgggtggattccatgcagggcagtaaatagacggccaccacaaaattaattcaatcgtattgttgtagactttttgtgtagtattgtttgagtatttttctccctcctggccttttgcctggatgctttcatttcagattttgtgtttttatggattttttttgtttttaaaattatggctttttgtttgtttgcctattttctaaagaaagagaaattggggagttggagaggtgggaggatcttggaggagttgggagaggggaagttgatcagattattttatgaaattttttcttcaaaaaaaattaaatgaaacaaacctttgaggaaaacaaaacttgttcttttacattttataaacaaagtagtaaaaatcaggtttgtaatatgaatttaaaacttcgtatgatttttcatattaaagga

SEQ ID NO: 514 - DNA, 285 bp, mus musculus
atggccgacgagaaacccaaggaaggagacaagactgagaagaaggatcatattaatttgaaggtggcgggacaggatggttctgtggtgcagtttaagattaagaggcatacaccacttagtaaactaatgaaagcccattgtgaacggcagggtttgtcaatgaggcggatcagattccggtttgatgggcagccaatcaacgaaacaggcacacctgcacagttggaaatggaggaagatacaattgatgtgttccagcaacagactggaggtgtctactaa

SEQ ID NO: 515 - DNA, 285 bp, mus musculus; identical to SEQ ID NO: 514

SEQ ID NO: 516 - DNA, 30932 bp, mus musculus; identical to SEQ ID NO: 3

SEQ ID NO: 517 - DNA, 30428 bp, mus musculus; identical to SEQ ID NO: 4

SEQ ID NO: 518 - DNA, 7451 bp, mus musculus; identical to SEQ ID NO: 8

SEQ ID NO: 519 - DNA, 20896 bp, mus musculus; identical to SEQ ID NO: 9

SEQ ID NO: 520 - DNA, 20896 bp, mus musculus; identical to SEQ ID NO: 9

SEQ ID NO: 521 - DNA, 31 bp, mus musculus; identical to SEQ ID NO: 11

SEQ ID NO: 522 - DNA, 713 bp, mus musculus; identical to SEQ ID NO: 13

SEQ ID NO: 523 - DNA, 171 bp, mus musculus; identical to SEQ ID NO: 14

SEQ ID NO: 524 - DNA, 171 bp, mus musculus; identical to SEQ ID NO: 14

SEQ ID NO: 525 - DNA, 820 bp, mus musculus; identical to SEQ ID NO: 16

SEQ ID NO: 526 - DNA, 820 bp, mus musculus; identical to SEQ ID NO: 16

SEQ ID NO: 527 - DNA, 12681 bp, mus musculus
gggatttaaagggcccgctcggccgcgccgccctgggagccactgctggtcccggccttgcggcctgcgggggaggctgccaggaggaggtggcgacagtggcagcggtgcgcgtccccggcccccaggaccacggcttcctttctgccaggtaggtctccagtagtgtgcgcgcggttcccacgttcccatccttaagctggcctgcggggcgcggatctataccccttgtcctgggacctagtccgcatcacctataggactccctccctgctatgttccctgccggcacttccactttcctgcagtccctcgaccagggcaaggctttgttgccggctttttgctgagtagggtgagatgaagctcgcggaagatacatccatacaaggagagatgcacacggcccctaagtgtcacagactccccctttctgcactccacattgagtgactaccttggaaacgaaggagcccacttcttccgccccatttgatatataggtctagaatgcatatcatttttatcatcattgaacaagactgttaacaacattctagatacacaaggtccttcattccctgcgggtcacagggcatccagaacacccgctgatatcacagttggtggctcagcccgatgtacctgatattcatatcctcccccaaagccttccaatagcaccctggggggttggcagccccaagctgaagtcctgagtgctcaaatcccaaccttgattgtggacagcaccacggacatctcactccctctgtgtcctccctttggcagctccatctgtccatccatctgtgtgggtccacaatggccaccttcagccgccaggaatttttccagcagctactgcagggctgtctcctgcctactgtccaacagggccttgaccagatctggctgcttcttaccatctgcttcgcctgccgcctcctttggaggctgggtaagtgcctaccaaactgtgttccaccacaacagattttatcttatctgtgacattcatggatatcaaactacaccttaccccaccacatcttaccatgcaacgtcctgcaatgccaaagcaggtccctacaggtccagccccatcatatcccattaagctaagccccaattccaccacaacacatcctttacatacagccacctcaagccacaccatggcaagccacatcctgttaaaccaagacatgaccttcagcattcctgcactctgagacggtgggatccggaactgtctgtgttccaaggtgttccaatcagatcctggaatgctgctgttacaagtatcctatcccaaagcgtcctagttactaggtatgaagagtctgccaagttgacattttcacatgctggacttccaaaaatgtgacattatgaatgtctataatcaggacattgtgaaatttctggattctttgattctataatgttcctgcagttatagcaaagtcaatatccaaatgggaaagttctgaaatccccaggattcctctaggatacaggcatttgtgaaaatcaaacgttctctaatcaactctttcctcttcatcttaagtgggtgctttctttcccccccccccagctttattattttgggacatgtcaaagctactgaaaagctgaaacaatattaatatacatttacatataaaagccagtcaccctggtttcacagctagccacaatagactgctctgtcttcctgcctgtctatcccgtcctcctctttctgaatcatttcaataacctgatggcatcaggacccctcacctcaagtccttccgcatatggtccttgagaacaatcccaccccatacagaaccctagccgcatccatcatccccacccctgtgacattttaatatggatgcagtcctgtccaacatcaattgataaattttcctttcagggtccctgaaatgtccttggtagatgttgctttttaaacccaggccttgccacacgtgccagctctccagtaccagctttgggtccccttagaccccagcatgttctaggcttttgcccaagtccttcttctcttgccagcctaccaacctcccgcttcttgttttcccaccctgcctctgtctctccctctccctctccccctaagggttaccgtcttacctgaagcatgcaagcaccgtggcaggtggcttcttcagcctctaccacttcttccagctgcacatggtttgggtcgtgctgctgagcctcctgtgctacctcgtgctgttcctctgccgacactcctcccaccgaggcgtcttcctctccgtcaccatcctcatctacctgctcatggggtatgggtgtgcatcctcaccctccccttgttggcagaaggcaggcgggggggggtccccaaggccttgatgaagtggtccaagataggatggcatgagattctaagaaagtgaaggagtcagggaccagagaggatgacgagtgttccagaaggagacctgaaacacgtgtccttccgtgaggctgtacaggataggttgaacatgggctttccctggaggagggggtcctggggattttttttttcttaatgtgttatatgggttaggaaggcagaaccccttcaatacctccgtgcccccggtagtgtccaaagccctaggaggcataggcccaagaccatcaccttttttcctcagtgagatgcacatggtggacaccgtgacatggcacaagatgcgaggtgggtagctctctgccctcccacctgccctcctcacctcctgagagccctcctggaccttccccttcataaaccaaccaccatacagtgcaggcttccctttcccctgacatctttgtctctgtctctttctacctatcactgtgtctcccttctcctctcatctcacacttggtgcgccctatctttcatggtgacatgctttcttatccatacacttgaccatgggccccacacataggggcccagatgatcgtggccatgaaggcggtgtctctgggcttcgacctggaccggggcgaggtgggtgcagtgccctcacctgtggagttcatgggctacctctactttgtgggcaccatcgtctttgggccctggatatccttccacagctacctacaggctgtccaaggccgcccactggtgagcttctgggtggccaggtgggcagggactgtgggagccgccatggggcagtgctcatggatccttgatcccacagagccgccgatggctgaagaaggtggcccggagcctggcgctggccctgctgtgccttgtactgtccacttgtgtgggcccctacctcttcccctacttcatccccctcgacggtgaccgactccttcgcaagtgagcacagccttcaaggccccccgtgtagcagtgagggggttgggtagaaggctgggtcttcccaattctgagcctgtctcttaatgcttctgtctgtcttctgttactacagcaagaaacgcaaagccaggtaaatgagggcaggtgctgagggcaagtgggctgaccagggctgggccttgggccaattgcttccagacatctgaatctggctgaccatctaccccattaccgcacagagaccaagtgtgtctgtctgtggatgtctgtttgaccaagatttggctctgtgactccatgtgtgactgacactccaacactattgtgtctggatgtccttctgttgtaccactagaaacaagttctatgactgaaatgggaagcggcaagtgtgtattagttggtgactctaaactgtctgtgactccagataatttgacttgtttgcctgtggccactgactcccctgagtgtggaactgagaatactgactggctgggctgtgcatcatcagtggtgggcttgtgtggctgtcactggctagggtaaaccttggtgggtgattctggcttatctgtaactctggtttgcctgtacagcatgcagtgtgcccgcttatgattgactctgccagtttgtctgccttctcagaccgcttgctgctacccgaggaaaggattgtgacaagctgtgagcctgtgtctgtgtttgtccaggactgtatctagctgtttgttagcggtttgattgtgtgactttcttcctgtacttactggctcctggttctgtctgatactgagcaagactccaaaaagtaaccgggcagtagtggcacacatctttaatcccagtgttcgggaggcaaaagcagacggatctcttagttcaaggccagactgcctgatctataaaaggagttctgggacagctagggctacacaaagaaaccctatctcaaaaaaagaaaaaagggggaaaagaaaacaacaaaagagagaggtgagaggggagagacagactccaaaaattggaatcacttgaccagtgtccctgagttaaacagccgggcacaaaactcaggcctaatcctatgtacaagatgctctctgcttttgacactgtctgggaaattgacagtgtgtgtgtgcactgtgagtgtttaactgtctctgtatctcacaacgattttattttattgtcttagaaggtgacaaaatctggttagagagctgagaggctgagaaccttttgtctggctgtgaggccattttagcgtgtagggccatgtcatatgccagctcgcccattcatttgggccacatgaaacctatcacctgacagtgtgtgtgtgtgaccatcatagtctgcctcttttgctaccatgtttctgtcttatctatgaagaactcaggccaacttccaggccctctctgactctcttttctctcttctctgctgcattcctgaccccttggggccctaggggcaccatggtaaggtgagtctgtaaggccggggtgccatgaaacatggggggtatcgtgtcggggcccaaatgtaatgcctctcttcctggcccttcacaggtggctacgagcctacgagagtgctgtctccttccacttcagcaactattttgtgggctttctgtctgaggccacagccacattggccggggctggcttcacggaggagaaggaccacctggaatggtggggagggctttggggccccttctcccacagggtgctgcctggaggaactgtagggcggtgggtggtgctcctgggaagggaccagtcaagacaaaaagaaaaactatagcagccggatagcttgagattccaaccgtaatggaatgtctgttttttgcccacagggacctgacagtctctagaccgttgaatgtggagctgccccggtccatggtggaagttgtcacaagctggaacctgcccatgtcttattggttaaataattgtgagtcacccagtcaccactccagaatagttggtgacccagggcctttcatgcatttgtacagcaaacatttactgagcaactactgtgtgatgggcactcaagctgcaccaggggctgttagtgttatttcagtttatagagtgtttgcctagcattcatgaagcccaagatttggcccccagcaccacgtacaaactgggtgtgtacctgcctgtagtcccagctctatagaggtagaggctagacagtcagaaatccaaggtcaggctggagagatggctcagtggttaagagcgctaactgctcttccagaggtgctgagttcaaatcccagcaaccacacagtggctcacaaacatctgtaatgggatgtaatcagatgccctcttctggtgtgtctgaagacagcgactgtgtactcatgtaaataaataaatctaaaaaaaaaatgttaaaaaaaaagaaatccaaggtcatcctcagctgtatagagctgttttaagtcagccttggatccgtaaggtcctgtctcaaaaataagatatgttagggacaacaacaaaaccacacaacatttgctaacctgctagaactgtcaatttggagagtggataatcaataagaaagattatgcagtaagtcaggtagtggtcaatgccacagtaaatcgtaatgatgttgaaacgagaaagagggaataaggagtggtctgggaattatccataatttatccagggaacgtttcactgaggaaagtgaaggaacaaggagtgtgggggaaggaatggaacagatggcgagaacagcaggtgcagaggtcctgaggtgggagttcacctggtgtatatgagagacggcaagacaatcattgggggcatggggacatggctccatggtgggccattgtaaggctcagagttgcatccccagaactggaagacttaaggtctttgggcagacccagggaggggtagtagtaggacatgagttcagagagatcctcaagaggctctgggacctaagaagtctttggctttttctttgagagacagtcactctgggtgaggctgggatccaaggggagtcatttggttttggtttttgttgttgttgttgttgttttttgtttttccagacagggtttctctgtgtagctctggctgtcctggaactcactctgtagaccaggctggcctcaaacacagaaatccgcctgcctctgcctcccaagtgctgggattaaaggcatgtgccaccatcacccggcagaggggagtcatttggatattggatcgtaactgaacccctttggctcgacggagggaagtggagggaagatggatggggtgaaggcagtgaggcccacccactgtagctgactgaggattagcagtagtggtggcaacagcccatggtgagaagtgggcttctgaaggaagagctgattcgatttgccaagagtgtgactgtgtgggaagggagaactttgtcctgaggacctggaagcctgcagggttggctctgactgaccttgggaagtccgactaaagcagactgggagttcattttcaggcttgtgacagttgagggcatcctaaagatgttatcctgagggtcccctacagattatggttatcatcctacctgtgattctctggaaaagttggtgggagttccagaaatcttgacctgtgtctctcccacctgtagatgttttcaaaaatgcccttcgcctggggaccttctctgctgtgctggtcacctatgcagccagtgccctcctgcatgtaagcaagacagaccatgaacaaggggaagtgggtggggggattcagagcctcctcttcactctccttgtccccttgtccgggtctctagggcttcagtttccacctggctgctgtgctgctgtccctggcattcatcacttatgtggaacatggtaagtgcacacagagcctggcacagtacaggtggaaggttcatgggaggctggggctaacctttccatactgtccagtcctcagaaagcgcctggctcagatcctcagtgcctgcatcttgtcaaagcgttgtctgccagactgttcacatcggcatcgcttggtgagggttcatcacgggtaaccttgtacctaacactgcccttcaaaaatgtcacttctgtctccatcttgtatctgtctccgggtacccagcctcctcttctggtgcctgagccatccctaaagcctcccctctattcactggcatctgtttctctaacaggcatttattgagcacctgctgtatactcacctggcattcgtttcccccactgaacatttattgagcacctgctggttctaggtgctggagacaaagtggtgaactaaagcaggccaaagtcctggccctgtgggacaaagattttaattgggtagacaggaaagtcagtcaaggctaagaatagcttgtgaggttgcgagtggcactaagcataaggggacgcggatgggacatatggtggtggtggtttcccttttcactggaaggccaggaaagcctccctgggtgaggcaacttttaagttcttctaagtgaagaagggaagggagggaaacttctcaggaaaagggggtacccagtgtaaaaagccccaccccaacgtgggcctctgagcaacagtgtggcttgagcagagagtgagggggaagggaaagatgggccctctaggtcagggcggggtttgttttggttttgttgttgttttcattctgtttgccataaaaaaaaatgcagacaacctcacatttgtctcccacccggcaaagatgctcatcaccataaccccacattcttgctcctctgcctgaacgctcgcatctcccccaacctggacgccctcgtggttaccaacaccctcgtccttggatacctctgagctcccataagagactccttgaaccatctctttcctatcttggggtaccctgggcatcctgggacccacagtgccttgtgttccccctgggcttccctacacaggtggtggtgggggacagtgaccaagtccagctgccaaatatatccatctgtccaccacagggcctgggggtacgagccttaaacttgctctttggggccctggctatcttccacctgtcctacctgggctccctgtttgatgtcgatgtggacgacaccacagaggagcaggtgaggtggggccctgggctgggaggtaaaccagggatggcagttactgtttgggggaaccttgaaggccaaggcagtgagaacaagccaggaccatgtgtcttagcttgtacaaatgccttccttcatcttcgcactgtctctcaaattcagtcatgctgctggctctttcctttgactaaactgcaatatttacttacttaccctctaaaatgcattctcctgcaatagaatacaaaatccaggcttttctctttttttaactactaggaactgtgaatccaggccctccttcatgttagatacacttgctatacctcctagccccaggttttacttttgtttgtagctttgcttgagacagggtctcagatattctaggctggcctcaaactcagtatttccccaaggtgatcctcctgtctgtacttcctaatgggttgggattacaggcatgcaccaccacacccagttttgtggtctgctagagaccaaaccaagagatgcaaggcatgtaagcactctactgtgttacacaccccagccttgtgtatgggtgtggatgtgggtgggtgggtgggtgtgcacacgtgagagggataggaaagagaggagaggagaggagaggacaggacaggacaggacaggacaggagagactgacttgtgtagctcagactggtctcaaggttattatggagccaaagatgaccttgaatttctaatcatcctgccgccacctcccttgaggtacattatagacctgtgcctctaggtccagtatgctgtgctgggggcagagtccagggcttcctgtgtacagagtagtcaatgtaccagttgagctacgtcgatagccctggatcctgctttaaaatgttatgttccttgtagtggtagtgcacacatccaggtgccagctacatgggatgctgaggcagggatggcctgtgagtccaggagtgttgccacctgtgcaacataactgagaccctactttgaaaaaaaattctcaatttgaaaattagttcatatggcttttgaaaaatctaaaatttgccctttttgggggggtgtcttactttttctctttcttttttttttttcttttgagataggatgtcataggagtctcaaactcagtatcttctgtcttagcctctctagtagttcaattttttaattttgttgttattttcgagacagggtttctcagtgtagccctggctaccctggaactcactatatagaccaggctagcctcaaagtacttttatttttatttgtttatttatttatttatttatttatttatttattatatgtaagtacactgtagttgtcttcagacacaccagaagagggcatcagatctcatgatcggatggttgtgagccagcatatggttgctggaatttgaactcaggacctttagaagagcagtcagtgctcttaactgctgagccatctatctctccagcccctaaaatttttttaaaaagatttatatatatgggtatcccgtctgcatgtatatacaccagaggaaaacatcatatcgcatggaactacagctacagatggctgctagccaccacgtaggtgatgctggaaattgaactcgcccattatactggacttctggaagagcagccaacgtacttaactgctgagccatctctccccaattttaaaattcttttttttaagatttattgattgattgattatatgtgtgtatactgtagctgtcttcagacactccagaagagggcattggatttttgttatagatggttgtgaaccaccatgtagttgctgggatttgaactcaggacctttggaagagcagttgatgctcttaaccgctgagccatctcaccatccccaatttttaaattcttaattgaaaataaaatttcatgttactttcctaattacaaatatttttttagaagttttccttgggctggagagatagctcagtggttaagagcacagactgctcttccaaaggtcctgagttcaaatcccagcaaccacatggtggctcacaaccatctgtaatgagatctgatgccctcttctggtgtgtctgaagtcagctacagtgtacttacatataataaataaataaatcttaaaaaaaaagtttttccttcagattgagtgtagagaatctgaatttgcagctaggcactcaggaggcagaggcaggccctgtctctgagctcaaggccagcctggttcatggagttctataggctggcctgagttccaggacagccagggttacacagagaaaccctgtctcctaaaaaaagtaagtaggtaaagctctgggtgtttttttttgttttgttttgttttgttttgttgttattatcatttcagtccaggctgacttgaaacttgtttgtcaaatctcagtctccctagtgtgaagattacttgtgtctctgggcagtggtggcacacgcctttaatcccaggacacaggaggcagaggcaggcggatctctgagttcaaggccagcctggtctacagatgaagttactggacagccaaggccacaccgagaaacgctgtcttgagaaaaagaaagattacgagagtcagccgtcaagcccactttggtttctttttagagaaaacgttgctctttgtttcagcctcccaaatcgacattataggcgcacaccaccatgtcaggctttaccacttcttaaaacattttagttctggctgtggtagtacatgattttactcccagcactcaggaggcagaggcaggtggatttctgtgagtttgaggccagcctggtctacatagtaagcttcaggccaaccagggctacacacacacacacacacacacacacacacacacacacacacacacaaaccctgccttgaaaaaaaagactttaaggctgggagtatagctcagtggtagagcctttgtctgcctgccatgcttggaatgtgatctttagcacccctaaaacaaaccaaaaaagtaagtattgtagagactcactgcaaaatgtgcacacattcaattttattctattaacccacttcctcaaagcatatcaaaaacatacactctatattttaatttctttccccttgagacagggtttctctgtgtagccctggctgtcctagaactcactctgtagaccaagctggcctcgaactcagaaatcggcctgcctcccaagtgctaagtgctgggactaaaggtgtgcatcaccacgtctggcttcccccaattttttaagtacacagtcttccttttttttttttttcattgcaagaatttgtcagggtttactttgtcctgtattggtagacactcagatttctagtggtctcatatacaaacgacctcagggatcagcatgacccaccacatccaacatatttttaaaataactctttttggtgtgctggaaatcaaaacctggggcctccccatgtagaccctcccatcaagctgtatactcagccccttaaaatgatctttaaagaagaagaaaccaaactgtatctggtcacccttgataagcacctagacccttcttttactcaggaatatgaaataccaaagatccctgggcaagagatgggttttccggagactcactgtccttgttgaatttcaaaatcatgacttgtttctctcccacagggctacggcatggcatacactgtccacaagtggtcagagctcagctgggccagtcactgggtcacttttggatgctggatcttctaccgtctcataggctgaggcatatgaccatcataatccccttcaatacccctccttagggtgccaactctgatgggggatgagaaaagaccctttctctactccttttcccttatccattcttgacccccaacacccctccacacaacataggaacacacacaactttctatgcctgtcaatcctcaccccgccaccaggcaggaagggggtggtccttattgggccaaggaacgatggatacttgggaaagcagacaggagcagatccagggcctctgcgcctgccgtctcccttttttatatgcagtttgttattgtcgaataaaagtagaacttacacaacaggc

SEQ ID NO: 528 - DNA, 12681 bp, mus musculus; identical to SEQ ID NO: 527

SEQ ID NO: 529 - DNA, 655 bp, mus musculus
caggcgcgggcgcgggcgcgggctgatcgcttgctgaagattctctctgcgtttgctgtcgctgcagcagcggacgacctccttagggccaggcgtcccagctaggcaagtccagttgaccactcggtgtgcttaactgagacccaaggtacgacttcttggcgcggttagcgccgctttcctgttcgggaggtcccgctccaggctcttcggaccctcctggcgtcctcgtttgcgtcgggaagggcggcagcggcgcccgggcatggcttcggctggcagcggcatggaagaggtgcgagtgtcggtgctgaccccgctcaagctggtcgggctggtgtgcatcttcttggcgctgtgtctggatctgggagctgttctgagcccggcctgggtcaccgcggaccaccagtactacctgtccctgtgggagtcctgccggaaacccgccaacctggatatctggcattgcgaatccactctcggcagcggtgagcgcccccaccccacctccggtgccgcgccccttgctcccgcgtggccatcctgggctcctccgctgccaccgcctctctgggagccacctcccccactttccttcgctcccctccctgcctccttgccctaccttctcggcccttggaccccaggaccc

SEQ ID NO: 530 - DNA, 27203 bp, mus musculus
caggcgcgggcgcgggcgcgggctgatcgcttgctgaagattctctctgcgtttgctgtcgctgcagcagcggacgacctccttagggccaggcgtcccagctaggcaagtccagttgaccactcggtgtgcttaactgagacccaaggtacgacttcttggcgcggttagcgccgctttcctgttcgggaggtcccgctccaggctcttcggaccctcctggcgtcctcgtttgcgtcgggaagggcggcagcggcgcccgggcatggcttcggctggcagcggcatggaagaggtgcgagtgtcggtgctgaccccgctcaagctggtcgggctggtgtgcatcttcttggcgctgtgtctggatctgggagctgttctgagcccggcctgggtcaccgcggaccaccagtactacctgtccctgtgggagtcctgccggaaacccgccaacctggatatctggcattgcgaatccactctcggcagcggtgagcgcccccaccccacctccggtgccgcgccccttgctcccgcgtggccatcctgggctcctccgctgccaccgcctctctgggagccacctcccccactttccttcgctcccctccctgcctccttgccctaccttctcggcccttggaccccaggaccctcttgcatgtgcccctctctcgaaggggtccgggtaggcaagactccagagacctcctacgccctctactcctcccttgctcatccctccagttttggagtaacacgtctgctattttgggcaattgttatcattgagggcgagaaccatgtggctgtgtaaaagacgcaatgccttccacacccccgttagaaaagaaatgggtaaaacgctccaaatctgtgtgggttctctgttccaaccctctaagagaaatttgcccaagttttcctgaaggcccacatttccccctattctatttcactttacctggtgtattggctaggaaccctgactaagacacctggcttttcccgagtgaattttcgtgtgtgtgtgtgtgtgtgtgtgtgtgtgtgtgtgtgtgtgtgtgtgtgtatttcccctttaaattttggggagggataccgagagtcaggagagactgatgaattttctttccttttttggcgacaccattgttgcttctgagtttcctttctttcactcccacagtaagaaactcccctttcttccactccgttttctctgagctagttactcacagttgcctggaaagttctgcttcattcagcaagcagtgaaaattgtgtgcggatgggaaacggggtagagtaggcggtagccattgtggctactagctcaaagggactttgtggctttattctcttcctgatcctctagtttttgtttttgttttgttttgtttttaaccccatttccagagtcccattcctaagaatttgccaacttccaatttcttgctgaaaactattgctacttgaattctgtttcttcagctgctgctgtgtgcacagattaaggaatgtaaaagggaggctctgctgggtgctttttttttttttttttctttttaatgctggcgcgcgctaacacacacacacacacacacacacacacacacacacacacacacacacgcacaagctcacgctcacactcacacactgacctgagaaactcattaaatcccttcttgatagtttcaagtcttttctgaaacaatttttttaagctttgctggaaacgtttcaagttctaataaagttgaaatagcacaaagaccacacacacacacacacacacacacacacacacacaaatccgacttttctttgtcttacgttttttgttataggagaaattagttcacttagttaaatttcttccagaaatttaattttgtgcttacaaaggctttttctttgctgttacctcagaatacctattgaaggctttctttgttgattgattcttagtgaaggggactggttggcagcaggaggtcaacactcaggctttttaattctttcaggattagttgtttacaactgaagataaaataaacccacaaaatgcctttctttggtaaccaggggctccaaataaactttggaaaaaatatcttttctttctcccttcaatagaaatggaaatttatgtaggaatgccagcttcagcagatctccttagcaacgtgaatcttttgcccccttcactctgtctcctgaaataatagccctctgattgcataaagacttttcagataggttggagaaaccagcttcagctcccatttgctttttaggctattatccttttctcttggcttggaatgtggggaatggacgaaaagcagcttcagtttgtttgctaatctttccttaattgcctccataccgattgattttagctacaaagaaatttgtaactggaccaaaaagaaaaataaaagaataaaaaaacaaaaaaaccccaaagatttcagctgggcaaatacggagacataagcttaatgcaaatatggtgtccataggactgtggaaagggaaaatcaaaggcaagcatgctttctgagccccccacccccgccccagcctacgccccttattctatctccatgtccttcaacttgggttcattggcttcaatttgcttgaaaaaaatagttttctgtccctctaaaagatgacaagatgtgttacaagtagtacaagttatgtggaagttcttgactttgtgtggtagcagaaaagttgtgaagggaagggccaaaacacagaaaattgctgtggccacttagaaaatgtgctcctagagatgttatatggacttgaagcttctatcaagcagtgttttaagacaaagagggacactaggatcagcccaggaatgctgtccttgtctgttccaatggtgggcagcttatttagtctgtttgctgtacagagtagcagagggataggagcaaaatgtctttctgaagatttttaaagatcgacttcattctctctggaaaatcaattactttgggaaaacccaccaaggacagttttacttcgccaggatcttcaggacttaattaaaaacctttgttttaattagacaaggttttctttcaagaaggaaaaattctggaatgtttttcttctgaaaacaacattccctacttaggcccagtttctactgaaacatccccctaagccatgatttcaaacttgcatttgaattttggtaccaaatatgcctagtttgctgttgataactgtttttgtggttttaagctagagcagagccatgcctcttgtgtcctgttttattgaaggttgcgtcagcacttctagtagaaagcagtaatcgggttgtcagtcagccagaaagcttttcactagagtctcaattcgcgatatgaaggatagcactggcattatctttgcttgtatgttttctaggaagacaactgggaaaagggagaattggctgtcactgatagtatggtgggggaagtttggaatatgcagtaatcacatggttgcctgctccagaatttttttctaatgatgattttccccaggacattggtacagcattttaatacgtcttcagtcctatttaaagtttttacaatgtttaaccactgcttcctgtttagtttgataacttttcccctaggatataatagttagggtttcatagccatagcaattacaagagaatacaggattaaggttccctaaactccacatcaagaagttgtgtaattcctagaatgattttatgtttctgctaaaaacaattaatatgtaactacttcccatgaagcagatggcttattactgtctgttttttgactcagcaaaatagaaaacataggtgactcaataaacaggtttaagagtgatttgggactatagcaagggtgtgtttaaccatttttctatcaacaaaacacttgatcaaatagtacccttttcacgaaatattaatagcatcatgggtgtacttccctaagaataagctgcatttgtagcatgagttattggtagttttgaaatgacagggcactctgtgctaaaacaggtgaatattattattttcagttggcagaagctctttcaagagtgcttatatgtagctcatgtttttaacttcaatataaaaattccctttaaaaggaatttatgactaaaactatctgaggtgtaatttaagataaatggaactgtctgaacacctgcaattcctagaaattctaagatacagtgattccaagttcagattcatgccatctttgcatattttgagattacaccttgatttggaaatggaatttcgtccgaaaacctcacaatatgatttggtccaagaaggtttaggtgctcccagagatgagttgacactgataaatgtgtttacaaatagcaagctgcctacttactacaagtataccctcttccagtttcttctacgagaacatcatcagggaaaatgcacgagtgggtggaaaaagtaccagcactagctagcaccttaactaataaaccaaagaaaacccaggatgaattaaatcaaaatattcatgatggttttttcctttaaggtcttcttggatttcaaattcactaaaggatattttaatttgtggtcaagtagaatccttcttttgctcagactcatggagagattatagtctccagggagtcccttagtggagtctattggcaacaaatgggttttgataggagtgtgaaaactggcgtttaaaacaaatggtggcattgcaaagcaacaaaaccacaacaagcaaacaaaaacttttctcaagcaaaagatctttcctgttgaaaagaaatgaatttcaagattttgttcattttgtttattaattatacagtttagagagacctaagtatagccaatatttctggtttctattaatgaaagtatttgtaggtatttcaaaataagtctccacaataatcttctgtatgaactatgctaaattatagcataatctaatggtaggacaaagtactattatgaagaacacatgggacttcagctcccttctggccagaacttggccactcactgatcaacttagcatatacaatgttcttaacttcttcagatggcatgtcatgaagtttaaatacatgaaatattatttttctttcatattatatctttagaaaagtaaactcaatgttatttttcaatgcaagtaatatttccttttacattggatagtgaaataattgtttttgtataagaattaaatattggtctgaattaaatattggttacatagcatttaataaaacccctggtagatcatggccagagaactatattatcttagtagctacattttattcaataatattaaaggccaaatacctcacttacttccagtgtcatattaatggctgtgtaatgtttcccagaatactatggactttcgtaagtttaccgactctcaatttgtgataagagatgagcatttgctcatttcactagttcaaaaaacctaactctaccaacatttagttgtataaaataggcatactgtggaatactgaaggtcaggaatgcacgtagagcataatgagcctaacttgtccataacccagatatctgcagtcatagctgagcatgccttttacagtaagggactgggatattaattctgtaggatcctgttctgaatccttttgctcaaggatttggcactttgatgggaaaggttgataggcttgtcttgcctccaagcacttgcaggcagtctttagcatggggatctcaggataattagactggttaccgaccaagtgagaattttaattgagctatcttctctgtgaaccagctgggaagtcttggagctagctctcctattacatcatattggttacacctagccacatggctagctcagatttaaatggagagttggattccacttctcaatgatattcaataatattaaaggccaaatacctcacttactcccagtgtcatattataatggctgtgtaatgtttcccagaatgtttaccaggctctcagtttgtgataagagatgaacatttgctcatttcactaattcaaaaacctgacacaatctccaaaatctttattgcctttgaagagcaaagaaaactacttatgtagctttttcacttgatttttctaatgcatatataaataacccatggctaggataaatactatccttagccaatacatggcttcaatgattggtcacttctaagaatttagaatttatttgggtaggatgagatgagcctaaaaacttaaatgcaaatatgggtggagagctagataggtacatatagatacagccatctttgctctttgagttcatacaaccaaagatcaggcccattagaaattggtttaaatatttcatgtcaagggcactgacaaatgaatctacaactcttcagattcttagatcatctcgcttgaaaattagagaagggcactttaacttttgctgttagatttacattggattggggaaaactagtaaatacttttgattttcttttcttttggaatctttgccacataaacaacaaagaaccccacatataaagtgcaaatgtatacaagaatgaaggacatttgtggtctagcaaagaaccaggaaaacatatgtggaccattttagtttgtcagcacgattactaactgttgtgaagtttaaactgataatttaaggagtcatttctgtattgtgtcacaaactttgcatatagacagtcttttgttaaactgtttgtctattagaaaaaatgtaggaaaaatagaagatgaaatctcctcaattctctattatttgtatcaaaatgggcactaaacctaaaattcaactttttttttacaagagaatttcttgatgccatattttaagacttctaaaccaatagtcacaaaaacattgctattgtctattgagaataatactgggagactatttctagcaccatctccattttcttactgtcttagaaagcaccactaagttgacctcattaattcattaaatagcaaggggtagatccctacctgaacttagccagtaagtcttctgtactatgtagggagactaagtggttggtgaaacaaatgatacaatttaagctaatgaaataagtttaaaacttgctggaaatgaagcattagaagttcttccctgggaagtgagaaacaaagagctttctgagagattagctcgccagttttattctcaagtatttactcctgcattgtataatgtctgtgtgtctatttgaagatcttccttcttttttaatgttattagctgtcttatatgttactttcgaagcttatagtggctagaagggtgtccattctgtgggttttcagcttccagctttttccaaataaacccaggtattttgtctttttcaattttctgtgcttgtttttcaagacagggattctctttgttgctatggctatattggaacttgctctgtagcctagtctggcttggaacagagagatctgcctgcttccctgagtgctgcaattgaaggcttgtcccaccacaagagtcctctcctctcctctcctctcctcccctcccctcccctcccctctcctccttctccttctccttctcctctcctctctctttccttctctcccccttccctcccctccccttccctcctccttctcttctcttctcttctcttctcttctcttctcttctcttctcttctcttctcttctcttctcttctcttttctcctctcttctcttcctccctccctccttccttcctttctttttcttttgtttctcttttaagaattgaatggaaaaagccttcagtttaccaaacctaataaatctttgaacaaatattccttagtagttactactgagaagtagcagtgcttgctagctaatagcatcatcaaatgccagtgaaagttttctcatatagcacatgaagatacagcagtcatttggcatgatgttggctttctttctttgtaagtgctaaaacatgctttaataccaaggctctttgctaagcactgtatataacagttttatttgagaggaaacaccatatgttacagcactcagattttaaattatatttccagagatttctaatatacaactatgtgaactagctaagaggtccttttgttaaagaaaatggatgtttattctttgaaaactagcaaataacagctttaagggtttgaataaaattgtcatgattgaacatgaggaattcacctgctactgagaacattttttctttaaatatattaccgtggtgtttttagttcctaatgatagaaaggaatttacaataatgagttatctttcaaagttgtcatcaacataatttaattgaaaaagttttgttataaatatatcctacaattaaattaaattggtcagatatatttgttagataagagtgggtgaaagtagtcaaatttatttaggtagattatggagaatttggggaaaacttatgaggagtgaataaaaaatgatttttattatttgatctactgagtgactttcactaaaattatggatttcattttaaataatataatttcctcctaggggattaaagatgaaaatacaggtgggtgctagtaaaattttattgtgattttacaagtttgtaaaaatttatatttcaatttctaatgagaattttagaaaatggtaaataatttattatagcaacatattatattaatacattaagttaaagcatacattatatttagagaaatactgttcattcaaacaatagaaccttaattttaaaataaaagtgcatttctttttattgtatctacttttgtgaaataggaataattttaagtttggagagatatataaatgaacttagcaaacaaaataaacatgtatcctcattaagattttcctttcttggaaatcattaatgaattttgactatgaatttccctgtgtgaagacagttctccagctggacagttgtaccataggctatagaattttcataaagtactactaacttctgaccagtctcacgtattacactgctaaaaataagtcagcacaattctgtagaacactaatgtatttatagacaatggaaagtctgatgcttgtgagtaaaaataccttgaaagaagactcaaatttagttcctgaactgcatgttaatattgaacttaatagtataatacaaggggcttcctgattttgttctgttactgtggaaggaaatacttcgtatgtatgcatttttgtttgtttacttttgcttttgtttctgttaggaaaagtacacagttgttttaggttgttgcttccctaagtttagttccaatgtctccagtgtattcctttatcatttttgcccatatactcttgagggaatgtgataagtaatatggcaacgttatttcattttgtatgttatctggccatgtgagccctcacccattttatacactaagaatgctaagaattgtatcaagattgattatcacctgttctctcagatcttaggaaaagaagtacagatttgcaatcagctgccctaatattaaagagaagactacagtgtttaaatcagtgccataggccattgatgttctatagaactgctttttatatgtactgttccactacagtatcacaccataatttacagaaaattgtaaagcgaatacagaaccattactctcagggttttatactttatctgacccagttctatgaggtatttaactggaaagaaaaacgaagatcaatatagagattaactgatagtaaaaacttaaaacacatgactttctttttataagaagtagacctgaaaattacaaatgttactatcttttaatttaccttacagacattgactgttaggtatcattttttttttttttaactaaaatactactgaggtaaaactgagtattttggtcacttgttagtgtattcctttataattgctcggattttgcatgcacttgtgctaaatccaatttttagatgttggttgagaaataaatattataaaccccaacctggtactttagtgacctaagtatacataaatcctttttacttttgtttttaattcttgatatcatagtattgttcctaatgagaaaagggaaatgttaactatttatccatgactttaagatcccctcttagccttgtcctttggattcgaggcttctattggtgcacaaagcaaaagctctgttcttagctccagaggttcaaacagagacttataaagcatactggacctccctgattatagtagcccttcataatcattgtttatgctggtgaattgagtattatctgactgggaatgtgaagtttaagtcctaggcaaacactcagcccgaatgaatccttgccagtggacattatgacaatacttaaaaacttggcactctccaccaggaatatagtcttgcttttccagttcaaagccatggcttctggccaggacagtgacaatcatggcccattcctagtatctcttggaaaattaaatagcttttctgtttgagctgtagctctggttgcagaccaaaaggaagggtaagagtatcacagtaacgatggtattgtttttccttgttgactttgagtctagagagatgttctgcattagccataaagccatcactaaaaattaatacaggcaatctagtagaaaacccagaagtgcctctgttcatttgcttttaatgtcgttcctggcctgcaagatattcctttcctagttgctagtctctcttaatagttttcttgtatctactactgcatttttgcattttttttctatatgaaaggaaataccattgtttgagaacattcaaccttacgagaaattaggaatttttattttgtttttttttttcttcttcagatttgtatgactatcacttggtaatacagatttattccatttaattgttatgtgatttcagttgtttgattagactttgcttaggagaaaaagaataacatttgaaaatgaaatagaccatagtcatataacagtacaggacaaggtaaaaaccatccaaccagcctacctcctttttttttttctttttactttaatgtttttacatttatttggggagtgtgtgtgtgtgtgtgtgtgtgtgtgtgtgtgtgtgtgtgtgtttgtctgtgtctctgtgtgcacatttttgtagccggtgtgcttggggagtaggtgtattttcaatcagatgtgattcagggattgaactcgggtcctcaggcctggcagcatgtgcctttacttgctgagctatctagttggcccaccattcatttctgtaatatatttttattagcatttgttcatttacttgttatgtgtggccacttttgcactatgtcatagttaggcaggcacaacagagaccaataccctcaaggctgaaaatattgatttgactttttttttcttcagaaaatttactgagtgtttttcctagtctgtctttacaaaatgcaaataaatatgtgacttgggtctttgaagctattaaaaaagtagatgatactgattaagactatttcttgtctgattttgagttaaagtaaaaatagtataaatagtgccttttaacacatgttttaggaacatggaagaacttagcaggaaaaacagtaagtttgtattgatacttttaaggaggtggctatttagttttatctttattcgaagacagctaaaatttcctttaaagtgataattactttataacagtaataatccaacgaaaattatccatgatgtagctgtttaaacaccaggtgttttattgatctatgaatgcagcaatggattttgctctttttttttttctatttattgttttggtgtaattacactgatttttttttaattcagaagtttcaacttacaagcttccattatgtcaaataatgtacaatatataaagttttccaaagtaatttagaggcttccaagtacaaggattatgctttcagcttttaaatttaaagccacatgctgttggagaataaaaatgccataatatagctatccttttaacttctagttgaaagccagatacacttttgtttgaagttatatggctttgttacaaatagatgcattaaaattgctctctactttcttgtgattgctgcttatactttgaaatctgtggatctgttttatgtatttcttttctgatggctgttcaggttctagttgaaagctagtgaaacatccagagctttttggaggtaaggatgtggaacagggtgttcaagaatcaatagaaaaagaatgactttagggtttctctcataaacctttctcatatttaagcacttgagaagctttgaaggataatttcaggggcaagcatcaaagtattatgggttatggacttagagtagaatgcattgcagatgcagtttagcaattgattaaaatctatttgcatttcctgtgcatacattaaattgagcaggagaggtattctgggattttcattcaaattactatgctgtagtgtgtcaatccctattatatcctttatgtaatagttcctgatctatatgtattttataaattcatctgtatttttattgactgaaacatgcatcatttttctgttataccatggctacatctttataagaaatggtaaactgtcatcagtgaggttttttttttttctcactcaatcaaacatgctaagtggtcaatataactttacatgttcttgattaaagaaaggagctaagcaatcatttagagtttgtctgactctctgaaattccctacttcagaaaccattttggtgatggtgatttcagacacatgaaatgaaataaaccactatcaaacctttctgatgggagttgactgggaaattgttttagcagtgagggaaaagaattttaaaaactattttcttgaaacatataataatgagatgattttcagagacttaaaggcacaaaatagttaatatcatttatgaacagattaaactaaattagtcatgggactggatcttgtcagtagttcatgtagtaagaaagctattgactaagaaaaggcaaaaggggagtttcttggtgatgaaaatatctaaaatctacatctgaatggtggttatatgcaatttatccttgtccttattttctatacttaaaatttgttaactttatagctaaatgcaatttttaatcttaatattgaaaaaaactaggtcatagaggtggaccctcaatttaacatttgaagaccccatgtaagaactgtagcaacactctgccctaaaaactgtgctgaggttagcaaagaaaccatttcttaacaaggacattaatattaatttttttcataaaacatttcaaaccccagaggatgcttagcatgaagacaaatcacacccagaagtgcttcagggtgaaaggtgctgagcagaggtcagatgattctttggagtcattttgcttaaaaaacatccttttcttttctttttttttttttttttcttttcttttcagattggcagattgctactctggctttactcctgggcggtgctgccatcattctcattgcattcctggtgggtttgatttcaatctgtgtgggatcacgaaggcgcttctacagacctgttgctgtcatgctttttgcagcaggtaaatatattcattacgttcaaaccagcattaaagattcatgaacctttctaccattatcccaccttacgcatcagtgtgtgtttgctccttacataaaaattgaaaggcatttgttatattttaaggtaatttggctgaaggtttatctgagtaccagtttttagcatgttaagcatttcacagaacactgtcaatttctaaacttcttactaaagcatgaataaataaaatttcttgggctgcaaatacagcttagtagtagagtgcatacatagcatgacttgaagctctaggacagggcatggagtctagattcaattcccagtaatgcaaaaataaagacaccaaattaaaaaaacaaaaaaaaaaaaacaaaacaaaaatatctttcacagggctgctgggctattgctttagaaattgtagcagatgtatttatcaaatcctttttttttttttaattttttaagcatcagttcttccctatctcaacgcctagcctcctgtgtgatcttagggcaatagctagcagtcctttttttttttatttttaattctgacatgaaacaagaaaaaaaaattttttaaatatatactcctaaaagcatacacattttgaaaaataagcacccttgtatgaaaaaaaaaaacatgacagctaatgtgaacgatcaaagaagttaattgtatgagggcagctggatgtctgctactttaacagccattattctgtgaagcatattttaaatcgaaatatcaaacaatgtaaacaaaagaccaacagctgtgttcagatgggggaggagcttgtggactgttacaagcccagttcattatctgatgtgagttgtaattttcatttagaagaacatccttgaatatattattcattttgactcttaactaaaatatccttgtggtatcttcaaaatttcctgtcagtcatatctgatttgaagtctgaaaaataagcccctgtgactgtcaataatgaagacactgacagaaccatctagtctgttagatggagttttaaaagctgtttaaagttggaagagatcaaatttctcaggatttaaaggataggatgagttaaacacaaaacccaaagtgttctactgccccctgctgcttgtgttcctttgataacaaagaagactgatcacagtgcagacatcatgaaagggaaaatacaaagggctgaacaacaatttagaaatatgtctaattcccttacttaaatgacctgctcaaaatcaagtagtgactggcagagttgggactacaatagaggacagtgaatcttaaagaagtagttcgttcattactgacttcctcatgcatccattcaactatttctgggatgtctattatggactaaacattttattaggacagctctaaaactggtcgaagtataaccacaaaacttcttttagcagacaacaaaagtgtgactacataatatattttgaaatgtttgtaatactatagtattattgttgccaggtgtaataagagtctcagttgggaatgatacagtaacaaataaaaagcacccttaagatgtgtcaccatttgctggcttatttcttggttcattgatttaccattgggtcttttcctgttttagagtggaacaatattggtattttaattaggtgtaagttcgtctttgaagataggacttaaaaatagaacaatgagataataagttgaactctttttaataaactgttccccataaaacactatgttatatggctttaaaaagtagaattgttatcagccatttttagaatagtaaaaatttcttattgtaggagggcatagagatactctagttatttttttttaatattcaatgttactgtgaaaacttaattactattccatttagcagtttagttactgcctaatgaaaactgtaaatatgtccattgctggtaccatctagaaatttgtagaaaactaactgggagtttgtttccccttttatccttaaaatatacattttgccaagtatagaaacatttgtgaaagtgagtcctggttatacaaaatatgatggaatttagcaacataaagttaagaggtttggccaaaataaagtttttttatttagctttagctattacatattagtaaatgctaaaataatgagaagaaaccctgtagcaagatgcatatagtgtcactccatgcactaaggcctaaaatgggcattatacagactgctacactttaaaaatgtgcatgtcctcagatttaatatttatctcttcctttcgcaataattatagaaaatctgttttgaaataaccattaccttaatgttaccttttcatataaggaaaaacatacttgttattttatattgcacaaaaagccaataaatcactacatttgattgtttgggtttttttttttttttttttggaaagcatgttcattgcacatagtaatcaactattaatctggatttaagatataaaaacttggaaaatctacataactgaaactaaatgtactgaagtagttggcttacctcagttgtaatttcagtcattctttaaatgcatatctgagagcatttcagttttatttatattggcatttgtgaatattgtaattagatctcttaacaaaatgttttcttcatcaaatattaacaagccttgtaccaccaagcagtatttgtctctcttcatgtagagaatgtgatctatcaaaggaaatgtctctttgcttctgcagagatgaacagtacctgtattcaaaataggtataccagtcatctgtgctggctgatactcatggatactcaagtatagtccttgaatgactggtaaacaacaactacatttagtggatagtgttgtaagggaaatcaagcatggaaactactgtatgtgattcatgtgatatcacgtctttttttttttttttttttttttctcattgaggctcagaaagaaacaggtttcacctgaccctaaaagtttttgtttgtttgtcttgaaatgttctaaaaacagccaaacagatcttgtcgattttttttaatcatctttcttcctgaaactcttgacttcatggtgggcttgaaattaacttgagcagctgctaacagagctaaaggtagccatcatcacagttcatttaaaccattgcttcagtttccaaaactttcttatcctttctaaaagtctagatttagatccaggcattatctctaataatactgttaatagtaataattaactgaacacctgtcttgtgccacacttaagcatattctatttatgatacaacggcctttattgtccaagaactagatttagaagggttaattaagcccctcccatccccagttatccaagtactattttggagggccagggattctttttccattaatttatttattcactttaaattcctatcccagcgccccactcccacccaactttcctcacatagcttcttaccttttttcacttctcctctgagaagggtaaagtacctcccaccccctccagggtatcaccaccattctggcacatcaagtctctgcagggttaggcacatcctctcccactgaggccagacaaggcagcccagttgaggaacagattccacagacaggcaacaaattttgggatagccccacccccttatgcactccagttgaaggtcatatgttaggggcaaggtccagcctgtgtatagagagccagggttttctattcagggtatctatattacatgaaagacgaagattactgaatcatcttataggttacctgtcacattaaaaaaaaaaatccaagaagaaaaagaaagaaagaaagaaaggataagaagagaaaagaagagaagagaagagacagaaaagaatcagctttgcatttagttttcaaactaaattttccctcttctgactatcctagaaacccctttttactttctaaattctttactgtagtctttcttttatctctccgatagagtctatcctgaagatgcagttgttctatctcacaggggcaatactcctttaggaagtcagaagcttgaaatgtcacaaagagcacaaactgtcttgtactaagcgactgacctgaccaaattatagccgactttatcctttttggacagctgatagtgatagatgtgttgagattctgatacctgccattcaacttccctcactaatgacttagtgaaatcaaaaagattgtctccttggttcttcagtgtctgcttctttactctactgataattagaatgagtgttttcttttgtccttcatggattttgaatacagattaaagaaaatatttaatgctttgtaatttaaattttgaatgatattgcactaattcattatattactaaagatgcttccttttttgtcatatctggaagaagcctcctgtaagtgattatatggagtgatggctctttcccttatgatctagcagctaatttttatttctgagttttctctggtccatgattagaagcttgtgtttgctacctcttgtcatcatcttaaaagatattgtgaaaatgggcagtcattttaaatctctgtttgactaaaatttagtccagtttagattataaactaaaaggatgttctactcacaggtgtttagatactatgttactttccatgtgtcagtatgctactatacttcggttagagtgttttacactaatttattttatacttgtactactttctgagttataaatttaattaatcaatagcccaacattccctttgtaggagaaatgtttttattatccaaattacaatttcctttacatgctatatttaggaacctagctggaaggccttctgccttttagttatctccagtcttccccttgtttgtttacagcatgagaattgccttagttgaggccacagtttctctttttgtaaaaaaaaaaaaaataataattatttagcttatgtatgagtacactgtcttcagacacaccagaagaggacattggatgccattatgaatggttatgatccaccatgttgatgctgggaattgaactcaggatctctggaagaacagtcagtgctcttaaacactgagccatctctccagcccctacagttgtttctcaaacgacacatttcagtgcctaaatgtggtcttctgttttatttatttatttatttatttatttatttattttccctttttttctgttttattttaacttagtaatttctaacttagttatgtgattctttcctttccctttttctagaatcaagatgatattcttttcttaatagtttctttaccattccaacctttatttttcacctgtatctttttctcccttaccccactgtccaggatgatacatagacaagtaccgatctcttaggccctgtcttttcatctttttaattgttcttgtgtacaagtgtactgattccacttctaaagtaggaatgtattcttttctcttcctgatttggttcccacagaagtgatccttaagacaatggactctaggacaaacaatcctattgcagagttaaaataaggactacaataagaaacctagaaagtaaaaagagcttcaaagcactgccagaagagagaggattttcaaacccatttttctgagccagaagcagctggattttattccttagaacaagtttcgaaactggtagaaagcacacacttcaagatgtctctcattggaagcaatggaaagctagggtatttaaacatcagtttttatgaggaactggtagaggttttgcttaatggacttcagcattcatttcccagaacttgtcatcattttgcaggtgagcaaaataaattgagttactagaggcaaagaaatgcaagtggtagcaattggaaatctatttgctatgtgatagagtgccaaggataaaagtttctggatggggcattagcaagttctgtaaccacagaaacaaatacctcaaccaaaccacaggaagtacccaagaaatttttcttaaaatgttaaaaaaaaaaaacattctcttagaagaaatgttgaatgtttgtgttgacaaacttctggttcaaactaaaatcaaaatagtgggtttcatgtctctgatcttgggaggcagaggtatgaaaatcagaagttcaagatgagcctgtgctgaagccagaggactgatataacttcaggaccaattgggcatacacatcacatcaagttcactttatcttaaatccaagaaagcagataaaacaaaactgaaatgcacacaaagattactagctttaagtttgtctcatatgtctagccatgcaatttcataatcatagttttcatcacatctgcaagagagagagagagagagagagagagaaaggaaaagaaaagaaaagaaaagaaaagaaaagaaaagaaaagaaaagaaaagaaaagaaaaaagtaaattccagcatttaaaattctgaaatgctctgtaactttcccaatgctgtatcagatgaagggcacagaataccgcagacaatgcccactatttttatatttcattgattggtggtaagatacaaatacagcatgatgttattgtcctgtactgaaaatgttggtccttctgcccccttgcagatatttctgaaaagcaaagaggcatttttcttttactatatattttataaaacggagaaaaaaactgtttgccattccaggtttatattttccttcagtttttctgttgcatgcatttttttctgtgggtcctgaaagaataacacaattcagaaggctaattcattttagggtaatctttcatcttgttacaacacaagaaaagtctaagcaaccggttctactgagtttcccattgaagcctgaatggcattgtatttccacttgccctctaccaggaaattatgtcattacattttacaatggggtctcagaatttgctgaatgaaatacattgaaatgaagctttagtgcagcttaggtgagtaccttactcaagggactggctgcttgctttttgaataaattcaagttggttattacttctttgctcaaattcctctagcagctacctataatttacactggagtacaaaaccctaactctggtctccaggtgaaaaacctaaccaggaattgatgcctgatgggtttgttttgggttttgtttggtttatttggttaacttttttacctaccttattatctgaaccaggcccacagcattggcatcttccttattgaattcatttctccattatgaatttatccctgtctgttccctggacactcttcctgctgtgttgacctgaatctccattcagaattcatgaatatgctcctatcaacttcccaggaggaaaaaaaatcctttgtgaatctaaaaagtagctctcaggtctttttctggtcattcttggatcttagtagtacttgctattatattcagagtagactgactgatagacttgatgctttgtttttttgatgcagaatgcttctgtatggtagagtatggcttccagtattctcgtgcctcagcctcctcagttgctgaatgggatcataggcatggaccaaatggccaactttctagtttgtactcatttacgattgaactgtccataaatgagaatagtagctttgattcccttgtgattaataatgctttaaactgtatatctcagaaacatgctagtattcattgaatagatgaattcattagatatattttaaaaaatatgtaatccacacccccattttaattgtatcctgggtacttttgctatgatttagtaataagagtaataagacaagcctttaaaatgaggaaaaaaagcatgctaggtatctaatgttttttttttttcttttgtttttgtttcttgtaattgattcattagctttatgacatttaaaacatgatcattccctttctttcaccaaggtagaaagctaaccatttccttttaattagtgcacattataccacttagtggttagaaatagattaagtgaggttatataattgtgctgtaggcagaggcttaactgatataaaactttaaaccagaaaggaaggtgtggtttctatttttggtgtcaagagattctccttttttcctgtttatctactctcagaggtaatgtggaagaatggcaggcagttgtaagcccagtggaattgtgcaaccaaacaactacatttggaattctatccagatccagatagtcgttgctttgtggtcattcttacagaaagtattgattttgaagaaccatgcccttcatcataacttcaccaaaacttcctcagttttatgccaaaggtagatgattacaatgtagtcttgctaggagacttaatcatatagctaatgtggctcttaacaaaattcagaaatgtttaggcacaaaagtctcagaatgtgctgagaacaagtgaggatagatcttaaaatctgaaatccttttgttctatttaaatttaagaaacctttctctctctctctctctctctctctctctctgtatgtgtgtgtatgtttgtcaacatacatatatacatacactggatcaaagtttattgtatttgttcatattattgtctgtgaatttatgatcttttaataaaaactaaacagtaatcatgtttaacaaaaattttgtttcttaagtcagggctatttttaatttttttttaaagatacaaaaaacaaatactttagggtttagagatactgggtttcttttgtaactatagctttgccattgtaatgtgaatagcatatacctgaatgagcatggctgagtaattttcagccccttttatgtatatctttacctggattttaaatggaaaacaatcacctttcttgcgtgttaaggctaacatagtaggcaagtatggaaagtttagctcatacattctaattaaattatataatagttgatccaatagggaactacatattttaaataggtgacttcatcttctgtgtaacacagtatagtgactctcatataaaaatacccacaggatatatgacactctagttttagatagttaaaagaaaccttccccttccttcccttactgattaattggttgttttcttttattaaatatgactcattatagttctctttcattcctgagttagaactaagagccaactaagaattaagatctaaagtttgtctctgctatagtagtcttcttgtcctatctttttttctttttttggatctatattcctcattccttaattaattcttttttgagtacctgtgggaaatatatgtacatgcaaataagtataagatatactaaaaggatagaattagttgtggctttgtggcaaagatgacttttgagtctctttaagatgaatggtgtggactgtgtgagaagaaaaagtgaaagtagtttcttattagagtaataggaaaaaagacattaagattagtctttctagaatattggctgagtcagatgattgtgaacatctattaagtaataggttgctataggttgctcagctttatcactaaaatgttgaattcttcagttccttaaattcaaaaataaataatgagggcttaagtctgcatggaggccactcttattaactctatagatattatatgaaatactttagtgtaaatagtactgtcattagtgataattgtacatgtgtttgcagagcaagaatcactttgtatattcatgaattaattttttaataatttcatttttgctaatagcaactacaagtcattaacagagcaatgattacagtattgtgacagtacctaagtaaataaagctgttaatattttaaaagataatatttggaattagaagtgctttaattttttggcttatacttatttcattaaaaattaactcactgttttgctgttttatttgctataaataacatcataattttgtttgctttctttttttccagttgttttgcaggtctgcagcctggttctttatccaatcaagttcattgaaactgtgagcttgaaaatttaccacgagttcaattggggttatggcctggcctggggtgcaactatattttcatttgggggtgccattctttattgcctgaaccctaagaactatgaagactactactaaaatcaagtctgaaaaacaaacacacatatgcacacacacacacaaaacatacactacacacaccacattacacacaaacacacacacacacacacacacacacacaccacatgaaaaagagaaactaaccatccaacaaaagatttgtgttgacatcttttctaacactattttctaaaacacttgtggagcctcaagcagtttgctcagttgatttaatatccttgcctttgggtgtcaacatcataaccagcttttatatccattttagggacctgcacaaattaagaatgctgattagatataggcatatgctgcaaacttccaatatgcttatgccatttctcttgacatgtgaaggatctgtatgacagcaaccattttgagaagctagttggaatgagaattgccagagtctctttttgcctgcagggaaacagctgcataagcaacatgtaaaagttccattgctctgacatttctactgttggagcccttatcacctgtttatattgcgcagtggctatattggttattggttactttgctttggaatttgaaactgccatttgggcatctaatgagaatcatagatatagccatttaattctacctttaaggctgttctttttaatagcaaattatactttaccaattatcatctcttgggaaggaagtcaacgtttggagacatgtgtttttcattatgtagttataaaattgagggtgtctgctttcccctggggcaatcagaaagaaatgtgcatgagttgcttttgtacccttaaaatcctttaaaaattttgcagcaaacaattgtccatatgtaacaagcttattcttctacaccacaagccattaccatactggtaataagttgctcattaatagtccacatacatgtacctatcattcatataatcaatacttgctctagtgaagcaatttgaacactaaccttgtatgcatcaacagactcagtattcacagttacttaccatacaaaagttcatataccttaaagcttttgctctgtgttctctactgattcattggaaagtattaatagaattgcctaagaagtaaaattgaaatgttgttaatctgaaatttaatgattcttttataagtattgtagttcaaaagagagtaggaattagaatgatcactttgtgtaaaattcattaaaatacaaggctgctatttttgcaagtattttaaatgtcttcattttaaaataaaggaatagtgatagatttctataaatgtctaaaagtctcagtagatgagtagtattccgttgttacctggtcctctgaagttaaatgatgggctaactgatttgtgcacacaagtgtgatgaatttatgttagggaaattattcactgactattccaagggaagaaaacatcaacaataaggaataagtttgcaattgatctttactgcaaacttgtgttaattctgtttattatacaaatctggatagtttaagtataagcctatttttatataaaatatacaattctgataggaaagttataaatgattatttttgttaacaaagacattaaagcaagttttctctcatttgaccctcttgaagacagaaacattggggaagaaaacattaaaaatgtatctatttactaatatattatacaattcactaagaaaaagactgtgtcaatagcatttaataatttgctttacctcccagagcagatttctgctttcagcttatcttaagaatggttgccaagaacaactgtctttccctgacctgaaaaatgttttattcaaatgtcaaaataaattgtgaatttcctatggaatcaaagtaaatataaataccttattcattcttattttagtggtgatagacaaacattattaaatgcatcttagagatcaaactttatgaaaatgtatgattctatcaagaatcataaggaactgaatggaaaatttccagaaagggattagtattatagactattttgaagccgctttcttaaaatcaaaatctgggataggttctcttataaacttcattgcatattgggagaacagaataagaaatgtgatatttggatagggatttcagctacagaccacagcctcttgtgagaggacctctttattcttgaatgaataagaggcgatgaaaactttgcagcaggcatcagtgaggcttgttgaaggatacagtgtgcagttagaccaatatcaagaatatgatagagcttccattctctgtccacatggcaagccaaaaagtgataggctatgttacaggttgaagcacagatatttgtaatctactgaaaaatagattctttctgtaattttctcccttcccaattaacgagccctaagctacatttttaccatatttggaactttttcattactaagaaagcttagtacagtggggaaatcctttttttcttgtcctaagtaatgtgtctatctgaataaacacaagtgataatttcagctatagtagcatcatttcttctagctttaggttggattggtgttttcttaaacagagttgttagtcatgaacccatccatggttaccttagagagatgatatacacacagagaaaccctaacattattcagcagggctagctattcagatttcttgcacaagtatttagctttttgtaaggtcaacatgtaaattttaaagacaaatatagagagacttatgtgtttgaaatataaatgatatatatggataagcatgtacctgtatattattaaacatgcagtgaactgactggtaagtgattgtctaattgtatggctagcaatgtaatttattcagactgtatttttgtacagagcagcgcacactaacctatgcctctgtgtcctccttaatgcctaaaactgtgcctagaaatttcatctgtcttaaagaaaataaaatatattccatgctgttttatgataatagtttctttcctgctattctgtatttattatttttaaatatctgacatgtttactacttaaatatgagtttatgttatcctgttcttttcttttcttttctcttcttttcttttcttttcacttagaagtcatctggggaaatctgtttgtcactccagtgatgcttgagtgtgcagtcccattatctgttcttcatttaatgatttttgtagttgacctaacgttatctatgtggaaaaaaaattaaaaaaaaaagtggtttcactaacaa

SEQ ID NO: 531 - DNA, 27203 bp, mus musculus; identical to SEQ ID NO: 530

SEQ ID NO: 532 - DNA, 24079 bp, mus musculus
gcttgctgaagattctctctgcgtttgctgtcgctgcagcagcggacgacctccttagggccaggcgtcccagctaggcaagtccagttgaccactcggtgtgcttaactgagacccaaggtacgacttcttggcgcggttagcgccgctttcctgttcgggaggtcccgctccaggctcttcggaccctcctggcgtcctcgtttgcgtcgggaagggcggcagcggcgcccgggcatggcttcggctggcagcggcatggaagaggtgcgagtgtcggtgctgaccccgctcaagctggtcgggctggtgtgcatcttcttggcgctgtgtctggatctgggagctgttctgagcccggcctgggtcaccgcggaccaccagtactacctgtccctgtgggagtcctgccggaaacccgccaacctggatatctggcattgcgaatccactctcggcagcggtgagcgcccccaccccacctccggtgccgcgccccttgctcccgcgtggccatcctgggctcctccgctgccaccgcctctctgggagccacctcccccactttccttcgctcccctccctgcctccttgccctaccttctcggcccttggaccccaggaccctcttgcatgtgcccctctctcgaaggggtccgggtaggcaagactccagagacctcctacgccctctactcctcccttgctcatccctccagttttggagtaacacgtctgctattttgggcaattgttatcattgagggcgagaaccatgtggctgtgtaaaagacgcaatgccttccacacccccgttagaaaagaaatgggtaaaacgctccaaatctgtgtgggttctctgttccaaccctctaagagaaatttgcccaagttttcctgaaggcccacatttccccctattctatttcactttacctggtgtattggctaggaaccctgactaagacacctggcttttcccgagtgaattttcgtgtgtgtgtgtgtgtgtgtgtgtgtgtgtgtgtgtgtgtgtgtgtgtgtatttcccctttaaattttggggagggataccgagagtcaggagagactgatgaattttctttccttttttggcgacaccattgttgcttctgagtttcctttctttcactcccacagtaagaaactcccctttcttccactccgttttctctgagctagttactcacagttgcctggaaagttctgcttcattcagcaagcagtgaaaattgtgtgcggatgggaaacggggtagagtaggcggtagccattgtggctactagctcaaagggactttgtggctttattctcttcctgatcctctagtttttgtttttgttttgttttgtttttaaccccatttccagagtcccattcctaagaatttgccaacttccaatttcttgctgaaaactattgctacttgaattctgtttcttcagctgctgctgtgtgcacagattaaggaatgtaaaagggaggctctgctgggtgctttttttttttttttttctttttaatgctggcgcgcgctaacacacacacacacacacacacacacacacacacacacacacacacacgcacaagctcacgctcacactcacacactgacctgagaaactcattaaatcccttcttgatagtttcaagtcttttctgaaacaatttttttaagctttgctggaaacgtttcaagttctaataaagttgaaatagcacaaagaccacacacacacacacacacacacacacacacacacaaatccgacttttctttgtcttacgttttttgttataggagaaattagttcacttagttaaatttcttccagaaatttaattttgtgcttacaaaggctttttctttgctgttacctcagaatacctattgaaggctttctttgttgattgattcttagtgaaggggactggttggcagcaggaggtcaacactcaggctttttaattctttcaggattagttgtttacaactgaagataaaataaacccacaaaatgcctttctttggtaaccaggggctccaaataaactttggaaaaaatatcttttctttctcccttcaatagaaatggaaatttatgtaggaatgccagcttcagcagatctccttagcaacgtgaatcttttgcccccttcactctgtctcctgaaataatagccctctgattgcataaagacttttcagataggttggagaaaccagcttcagctcccatttgctttttaggctattatccttttctcttggcttggaatgtggggaatggacgaaaagcagcttcagtttgtttgctaatctttccttaattgcctccataccgattgattttagctacaaagaaatttgtaactggaccaaaaagaaaaataaaagaataaaaaaacaaaaaaaccccaaagatttcagctgggcaaatacggagacataagcttaatgcaaatatggtgtccataggactgtggaaagggaaaatcaaaggcaagcatgctttctgagccccccacccccgccccagcctacgccccttattctatctccatgtccttcaacttgggttcattggcttcaatttgcttgaaaaaaatagttttctgtccctctaaaagatgacaagatgtgttacaagtagtacaagttatgtggaagttcttgactttgtgtggtagcagaaaagttgtgaagggaagggccaaaacacagaaaattgctgtggccacttagaaaatgtgctcctagagatgttatatggacttgaagcttctatcaagcagtgttttaagacaaagagggacactaggatcagcccaggaatgctgtccttgtctgttccaatggtgggcagcttatttagtctgtttgctgtacagagtagcagagggataggagcaaaatgtctttctgaagatttttaaagatcgacttcattctctctggaaaatcaattactttgggaaaacccaccaaggacagttttacttcgccaggatcttcaggacttaattaaaaacctttgttttaattagacaaggttttctttcaagaaggaaaaattctggaatgtttttcttctgaaaacaacattccctacttaggcccagtttctactgaaacatccccctaagccatgatttcaaacttgcatttgaattttggtaccaaatatgcctagtttgctgttgataactgtttttgtggttttaagctagagcagagccatgcctcttgtgtcctgttttattgaaggttgcgtcagcacttctagtagaaagcagtaatcgggttgtcagtcagccagaaagcttttcactagagtctcaattcgcgatatgaaggatagcactggcattatctttgcttgtatgttttctaggaagacaactgggaaaagggagaattggctgtcactgatagtatggtgggggaagtttggaatatgcagtaatcacatggttgcctgctccagaatttttttctaatgatgattttccccaggacattggtacagcattttaatacgtcttcagtcctatttaaagtttttacaatgtttaaccactgcttcctgtttagtttgataacttttcccctaggatataatagttagggtttcatagccatagcaattacaagagaatacaggattaaggttccctaaactccacatcaagaagttgtgtaattcctagaatgattttatgtttctgctaaaaacaattaatatgtaactacttcccatgaagcagatggcttattactgtctgttttttgactcagcaaaatagaaaacataggtgactcaataaacaggtttaagagtgatttgggactatagcaagggtgtgtttaaccatttttctatcaacaaaacacttgatcaaatagtacccttttcacgaaatattaatagcatcatgggtgtacttccctaagaataagctgcatttgtagcatgagttattggtagttttgaaatgacagggcactctgtgctaaaacaggtgaatattattattttcagttggcagaagctctttcaagagtgcttatatgtagctcatgtttttaacttcaatataaaaattccctttaaaaggaatttatgactaaaactatctgaggtgtaatttaagataaatggaactgtctgaacacctgcaattcctagaaattctaagatacagtgattccaagttcagattcatgccatctttgcatattttgagattacaccttgatttggaaatggaatttcgtccgaaaacctcacaatatgatttggtccaagaaggtttaggtgctcccagagatgagttgacactgataaatgtgtttacaaatagcaagctgcctacttactacaagtataccctcttccagtttcttctacgagaacatcatcagggaaaatgcacgagtgggtggaaaaagtaccagcactagctagcaccttaactaataaaccaaagaaaacccaggatgaattaaatcaaaatattcatgatggttttttcctttaaggtcttcttggatttcaaattcactaaaggatattttaatttgtggtcaagtagaatccttcttttgctcagactcatggagagattatagtctccagggagtcccttagtggagtctattggcaacaaatgggttttgataggagtgtgaaaactggcgtttaaaacaaatggtggcattgcaaagcaacaaaaccacaacaagcaaacaaaaacttttctcaagcaaaagatctttcctgttgaaaagaaatgaatttcaagattttgttcattttgtttattaattatacagtttagagagacctaagtatagccaatatttctggtttctattaatgaaagtatttgtaggtatttcaaaataagtctccacaataatcttctgtatgaactatgctaaattatagcataatctaatggtaggacaaagtactattatgaagaacacatgggacttcagctcccttctggccagaacttggccactcactgatcaacttagcatatacaatgttcttaacttcttcagatggcatgtcatgaagtttaaatacatgaaatattatttttctttcatattatatctttagaaaagtaaactcaatgttatttttcaatgcaagtaatatttccttttacattggatagtgaaataattgtttttgtataagaattaaatattggtctgaattaaatattggttacatagcatttaataaaacccctggtagatcatggccagagaactatattatcttagtagctacattttattcaataatattaaaggccaaatacctcacttacttccagtgtcatattaatggctgtgtaatgtttcccagaatactatggactttcgtaagtttaccgactctcaatttgtgataagagatgagcatttgctcatttcactagttcaaaaaacctaactctaccaacatttagttgtataaaataggcatactgtggaatactgaaggtcaggaatgcacgtagagcataatgagcctaacttgtccataacccagatatctgcagtcatagctgagcatgccttttacagtaagggactgggatattaattctgtaggatcctgttctgaatccttttgctcaaggatttggcactttgatgggaaaggttgataggcttgtcttgcctccaagcacttgcaggcagtctttagcatggggatctcaggataattagactggttaccgaccaagtgagaattttaattgagctatcttctctgtgaaccagctgggaagtcttggagctagctctcctattacatcatattggttacacctagccacatggctagctcagatttaaatggagagttggattccacttctcaatgatattcaataatattaaaggccaaatacctcacttactcccagtgtcatattataatggctgtgtaatgtttcccagaatgtttaccaggctctcagtttgtgataagagatgaacatttgctcatttcactaattcaaaaacctgacacaatctccaaaatctttattgcctttgaagagcaaagaaaactacttatgtagctttttcacttgatttttctaatgcatatataaataacccatggctaggataaatactatccttagccaatacatggcttcaatgattggtcacttctaagaatttagaatttatttgggtaggatgagatgagcctaaaaacttaaatgcaaatatgggtggagagctagataggtacatatagatacagccatctttgctctttgagttcatacaaccaaagatcaggcccattagaaattggtttaaatatttcatgtcaagggcactgacaaatgaatctacaactcttcagattcttagatcatctcgcttgaaaattagagaagggcactttaacttttgctgttagatttacattggattggggaaaactagtaaatacttttgattttcttttcttttggaatctttgccacataaacaacaaagaaccccacatataaagtgcaaatgtatacaagaatgaaggacatttgtggtctagcaaagaaccaggaaaacatatgtggaccattttagtttgtcagcacgattactaactgttgtgaagtttaaactgataatttaaggagtcatttctgtattgtgtcacaaactttgcatatagacagtcttttgttaaactgtttgtctattagaaaaaatgtaggaaaaatagaagatgaaatctcctcaattctctattatttgtatcaaaatgggcactaaacctaaaattcaactttttttttacaagagaatttcttgatgccatattttaagacttctaaaccaatagtcacaaaaacattgctattgtctattgagaataatactgggagactatttctagcaccatctccattttcttactgtcttagaaagcaccactaagttgacctcattaattcattaaatagcaaggggtagatccctacctgaacttagccagtaagtcttctgtactatgtagggagactaagtggttggtgaaacaaatgatacaatttaagctaatgaaataagtttaaaacttgctggaaatgaagcattagaagttcttccctgggaagtgagaaacaaagagctttctgagagattagctcgccagttttattctcaagtatttactcctgcattgtataatgtctgtgtgtctatttgaagatcttccttcttttttaatgttattagctgtcttatatgttactttcgaagcttatagtggctagaagggtgtccattctgtgggttttcagcttccagctttttccaaataaacccaggtattttgtctttttcaattttctgtgcttgtttttcaagacagggattctctttgttgctatggctatattggaacttgctctgtagcctagtctggcttggaacagagagatctgcctgcttccctgagtgctgcaattgaaggcttgtcccaccacaagagtcctctcctctcctctcctctcctcccctcccctcccctcccctctcctccttctccttctccttctcctctcctctctctttccttctctcccccttccctcccctccccttccctcctccttctcttctcttctcttctcttctcttctcttctcttctcttctcttctcttctcttctcttctcttctcttttctcctctcttctcttcctccctccctccttccttcctttctttttcttttgtttctcttttaagaattgaatggaaaaagccttcagtttaccaaacctaataaatctttgaacaaatattccttagtagttactactgagaagtagcagtgcttgctagctaatagcatcatcaaatgccagtgaaagttttctcatatagcacatgaagatacagcagtcatttggcatgatgttggctttctttctttgtaagtgctaaaacatgctttaataccaaggctctttgctaagcactgtatataacagttttatttgagaggaaacaccatatgttacagcactcagattttaaattatatttccagagatttctaatatacaactatgtgaactagctaagaggtccttttgttaaagaaaatggatgtttattctttgaaaactagcaaataacagctttaagggtttgaataaaattgtcatgattgaacatgaggaattcacctgctactgagaacattttttctttaaatatattaccgtggtgtttttagttcctaatgatagaaaggaatttacaataatgagttatctttcaaagttgtcatcaacataatttaattgaaaaagttttgttataaatatatcctacaattaaattaaattggtcagatatatttgttagataagagtgggtgaaagtagtcaaatttatttaggtagattatggagaatttggggaaaacttatgaggagtgaataaaaaatgatttttattatttgatctactgagtgactttcactaaaattatggatttcattttaaataatataatttcctcctaggggattaaagatgaaaatacaggtgggtgctagtaaaattttattgtgattttacaagtttgtaaaaatttatatttcaatttctaatgagaattttagaaaatggtaaataatttattatagcaacatattatattaatacattaagttaaagcatacattatatttagagaaatactgttcattcaaacaatagaaccttaattttaaaataaaagtgcatttctttttattgtatctacttttgtgaaataggaataattttaagtttggagagatatataaatgaacttagcaaacaaaataaacatgtatcctcattaagattttcctttcttggaaatcattaatgaattttgactatgaatttccctgtgtgaagacagttctccagctggacagttgtaccataggctatagaattttcataaagtactactaacttctgaccagtctcacgtattacactgctaaaaataagtcagcacaattctgtagaacactaatgtatttatagacaatggaaagtctgatgcttgtgagtaaaaataccttgaaagaagactcaaatttagttcctgaactgcatgttaatattgaacttaatagtataatacaaggggcttcctgattttgttctgttactgtggaaggaaatacttcgtatgtatgcatttttgtttgtttacttttgcttttgtttctgttaggaaaagtacacagttgttttaggttgttgcttccctaagtttagttccaatgtctccagtgtattcctttatcatttttgcccatatactcttgagggaatgtgataagtaatatggcaacgttatttcattttgtatgttatctggccatgtgagccctcacccattttatacactaagaatgctaagaattgtatcaagattgattatcacctgttctctcagatcttaggaaaagaagtacagatttgcaatcagctgccctaatattaaagagaagactacagtgtttaaatcagtgccataggccattgatgttctatagaactgctttttatatgtactgttccactacagtatcacaccataatttacagaaaattgtaaagcgaatacagaaccattactctcagggttttatactttatctgacccagttctatgaggtatttaactggaaagaaaaacgaagatcaatatagagattaactgatagtaaaaacttaaaacacatgactttctttttataagaagtagacctgaaaattacaaatgttactatcttttaatttaccttacagacattgactgttaggtatcattttttttttttttaactaaaatactactgaggtaaaactgagtattttggtcacttgttagtgtattcctttataattgctcggattttgcatgcacttgtgctaaatccaatttttagatgttggttgagaaataaatattataaaccccaacctggtactttagtgacctaagtatacataaatcctttttacttttgtttttaattcttgatatcatagtattgttcctaatgagaaaagggaaatgttaactatttatccatgactttaagatcccctcttagccttgtcctttggattcgaggcttctattggtgcacaaagcaaaagctctgttcttagctccagaggttcaaacagagacttataaagcatactggacctccctgattatagtagcccttcataatcattgtttatgctggtgaattgagtattatctgactgggaatgtgaagtttaagtcctaggcaaacactcagcccgaatgaatccttgccagtggacattatgacaatacttaaaaacttggcactctccaccaggaatatagtcttgcttttccagttcaaagccatggcttctggccaggacagtgacaatcatggcccattcctagtatctcttggaaaattaaatagcttttctgtttgagctgtagctctggttgcagaccaaaaggaagggtaagagtatcacagtaacgatggtattgtttttccttgttgactttgagtctagagagatgttctgcattagccataaagccatcactaaaaattaatacaggcaatctagtagaaaacccagaagtgcctctgttcatttgcttttaatgtcgttcctggcctgcaagatattcctttcctagttgctagtctctcttaatagttttcttgtatctactactgcatttttgcattttttttctatatgaaaggaaataccattgtttgagaacattcaaccttacgagaaattaggaatttttattttgtttttttttttcttcttcagatttgtatgactatcacttggtaatacagatttattccatttaattgttatgtgatttcagttgtttgattagactttgcttaggagaaaaagaataacatttgaaaatgaaatagaccatagtcatataacagtacaggacaaggtaaaaaccatccaaccagcctacctcctttttttttttctttttactttaatgtttttacatttatttggggagtgtgtgtgtgtgtgtgtgtgtgtgtgtgtgtgtgtgtgtgtgtttgtctgtgtctctgtgtgcacatttttgtagccggtgtgcttggggagtaggtgtattttcaatcagatgtgattcagggattgaactcgggtcctcaggcctggcagcatgtgcctttacttgctgagctatctagttggcccaccattcatttctgtaatatatttttattagcatttgttcatttacttgttatgtgtggccacttttgcactatgtcatagttaggcaggcacaacagagaccaataccctcaaggctgaaaatattgatttgactttttttttcttcagaaaatttactgagtgtttttcctagtctgtctttacaaaatgcaaataaatatgtgacttgggtctttgaagctattaaaaaagtagatgatactgattaagactatttcttgtctgattttgagttaaagtaaaaatagtataaatagtgccttttaacacatgttttaggaacatggaagaacttagcaggaaaaacagtaagtttgtattgatacttttaaggaggtggctatttagttttatctttattcgaagacagctaaaatttcctttaaagtgataattactttataacagtaataatccaacgaaaattatccatgatgtagctgtttaaacaccaggtgttttattgatctatgaatgcagcaatggattttgctctttttttttttctatttattgttttggtgtaattacactgatttttttttaattcagaagtttcaacttacaagcttccattatgtcaaataatgtacaatatataaagttttccaaagtaatttagaggcttccaagtacaaggattatgctttcagcttttaaatttaaagccacatgctgttggagaataaaaatgccataatatagctatccttttaacttctagttgaaagccagatacacttttgtttgaagttatatggctttgttacaaatagatgcattaaaattgctctctactttcttgtgattgctgcttatactttgaaatctgtggatctgttttatgtatttcttttctgatggctgttcaggttctagttgaaagctagtgaaacatccagagctttttggaggtaaggatgtggaacagggtgttcaagaatcaatagaaaaagaatgactttagggtttctctcataaacctttctcatatttaagcacttgagaagctttgaaggataatttcaggggcaagcatcaaagtattatgggttatggacttagagtagaatgcattgcagatgcagtttagcaattgattaaaatctatttgcatttcctgtgcatacattaaattgagcaggagaggtattctgggattttcattcaaattactatgctgtagtgtgtcaatccctattatatcctttatgtaatagttcctgatctatatgtattttataaattcatctgtatttttattgactgaaacatgcatcatttttctgttataccatggctacatctttataagaaatggtaaactgtcatcagtgaggttttttttttttctcactcaatcaaacatgctaagtggtcaatataactttacatgttcttgattaaagaaaggagctaagcaatcatttagagtttgtctgactctctgaaattccctacttcagaaaccattttggtgatggtgatttcagacacatgaaatgaaataaaccactatcaaacctttctgatgggagttgactgggaaattgttttagcagtgagggaaaagaattttaaaaactattttcttgaaacatataataatgagatgattttcagagacttaaaggcacaaaatagttaatatcatttatgaacagattaaactaaattagtcatgggactggatcttgtcagtagttcatgtagtaagaaagctattgactaagaaaaggcaaaaggggagtttcttggtgatgaaaatatctaaaatctacatctgaatggtggttatatgcaatttatccttgtccttattttctatacttaaaatttgttaactttatagctaaatgcaatttttaatcttaatattgaaaaaaactaggtcatagaggtggaccctcaatttaacatttgaagaccccatgtaagaactgtagcaacactctgccctaaaaactgtgctgaggttagcaaagaaaccatttcttaacaaggacattaatattaatttttttcataaaacatttcaaaccccagaggatgcttagcatgaagacaaatcacacccagaagtgcttcagggtgaaaggtgctgagcagaggtcagatgattctttggagtcattttgcttaaaaaacatccttttcttttctttttttttttttttttcttttcttttcagattggcagattgctactctggctttactcctgggcggtgctgccatcattctcattgcattcctggtgggtttgatttcaatctgtgtgggatcacgaaggcgcttctacagacctgttgctgtcatgctttttgcagcaggtaaatatattcattacgttcaaaccagcattaaagattcatgaacctttctaccattatcccaccttacgcatcagtgtgtgtttgctccttacataaaaattgaaaggcatttgttatattttaaggtaatttggctgaaggtttatctgagtaccagtttttagcatgttaagcatttcacagaacactgtcaatttctaaacttcttactaaagcatgaataaataaaatttcttgggctgcaaatacagcttagtagtagagtgcatacatagcatgacttgaagctctaggacagggcatggagtctagattcaattcccagtaatgcaaaaataaagacaccaaattaaaaaaacaaaaaaaaaaaaacaaaacaaaaatatctttcacagggctgctgggctattgctttagaaattgtagcagatgtatttatcaaatcctttttttttttttaattttttaagcatcagttcttccctatctcaacgcctagcctcctgtgtgatcttagggcaatagctagcagtcctttttttttttatttttaattctgacatgaaacaagaaaaaaaaattttttaaatatatactcctaaaagcatacacattttgaaaaataagcacccttgtatgaaaaaaaaaaacatgacagctaatgtgaacgatcaaagaagttaattgtatgagggcagctggatgtctgctactttaacagccattattctgtgaagcatattttaaatcgaaatatcaaacaatgtaaacaaaagaccaacagctgtgttcagatgggggaggagcttgtggactgttacaagcccagttcattatctgatgtgagttgtaattttcatttagaagaacatccttgaatatattattcattttgactcttaactaaaatatccttgtggtatcttcaaaatttcctgtcagtcatatctgatttgaagtctgaaaaataagcccctgtgactgtcaataatgaagacactgacagaaccatctagtctgttagatggagttttaaaagctgtttaaagttggaagagatcaaatttctcaggatttaaaggataggatgagttaaacacaaaacccaaagtgttctactgccccctgctgcttgtgttcctttgataacaaagaagactgatcacagtgcagacatcatgaaagggaaaatacaaagggctgaacaacaatttagaaatatgtctaattcccttacttaaatgacctgctcaaaatcaagtagtgactggcagagttgggactacaatagaggacagtgaatcttaaagaagtagttcgttcattactgacttcctcatgcatccattcaactatttctgggatgtctattatggactaaacattttattaggacagctctaaaactggtcgaagtataaccacaaaacttcttttagcagacaacaaaagtgtgactacataatatattttgaaatgtttgtaatactatagtattattgttgccaggtgtaataagagtctcagttgggaatgatacagtaacaaataaaaagcacccttaagatgtgtcaccatttgctggcttatttcttggttcattgatttaccattgggtcttttcctgttttagagtggaacaatattggtattttaattaggtgtaagttcgtctttgaagataggacttaaaaatagaacaatgagataataagttgaactctttttaataaactgttccccataaaacactatgttatatggctttaaaaagtagaattgttatcagccatttttagaatagtaaaaatttcttattgtaggagggcatagagatactctagttatttttttttaatattcaatgttactgtgaaaacttaattactattccatttagcagtttagttactgcctaatgaaaactgtaaatatgtccattgctggtaccatctagaaatttgtagaaaactaactgggagtttgtttccccttttatccttaaaatatacattttgccaagtatagaaacatttgtgaaagtgagtcctggttatacaaaatatgatggaatttagcaacataaagttaagaggtttggccaaaataaagtttttttatttagctttagctattacatattagtaaatgctaaaataatgagaagaaaccctgtagcaagatgcatatagtgtcactccatgcactaaggcctaaaatgggcattatacagactgctacactttaaaaatgtgcatgtcctcagatttaatatttatctcttcctttcgcaataattatagaaaatctgttttgaaataaccattaccttaatgttaccttttcatataaggaaaaacatacttgttattttatattgcacaaaaagccaataaatcactacatttgattgtttgggtttttttttttttttttttggaaagcatgttcattgcacatagtaatcaactattaatctggatttaagatataaaaacttggaaaatctacataactgaaactaaatgtactgaagtagttggcttacctcagttgtaatttcagtcattctttaaatgcatatctgagagcatttcagttttatttatattggcatttgtgaatattgtaattagatctcttaacaaaatgttttcttcatcaaatattaacaagccttgtaccaccaagcagtatttgtctctcttcatgtagagaatgtgatctatcaaaggaaatgtctctttgcttctgcagagatgaacagtacctgtattcaaaataggtataccagtcatctgtgctggctgatactcatggatactcaagtatagtccttgaatgactggtaaacaacaactacatttagtggatagtgttgtaagggaaatcaagcatggaaactactgtatgtgattcatgtgatatcacgtctttttttttttttttttttttttctcattgaggctcagaaagaaacaggtttcacctgaccctaaaagtttttgtttgtttgtcttgaaatgttctaaaaacagccaaacagatcttgtcgattttttttaatcatctttcttcctgaaactcttgacttcatggtgggcttgaaattaacttgagcagctgctaacagagctaaaggtagccatcatcacagttcatttaaaccattgcttcagtttccaaaactttcttatcctttctaaaagtctagatttagatccaggcattatctctaataatactgttaatagtaataattaactgaacacctgtcttgtgccacacttaagcatattctatttatgatacaacggcctttattgtccaagaactagatttagaagggttaattaagcccctcccatccccagttatccaagtactattttggagggccagggattctttttccattaatttatttattcactttaaattcctatcccagcgccccactcccacccaactttcctcacatagcttcttaccttttttcacttctcctctgagaagggtaaagtacctcccaccccctccagggtatcaccaccattctggcacatcaagtctctgcagggttaggcacatcctctcccactgaggccagacaaggcagcccagttgaggaacagattccacagacaggcaacaaattttgggatagccccacccccttatgcactccagttgaaggtcatatgttaggggcaaggtccagcctgtgtatagagagccagggttttctattcagggtatctatattacatgaaagacgaagattactgaatcatcttataggttacctgtcacattaaaaaaaaaaatccaagaagaaaaagaaagaaagaaagaaaggataagaagagaaaagaagagaagagaagagacagaaaagaatcagctttgcatttagttttcaaactaaattttccctcttctgactatcctagaaacccctttttactttctaaattctttactgtagtctttcttttatctctccgatagagtctatcctgaagatgcagttgttctatctcacaggggcaatactcctttaggaagtcagaagcttgaaatgtcacaaagagcacaaactgtcttgtactaagcgactgacctgaccaaattatagccgactttatcctttttggacagctgatagtgatagatgtgttgagattctgatacctgccattcaacttccctcactaatgacttagtgaaatcaaaaagattgtctccttggttcttcagtgtctgcttctttactctactgataattagaatgagtgttttcttttgtccttcatggattttgaatacagattaaagaaaatatttaatgctttgtaatttaaattttgaatgatattgcactaattcattatattactaaagatgcttccttttttgtcatatctggaagaagcctcctgtaagtgattatatggagtgatggctctttcccttatgatctagcagctaatttttatttctgagttttctctggtccatgattagaagcttgtgtttgctacctcttgtcatcatcttaaaagatattgtgaaaatgggcagtcattttaaatctctgtttgactaaaatttagtccagtttagattataaactaaaaggatgttctactcacaggtgtttagatactatgttactttccatgtgtcagtatgctactatacttcggttagagtgttttacactaatttattttatacttgtactactttctgagttataaatttaattaatcaatagcccaacattccctttgtaggagaaatgtttttattatccaaattacaatttcctttacatgctatatttaggaacctagctggaaggccttctgccttttagttatctccagtcttccccttgtttgtttacagcatgagaattgccttagttgaggccacagtttctctttttgtaaaaaaaaaaaaaataataattatttagcttatgtatgagtacactgtcttcagacacaccagaagaggacattggatgccattatgaatggttatgatccaccatgttgatgctgggaattgaactcaggatctctggaagaacagtcagtgctcttaaacactgagccatctctccagcccctacagttgtttctcaaacgacacatttcagtgcctaaatgtggtcttctgttttatttatttatttatttatttatttatttattttccctttttttctgttttattttaacttagtaatttctaacttagttatgtgattctttcctttccctttttctagaatcaagatgatattcttttcttaatagtttctttaccattccaacctttatttttcacctgtatctttttctcccttaccccactgtccaggatgatacatagacaagtaccgatctcttaggccctgtcttttcatctttttaattgttcttgtgtacaagtgtactgattccacttctaaagtaggaatgtattcttttctcttcctgatttggttcccacagaagtgatccttaagacaatggactctaggacaaacaatcctattgcagagttaaaataaggactacaataagaaacctagaaagtaaaaagagcttcaaagcactgccagaagagagaggattttcaaacccatttttctgagccagaagcagctggattttattccttagaacaagtttcgaaactggtagaaagcacacacttcaagatgtctctcattggaagcaatggaaagctagggtatttaaacatcagtttttatgaggaactggtagaggttttgcttaatggacttcagcattcatttcccagaacttgtcatcattttgcaggtgagcaaaataaattgagttactagaggcaaagaaatgcaagtggtagcaattggaaatctatttgctatgtgatagagtgccaaggataaaagtttctggatggggcattagcaagttctgtaaccacagaaacaaatacctcaaccaaaccacaggaagtacccaagaaatttttcttaaaatgttaaaaaaaaaaaacattctcttagaagaaatgttgaatgtttgtgttgacaaacttctggttcaaactaaaatcaaaatagtgggtttcatgtctctgatcttgggaggcagaggtatgaaaatcagaagttcaagatgagcctgtgctgaagccagaggactgatataacttcaggaccaattgggcatacacatcacatcaagttcactttatcttaaatccaagaaagcagataaaacaaaactgaaatgcacacaaagattactagctttaagtttgtctcatatgtctagccatgcaatttcataatcatagttttcatcacatctgcaagagagagagagagagagagagagagaaaggaaaagaaaagaaaagaaaagaaaagaaaagaaaagaaaagaaaagaaaagaaaagaaaaaagtaaattccagcatttaaaattctgaaatgctctgtaactttcccaatgctgtatcagatgaagggcacagaataccgcagacaatgcccactatttttatatttcattgattggtggtaagatacaaatacagcatgatgttattgtcctgtactgaaaatgttggtccttctgcccccttgcagatatttctgaaaagcaaagaggcatttttcttttactatatattttataaaacggagaaaaaaactgtttgccattccaggtttatattttccttcagtttttctgttgcatgcatttttttctgtgggtcctgaaagaataacacaattcagaaggctaattcattttagggtaatctttcatcttgttacaacacaagaaaagtctaagcaaccggttctactgagtttcccattgaagcctgaatggcattgtatttccacttgccctctaccaggaaattatgtcattacattttacaatggggtctcagaatttgctgaatgaaatacattgaaatgaagctttagtgcagcttaggtgagtaccttactcaagggactggctgcttgctttttgaataaattcaagttggttattacttctttgctcaaattcctctagcagctacctataatttacactggagtacaaaaccctaactctggtctccaggtgaaaaacctaaccaggaattgatgcctgatgggtttgttttgggttttgtttggtttatttggttaacttttttacctaccttattatctgaaccaggcccacagcattggcatcttccttattgaattcatttctccattatgaatttatccctgtctgttccctggacactcttcctgctgtgttgacctgaatctccattcagaattcatgaatatgctcctatcaacttcccaggaggaaaaaaaatcctttgtgaatctaaaaagtagctctcaggtctttttctggtcattcttggatcttagtagtacttgctattatattcagagtagactgactgatagacttgatgctttgtttttttgatgcagaatgcttctgtatggtagagtatggcttccagtattctcgtgcctcagcctcctcagttgctgaatgggatcataggcatggaccaaatggccaactttctagtttgtactcatttacgattgaactgtccataaatgagaatagtagctttgattcccttgtgattaataatgctttaaactgtatatctcagaaacatgctagtattcattgaatagatgaattcattagatatattttaaaaaatatgtaatccacacccccattttaattgtatcctgggtacttttgctatgatttagtaataagagtaataagacaagcctttaaaatgaggaaaaaaagcatgctaggtatctaatgttttttttttttcttttgtttttgtttcttgtaattgattcattagctttatgacatttaaaacatgatcattccctttctttcaccaaggtagaaagctaaccatttccttttaattagtgcacattataccacttagtggttagaaatagattaagtgaggttatataattgtgctgtaggcagaggcttaactgatataaaactttaaaccagaaaggaaggtgtggtttctatttttggtgtcaagagattctccttttttcctgtttatctactctcagaggtaatgtggaagaatggcaggcagttgtaagcccagtggaattgtgcaaccaaacaactacatttggaattctatccagatccagatagtcgttgctttgtggtcattcttacagaaagtattgattttgaagaaccatgcccttcatcataacttcaccaaaacttcctcagttttatgccaaaggtagatgattacaatgtagtcttgctaggagacttaatcatatagctaatgtggctcttaacaaaattcagaaatgtttaggcacaaaagtctcagaatgtgctgagaacaagtgaggatagatcttaaaatctgaaatccttttgttctatttaaatttaagaaacctttctctctctctctctctctctctctctctctgtatgtgtgtgtatgtttgtcaacatacatatatacatacactggatcaaagtttattgtatttgttcatattattgtctgtgaatttatgatcttttaataaaaactaaacagtaatcatgtttaacaaaaattttgtttcttaagtcagggctatttttaatttttttttaaagatacaaaaaacaaatactttagggtttagagatactgggtttcttttgtaactatagctttgccattgtaatgtgaatagcatatacctgaatgagcatggctgagtaattttcagccccttttatgtatatctttacctggattttaaatggaaaacaatcacctttcttgcgtgttaaggctaacatagtaggcaagtatggaaagtttagctcatacattctaattaaattatataatagttgatccaatagggaactacatattttaaataggtgacttcatcttctgtgtaacacagtatagtgactctcatataaaaatacccacaggatatatgacactctagttttagatagttaaaagaaaccttccccttccttcccttactgattaattggttgttttcttttattaaatatgactcattatagttctctttcattcctgagttagaactaagagccaactaagaattaagatctaaagtttgtctctgctatagtagtcttcttgtcctatctttttttctttttttggatctatattcctcattccttaattaattcttttttgagtacctgtgggaaatatatgtacatgcaaataagtataagatatactaaaaggatagaattagttgtggctttgtggcaaagatgacttttgagtctctttaagatgaatggtgtggactgtgtgagaagaaaaagtgaaagtagtttcttattagagtaataggaaaaaagacattaagattagtctttctagaatattggctgagtcagatgattgtgaacatctattaagtaataggttgctataggttgctcagctttatcactaaaatgttgaattcttcagttccttaaattcaaaaataaataatgagggcttaagtctgcatggaggccactcttattaactctatagatattatatgaaatactttagtgtaaatagtactgtcattagtgataattgtacatgtgtttgcagagcaagaatcactttgtatattcatgaattaattttttaataatttcatttttgctaatagcaactacaagtcattaacagagcaatgattacagtattgtgacagtacctaagtaaataaagctgttaatattttaaaagataatatttggaattagaagtgctttaattttttggcttatacttatttcattaaaaattaactcactgttttgctgttttatttgctataaataacatcataattttgtttgctttctttttttccagttgttttgcaggtctgcagcctggttctttatccaatcaagttcattgaaactgtgagcttgaaaatttaccacgagttcaattggggttatggcctggcctggggtgcaactatattttcatttgggggtgccattctttattgcctgaaccctaagaactatgaagactactactaaaatcaagtctgaaaaacaaacacacatatgcacacacacacacaaaacatacactacacacaccacattacacacaaacacacacacacacacacacacacacacaccacatgaaaaagagaaactaaccatccaacaaaagattt

SEQ ID NO: 533 - DNA, 47812 bp, mus musculus
gaagccctgaagccggcagctctttggcccaacctctcccagagaccggatccaggaaatacgaggcgggcttcagtgggagggacgccgcgagggaggaggaggaggcaagggggcggcggcagcggcggcggcggctcacaccggatctgccctcggcacggcgcgcagtcaagggggttcggccggggaagccgtgcccgcccggaccccccgtgggagcctgcggacggaccgagggccgggcggaggagcccggagcggccgcgggggctcggtgagtggtggcggggaggcccggcacctgcccgaggctaggacttcggaggtgccctggggtcgtcctagtgaccccgcgaccacgacgttgggcgtgggcgagactgcgggtgtcggcggggctcgtcccggcctctggctctcagccggcccgggtaagtacctggctgcgggaggtttgcgcagggcctgtcgtggcggctgcgcccgccaggacgccccgaacgccccgaggccgaggggagagggagtggctgcgggttgggggtggaggggcttgatcgctatcagccctcgcgggagaggcgaggatgcctttcctcctgggctcctggacatcctgcagaacgcacctctatggacaggtttgaagtccgggttaaggcgttcgagggattaggactcgcagaactaaggctgattcttttaaaggtgttgggacctgtgcgcaaggttagtagtggtagaaatgattgtcgtggaagtggtttgcaaataattgttggcaggtgttgaggaaagctaagatactgtcgtcttttaaagatgacactgaacagccgccctctgaggtccaacaacagattagagttggtcctagttggaggtttatagtttactaccgcgtatctgcttataaagtggattaagtaggataggaggagggaagatgtaggcaaggtgaaggagaaagtaagctgcacagtaaagaaccaaaagttcagattcaagacacgttgaagtataaaaaactgcctgttctgaagcataacatttagaatttggttgttgctggggaaattgcctgttagtggtgcaaggcagggctctttggttgtgggcttcagtaacctttgtcaatttttatcatttataatgtatttaggagtttgtaaacggaaaggaaggagcagtgtaaaagaacaacttgatgaacccggcttgctctgtactttgttagtgggtgggggtcgggggcttactttttgctttatgagtgatttataggactataaaagaacacacttagaaaggacgcatggttgagaagtttttggatttttttaaatggagatttaactataatattcaattacaaagtacactatcttctatggtaacttttctcaatgaacactggaagtcagcaagcacgtcttcaattctacatatacgtaatttgtaatcagtgggttatgtaatttttacaaacgtacagtccccctcccctttctcctagaacttgtttaatcaagacaaagttggctttagggaaggtagataataaatatatgattcctgacgttacatctgacaaggcataatgaatgtccagtcgccctgacttttcttctgttatgtgacatattctttaattgcaggcaaccctgtgcagtttgtgttggagcaaagtgagctgagtatctgcagtcactggacttggtaggcagtatgcattttaattgaatcctaagtgtttctcgatgttagagacaatgtctattgcacagataacagcataaaacttcagtattcttctgtagcttgcttacatagctgaggttatatagtgcgtaaactgcaaagctagaactcagattcttgtatatctaagtttagagcatgtgttctttctagatacgctgtatgtgtttatgtgctggcatcaatttattgaaagtggaaattttttattgtaaagaaaccattcaattctgttgaaggttttcgtgtgtcttaaaagataatctcaagtattttttttttattttggatgtgtccattttttagacggaggtatggtttgagctaatgtgtaaagattctaaatagttagcagtgacctatacctgaaattcatggttttggtaacttcaccttagtgtacccaagatacttcaaagaataaatgttttgtttactctgatcttgaattatatttataattgtactactaaagtaaatagcaagtgttcacaggggccttgggttgtgatagtgtccacaggtccttcttagacctcagaacagtacttgttaggcaattttgctgttcttctttacatttagtcccaaagttttagagttagattgcattttgcaaaatatacggccaatattagggcaagcagcagcatctcttatgggcctaggggtggacagattttagatcttccagagcagcgagtttccgagcctttagtgaagtcacagggacactttgcagaggtgttaggttgggaaaggcatggcttttggctcccactgctctctgctgttgggtctcttgacgtgctgttgagctcgtcctcgtcctagctcttatctctgttgaagagacaggccccacatctgggtagagttcagctggaagaaaagctagagcagtagggggtggggtggggaggaagatgacacctaagtggtgttcatcctccagcaggtcattcggccagagttaattatgtggttaattatctttggctggaaattctagaaatgttttgcagtttgggatctttttttttttttttttctaaagatgtaaattgttttagaagtcttcctggaatggccctgtctcacagacatggagaaaagatttctgagtttctcagtctgggtatgtgttctatggagtatggggctggtttaaataacaccttgtaatcttgacggacaatctttgggttgaaggagcaagtttttaattatagttgtactcccaagaaagagttaaatatactttacttgggaaggtaattactcctggtatttggcctattagagtggaaaatattgacaaatgagaaaacctacctagaagtaaacagaaagcctttctgacatattttatatcatcactatataaaaaagcacaccgggaaagtgtatgtatgtagaagcttattttcattcctttggcataaccctatattaatattataatcatgaatatttgtctaaaactgaaatagatgtaatgaaatacttggaactatccaactgaatcctaaatattgaacaacatttttataatttagttaattgaaagctctatttgcttactatcctatccaacagtccacaatctcacttttcttcttgcttaaagtctctcagcttgtattccttcctttcttgatgctatcctgtcatcacctggatctttcctttaattctcagttaaccctggggtcttttgcaagttgtatgaaaagtgaagaggcctacaaagcctttaagcccatcccctggtctgaattcttttgccctagcaagtcaagaggaatgcagttaagaccctataacccaccagattgtgtctttaaaaggagaatgagaataacagattgagggaggcagtgtccagactcttgctatggtttcctgtctcccttctcctgaagagtcaagaagctaagtttgtagaagccagtgtgctgcagaagtgggcgttgttccctccttctcttcaccacccaccttactctcagacggtccactccttcctttaagcagtcatcctcaatttctgtccttctcctaactaggtttagccttcatcctctttgatctctcccctacccccagctctgacttttgtcctttttcatgccctttctcctgctctgctttgatcagaatttaagtaagctcagactgttttcttagtgagggaagatttccttctacttgcagaacttaatagggcagtgatagttggtgtgctactgagttgcaatgctaaatgtgttttcccatagaaccattgctcacagaacttggtgttttgtatacttctgttaccttctggatgtttaggctttcatggattggtttagaaatgcagcacatttattattgtttcctgggaagcctatgccaatatatgattttaaaaatactgcaagtggaaatttctggtttctttggagactcagttgtgtcatatgatgttttcatggaaattctacctttcctttccactacctctggtgggtggtaggctagaagggaggctaaaacatttaagtaccattattaaaaataggttttgaaaaatataagcctatacagctgtacatatgaattcaaagtgctctcagctgtatgcataagacttgtacaagttcaagacagaacaaagcccagtgtaaagatgggagttgggcacaaaaagtattggcagttgttttagctttttagagaggcagagttcgttttctctaacaattaatggaccctgataagttaaccacactccagtggaaggcagaatttaatagggcagtgatatccaggagtatttgggaagcacaaatgggttttgataggattttcttttaaaggacatgaagttgggaagggtagggaatctgggaagagatggtagagggaaagtgaatatgatcaaaacatattattttaaaaatctcagaacactagttaaatattaaaagtgccttgtgttccagaaattgttggaggttgcttgctttttgtgagaatagtagatagcccgtctgtgactatccaacgtcagtgtagttatgctgatgggatggctcttctaggaaataagctgataaaaggtttttttaaagtgtctagtctttgaaaatgtttattttatacatatgggtgttttgccagcatgtatatctgtgcaccacctgcccaagttgaccagaagacattagatctcctgggaccgaagttacagaaagttatcagatgccatgtggaactgggaattggactttggtcccctgaaagagtagcctatgctcttaaccactgatttggtcttttaggatgtcagtgaaagttttctgaattagggtacacattttgaaataaaaagcatctttgttccatctcaagttaatgtttgtcattaaagcatatcttatggtggtgttaaaacaaccaagttccagtttgtcatggaaatgctatcttgcttgcactatttcttgttgatgttttgaaacttttcaaaggccctggccatcttggtgttatttactcatttttacttactgataaatgaggatggtgtttgttacctgaaagttttaatataaaggtttattaggctgctgtgatatatgctgtaaatggttgtggtaatgagatgattcagtgagagatttcaaagtgagaaaagcaaagccaaacttactgtgcacttgtttgccataagtgtattgaaccttagcttgctggaaggaaataatccagtaaaagtcaagatgaggctgcaagggttgctccaggccgttcttgtgtgaaaactgaatttcaccttacaccctctgttcattttaagtttaccaaattctctaaattatatacagaatgtgatggctgaaaaacatctctgtgggcaaaattctcaaacaactagatcttttgacacacactagctctgtgttttggggcaaattgcttaatctctgacctgtttcctcagttttgaaatgaggataatgtggtatttacctcacgaggattaaatgggccagaggatatattatatttaaagcatggctagcaatagtcaatgcacaaaagaattgtttttgttactaacattgtcattgttgttaatacttgatcttcctttctattgtgataggagtagctataaaagatgcctttacttacttgatagtaacccttgaagctaaagcttatgaagggggcccaggctagatgtataactgctagatctactcacaactagtcatagttcaggaaacccatagaatattaagatttttttcctatagccccaactctattatgtctagtataaagactgcctatatgagcaaaataggattgagtaactgtagtttctttattaaaaattaatgatattggcatctgtaaagctagagtctgtagaaagggagcctcaatttctataaggtctataaatacattttttaaaaaacttgaagtgcactccactttcccacaggaaaaaaaaaaacttacatggtgttctgcttctcaggccagttcagcatatctgaaattgaatattgatagtactgttaaaaactaactttctctatgacaatgtatcagcaaaaacatgcatgcagaacatcaggtactaaaagattatgaatgtaactttgtagaaaacacagtgggctcctccctctgtgcatgaagagccttgaggaagagctttcttttctggtggaggatgagaatagggtaatgatgagagccatttttttttctggcttgtatttcaaaagactatactgcctaataaagtgactatgactaccaactgtgtatccagagtgcctgccttcacatctctgttccactattgaaatggtactctccttacaaggtttgtggaaggattacgtgtattggtaatggatgaaatacataaaaccgtatcttgctggtttgtaagaaatgttgtatattcatctttgttaagctttactattttagaacgtctagaataccctgctctacttagttgtctactgcctttctctggtgtaccttcaataggattcttctttcccacgtaagagtagttttcttgtcttctttccacagaggagtgggtttagatttctcatttttatttccattcagattgaggtgagtttttatttgtttgggccttttgggtttgatggtataatgttagaaaagtagctagcatttaaagactccttcctgggggcttgctgttagagctccaccttcctgccatctcactgccctgcccgtggctggtttataaagggccagatcacctcagatgtacctcagcacccatctacagcacagtagcactgcatatatccgtttccttccttatctagtagccagagatctcacagcaatatttttaactgttttaggatacacagttaaagggatggatctccctattgcaaacaaacaaaaaattctctttgagtcccaggccagcctagactacagggagcttctatttaacaaacaaacaaaaataacagtatggaccagagagatggctcagtagggaaagcctttgctgtgccagtgtgagggaggacctgacttccaatttcaaacccacataaagctgggtatcaaactagcaagataaactcagtgggtaaaagctcttgctatgcaagcccgaccatctgagtttgatactctggacccatgtaaaggtggaaggaaaaaccaaactatacaaagtgggttttgatacttccaagcatgctgtggcatgcacatacactccccatagtaaacaaaccaataaataaatgctttacaatcttttaaaagtctggtttatagtctcccctcccctccattaggtgattgaggaaacttgcttgtgctcagttgaggtatacatttctcaggttttagtagcttttacaaaaccatttatttatttatttatttattccttcattcatttattgctttggaacaactttagacttaaatttacagaaataaattacccacatactcttctcccaatcctgtcatacttgtaaaaactaagactgtattacccaagttgcaaagtttaatttttattatttcccccccactacaaccctttttctgttccaagatggcatgttgcatttagtcatgaaataggctacttttttttaacatgtatttgtgtgtgtgtgtgtgtgtgtgtgtgtgtatgacacataatggcatttgtgtggggatcagaggacatgtggaactccatactctccttcgatatatgagtctccaggtttgaatacagatcattaggtgtggtagaagtgctcttttttttttttgctttttgtttttttttttaacttcactggaccatttcactgggaccatttttaattttttgcatttatatcattggtatctccattttattagaaaaatattgccataaaagcattctgtgatttattcttcagtttcatgcaggttctgaaaggccaggtgtttcctctatggttggcaaaccagagatttatcttagcactgaactttatgctctgagataaaaggtaagagtcgtgtgagagtgaggagagccttgttggatttgtagttgcgactaagcacttttataatttaaaactatctccacaagattacatgggcaatttgtattgttggtatttgatcattttagcttcagagtgacacaacattcttttaaaattttaagtatgcttatttgttgacatagatataaattgggatgaactggaaatttaacttttaagggaattatgatttagtaagaaactagtataatcatttaaggtcagcaaggtaacacatttgattgattgtttatataagcttttagaaaaccctaggtttcaatcaatgattgatttagttttaaattaaacatttctttagggattccatatgtggagattccactattctgaattttcataaatgctttaaatttgccgtcaaaagtcatcatggtgtaaacagagttatctagtaggctgcacatcacagactttacaaagtcttatctttcctgccacagaaataactttcagctgtaagttatggatggcaaagaaaatagttttgggttggttgggtggaaatgtttcaaataaatatggtgcatattgagagacactcccagtaaaccctcttttatgtagaaatgaacttagaaaattgggaaggatggctataagtcagtaagtaattccaggtgttttatacttactcatatcttttcatgaccttggacaaatcatctaccttcataggagctttgtttctttatttgtaacattaagggatggttgtttctcttagtgctgagattataggaggaatgagaggtgtttccttgaaatatgagcatttaatcactttcttacttcggagacaggctcttacttactccgttcgtacctctggctgtcttgaacttaggtcggtccacttccccctgcttcccagtgctggcattgtagatgagtaacagcatgcccggctcaacacagtcctaacacatctttacaacttgattatgcaaatctcagggagaggctcaataaatatagctaaatgttataattcgaggtttgtgctttcataactttcgtgtacaattccttcaaaaagtgtcatatacaccttgtcccttgtcacttgctcatatgtagttattatgtgctggaaataagctcttgctggttacaagtacattctgccactgtgtgatatgttcttccatttttcacgagtctcttcagaaataaaagtttctcatttttaatatagttattttttctcacagatttcaatttaaaccattttcctaccccatgattttaaagattatccgctcacatctggaagctttgtggctttggtgatcacacgaatatccagtgattacctaaaattgattgttttctgtccttttctccatatggataggcagctgtccctgcacataagtttccatactagtgagaagaattaaatatgtatatgcaccaaggttttgtttctgtgttctctgttccctttgtatcaccttgttctgacagcacactgtgttgtttgttagagcttcattctacgtctccgtattcagtagaacaagttcttccaccttgtcctcaaaacatcttggctgttctcagcccttcacacattcatatgaattttagtatcatgttacatagacagacatgcatatgcatacagtctgtcaatgctttgattatgattgaggattctaaacatttggtggagaagtgacatctttgtttttaacttcgttaacattgaacattactctatttttttctctgtggtatttataatctctagaaacttttattcttatgtatttggtattttcatgttactgtatgtaagtgcttatagactttattttgtttacatttttatgctgaccttatatatgatcattgagttaaacttttattacccttagtacttatctttggaattatttactaggtagttagtcatcttatcagccaataaagaaaattttatttcttcctttcaaaatgttatatatagtttttgtgttactgcatggactaattctctaatactgactagaagtagtattcgtgggaaccggttttgttccatttgtcaaagaaaagtatttaccatttctgtactaattaagatatttgtgtttaattttttcctagctttttttttgagaataatgaagctttggtttattcttaggatctcaccaggtgttcttcctggcaaaataaccatatcattatgttcttcaaatcaaatgtattgattactagtcagtaaatcccaacccagcccggtcaacaaaacagttttcttttacattacgtgggaatttcagaactttgttcatgagtaagattgtcttgaattacacgttttggttttttttttttttttgtattcttgtcaaattttaagagttttatatgctgggccgtggtggtgcacacctttaatcccagcacttgggaggcagaggcaggcggatttctgagtgttcaaggccagcctggtctacagagtgagttccaggacagccagggctacacagagaaaccctgtctcgaaaaaccaaaaaaaaaaaaaagttttataatagggtttttggtgtatgtacatgctaacattcagtagagaagctatttagatacagggttttctttgtgggaaacttcagtcacaaaacctgggaacctgacttggtagaatgttttgagtaataaacattaagccctccattcaatcactagccgaatataaacgtgaatggtacttcatgcctggaatccctcacataggaagtggagtcaggaactgtctagaggtcagggtcattctgactatataatgagtgccaagtcactgagggctacatgtcacaatcctgtttgaaacaaaagaaagagtgaatgaatgaaaattagaaaatatattgttttagtatgtattcttcaggctcgtttctttccactgttttggcagattattttgataagcttttcaacttcatttaaaaatcatttaaaatattattatatgaggtaaacactcatacatctcttaaaaagcaagcatttttacaaattaaatacaatgccagtctgttttaaataccatgtgcatgcctggtacccatgcaggccagaagaggatgttgagtcccctggaactggagttacagatatgccaagtgaatgttggatatcgaaacagtgacccctgcaagaacaacaagtgctctttaaacactgagccagctctccagccctttgcattatatttagaacctcattgggcactcctacaatcctttctcctcctctgccataggtttccctaagttctgcctaatgttcctatcagttgctggatgaagccttcctggtgacagttatgctcctgtctaccagtatagcagaatatcattaggtatcatttcattgactttttttttctggttgtctttggttctatcctaggtgtctgggtcctggccctccagaccaggggtgggctccctctagtggcttgggtctcaagttggactagttatcagttggccactcacaggttttgttccattcttacctcagtacatcttgtaggcaggacagattgtaggtcaaaggttttatgtctgggtcagtgtcctagtccctccactggaaactttgtctggttacagataatggccagttcaggctctatatcccccattactaagagtattcgatagggacctagggtcacccttgtagattctagggagtttccgttgccctaggtatctacctcatcccagaaatgtgttccagttccagctatttctcccagtgctctccccctccactccccgcaacctaatccctcctgttcccatctctacccacctgcagtctacccacaaaatctgttccatttccctttcccccttcccagggagatacatgtgtccacccttgagcccttcttggcacttcacttctttgggtctgtagtttgtagcatgattatactatattttacagctaatatccacttataagtgagtacataccatgtttaactttctgagtctggcttatctcacttaggatgagttttttttttttttttctacttccatatatttgactgagattttcatttttggctttgtatataacattttccccctttatgacctttctggcccagggcttattttggtggggggagggaaattttaatgactgcatagatttccttagtggttataggactattcagatagtttacctgatcttgatttagctttggtaatgggtatctgtctagaaaaatcatccatttcatttcgattttccttttttatttgattttttatttttgtttttgtttttggagacagggtttctctgtatagccctggctgtcctggaactcagcctgcagaccaggctggcctcgaactcagaaatccgcctgcctccccccccccccccccccggctgggattaaaggcgtgcgccaccattttgtggagtacaggcttttgaagtaagacctaatgagtctttgaatttcctcagtacccattgtaatactgggttttagttgggtctcttgacaataccatatatgtgtggcttttttttttgaatctagcctgacaaacaccatctgtgtttgaaatattccatttaaatttaacgtaattgctggaatataagggattaagaaaattgttgctagcttttcctatagctctattttttctcttcctttgcttcttattagttttctttttattctaatatcacgtactcatttctattcctcctgaaattactatagcatttccaatgtatgtctaatgatacttttaccttgctaatatttggaacaaatacactttacacttcagttctgtttattatctatctcctggaatgtatgcagttggtgtcctgtaattctttatacatttgtaactgtgggtactaattgttttgtgacatcagtgttctttaaattttttttcacatgcttatgtacacttcatagctccttcttggctcagttttgtttagccttatgacttagtttggattgcctggctgtgttttctatttttatttatgaatgttttttattttcattcttaaagagtattatatgaatatatggggtatgagtgtgtgcatatgtgtgcgtgcatgcaatcttgacaacttttagttctttccttttactgtggacctcaggaatcaaactaaactcaggttgtcagtcttgtgctgcaaacacttttacccagttgagccatttcacttgggccctaaaatttcatgtttttaaaaattttattcttgggtactatatatacaaccactgaaattcattatttgtatttttaatttgatacatgggtaccgtgtttccagtccctaagatttcattcttgagcgacatttttccgagtgggattgtaatctgctgcttattgtctgtttttatggtttcccaccccctttttttcaagagtgaagccttcagcctaccatttgtttctttgaaagcagcctcttcctcgtaaggatgctcttaaaatttctttccattgtgggttttcaaccagtaatttattgaaatttttaagtatgaggtttgacatctttcatcatttttggaatcttttcaatcatacacataatgctgcttcatttttttccttattccttggatttcaatgacctgtggactattagaacatccaacgctatgctagtcatattgcctaccccttctctttgttctgaaacccttccccaagtctttgagtttacatttgtgataatatccatcacccattaaatggtctttcattaattaatttaaattcttgcagttttagtaacagttgcttttcatttaaaaatctataatcatttggtgcatgtcattatttgtgacaaccaagctccatccacagtcgatgcagtcgatacccccaagattatattccataacaacgccatagacttgttaccttgcacattatgatgtctgcacagtgatttatttcttaaaatctctccttgttaggtgtaacataatggctatactttgctactttttatggttctcaggtttggtgctgagatattaaacatagcaagcataattcaaaacttgtaacctgataaagctctaataactgtagcccctatgaatctattttggatgattttgttattgccgtggtgatgctgatgatagtggttgtggttgttatggtttgctcatatcctctggtagttttctttcattttattctggacattgtatttgaaaagcaattttagaaatcatttgagggctggagagatggctcagtggttaagaacactgactgctcttccaaaggtcctgagttcaaatcccaacaaccacatggtggctcacaaccattcataatgagatttgacaccctcttctggtgtgtctgaagacagctgcagtgtacttacataaaatagtgaatgaatctttggggctgagcaagcgggactggagtgagcagaggtcctgagttcaattcccagcaaccacatggtgcctcacaaccatctgtacagctatagtgtgctcatatacataaaaataaataaataaaccttttttaaaaaagaatttaaaaaaagaaatcatttgaaaccaaaggtgattcatttcagaaatatgtgtgtgtgtgtgtgtatacgtgtgtgtatacgtacacacacacacacacacacacacacacacacacacacatatacagacatgcatactggtgaggttgcagggagaatttgcttttgccagtccaggtattgcttaataaaatttcaggtagggcttttgttgcttcttttggtggtagtggtagtattaggaattgaacctaaggactatacatgctaggcaagcattttaatgctcagtcagttagatgactcaagaccacattatattcagtgattgattactgagttacatttatttctaaaatgctggttctaagctgaaggtgggaaaagagtactcacaacccttgtggatgtggcctgtcaggtaaactttaaatttcctactttcctagatctcaaagtactttcctgatagatctttgaccctttaagaaaaagactttttaaaatgtcctgtcaaactctgttacttgtctgtggtgggagggttgatttaaattactcagcatcctatagataaaaaggcttttgatatatatgagtcttcattgacagaatttccttatgaatgtcagttgactcttttcttggagacttaggctattttatagttgtatataagctttgttttagatagttgtacatacatgtgtaattatgtaatttttactcaaagtttaccatattctgtgtatatataaatgtgagtaagttctttcctgaccattcagcaagagttttgagtccttttaactctagcaattcctagtccttggcaatagataagtttattgtattaatgttgtagctaaatgcagtgtctgaaatgattatctttggaatgtgaaattcttctggattgctgttgaaattggagtgcgtaatagcaactaatttttattacttttatggagactagtatcctagtttcccattgcccatgacttgttagtgtacctatatgtaggaattatagacatctgttggtaaaaacaaaacacaggagtcttagatttgctactatttcagcacttaagagagtgaataagtatgacacatccagtgaataaatatatcataactctttttcttttatgtatattaattcctgcagtagcctttgaagtgagtatctagttacatgtgattttaatcaaataacttgtctgtggcccaatgcctggaaaatgaatattttttatcagtacacattttatttcaagtcttatggtctagagatgcacaccgacttttcagttttatctctttatgcttttccccatgtaaaccctcatactaagaccccatgactcatgtcctaaggttagagatagttaagagatgagcctttgctatcctattgttactgaccttccactaccctatttctagagcattattttcctggctctgagatttactgagctgtgtgccctgttagaaagcttgctgggttattcttccctcccgtccctgtcccagcacacattactcctttcccttgtctagttctaaagaagttgtttctctgcttcccattatatttttcacctttacagttaaactcagacttccctcctttctgtcttcaagaatgtcttctgtaaaccttccttgtttgcttctttagccaatcttgatggaatcatagccaaaatcctgtttgttctatccttctgaatgttaacagccaaaagctgagctgtttcaggcctgtcctagccataatcagcacttgtgtatgtgtggacttgcactgggaagtatccctcacatctcattttcactctgtgtgctgtggtccccttggaaaactagcagattacccctgcaaacattggtgcttttattcagttgtaatatatccaactgcatgacagtcagttctaagtcctgcacttctaagatatgaatatgctgtctcctctaattttgtattaatgtgttttttcatgaatttttttttcatttataactgtttaaggattcttttggggagaatgcaaattaagtagtggtctcccatgttttactcacaaaaattacttacacttttaaaagtgttgaaggaactcttgacttgtaccaaatccctttgaatatactatactggtttgttcccctttttttcttttaattatccatactttttgtggtctgctttggggttattttccttcaataaacttacttttctgaatccatttctcccttgtataaccttcattctgagcatacaaagtgtgcatacttcactagctcaagacaataagggtatggagtttatgctgtgtgcttcatcacttactgcaactctgtttgagaattccatgcagaaatacacttagtttcatcattcccacccctccctctgccctttcaactcctccatcaatttcttgacctcttttacaattattgctgtgctttggggctgaccacctaggattgggggctcattcttaaatctcattctgcttccttcagcagccattgactgcctggagcagcagttcatcttggggtgcgtttgcagattttacacaggcaaccatattgttggaagtttgtaggtaccactccatccctgccctgtccaaaagacacttatcttgtagcagagtcatcctgggtccccaagctcttagagtttctttctctctctcttcttcagtattccctgagctgtaggtgtagatgtgctaaaggtatttcacttggggctgggtaccaatttttgccagattttggatcactaacatagcctctgcctactaaattcaaaaaagctttaatgagagctgttcttatctaggaaagaggataagtgtttagaaggcagttgaaaactagagaacctaagtagtagtaggttctcctctagggcctgggaactctgtgcttgacagtcccatacttgagtttcttcccattgagtaggtttgggatacagttagacagttgttgattactccgaagagacaaaggactcccttcatttctaataaatatataaaggtactagcttgttttttttttctgcttttagcttttttctatattctgaacgagaaaataatcctttttcttccaacattactcttttctttactgattgagtcaaggtctttctatgtggcccaggctggtctcgaacgtgattttatcccttctataacctcccacgtacttgaattgtaagtgtgaaccacaacacgcaattaaaatcattatctttcaggtattacttgaaatatgttacttttttcttgactatagtgattcttagttgatttcatttaactttatgaacatttccaaatgtatataaataaaaagttcagcacacttctaattgctgtagctgacaacatactgccgaatttgttttctccattttttttcttttttctacaaaaactgaaagcataaataagatgtcattgcactccaaagtgaatgtgcctcatactacattttcttatctaaatgcgatggcattatcatacaacctactaataccctagcagcaaaggcaacatttggttcatctgaaagtttccgcggttaagcctcttcacgatttgcttgagatctctatcagctctcttatcccatcctggtgaaaggttcgtctgttatttatccttcgtatttcaaatggactagaaattatctatctgcttaatttggttcagcttatatctttggatgtgtggcaagaacacttgctgtcatttcgtgttgcgtcatacctgagagcacataataaatcatttggtcacttctgtcattattaggtatttttttcctctgggggacatccttattctgcttcacaggtgctagttgcttaacccaaaatctcttgtcagctgtgtattgttaagaaacaatcctagtttagagatcgaaagagtctgctttcctgtttaacactttgtattgtttcactgaagtttatgataaagtaatcttcttccttctgaaagaagttaaaagtcatccccagaatggtagattagtgactttgtgggttacacaggagtatctagtctcctagctctgggtgagttagcctatttgttgagattgaatggcagaaaaaccaaaccagaaagaagactttatacctacttcctgctgctgccttgtagttagggtatggtgctcactggagctgtgggaatgcacaaagtcttgtaggttactggaaactaaatcaggctcactatggagtcatttaaattttaaagacccagggccttaaaagagccccagcacagttttgtaatcaaatgcattaaattttaatgactactttatcttgggaagctgcagggaccccctgatggtttactcttcttgctaggtttttctgaagccaaaagctcagcaaagcattgtgcctttgcaatttggacctgtgccttaggccctagaggtgactgatgggaacagcctatctcaggcagccaagggagcggttttcttctgtgttgattaaatgtaaacttaattcaatgaaatgtagtcaaatgaccatttacattttcatgacctttcatttcattgtacatggttatcatttattcatgatcccttttaagcctttcactgtttttaatcttacctctttggtcattcttttttctataggacagtggtgccagcattttcttcaagttattcaccctgaattatagtgtgtctaactttgcaatgtgtcttagctgaagtattagcaattgagacgttgacggtaagacatttctataactttgttgagagtgcactggtctttatagctcttaccatgtttcttttttacactgatccccataagtaatccttccccgttatgcatttaaaggataaataagctaggtgatgtgtgcctatagttccagctacttgagatactcagtatcctttgaatgtacaagatgagacagcacatcaaaactaagccaaaccaagcaacctgcagagcaaggataacaaaagaaaaagaagaccatgtgatttattttatttaaattcggcccttataccctaagcagctgttactgcctgtttaacagaaatttaagttctttggataattcatttagtgttagatactaatctggcccatggctcagatctctattggttggagctattagaatattgaagtcctaccccaaacattaactttatctaatttatctctccatatatacatatatatgtgtgtgtgtgtgtatgtgtctgtatatatatatgtatatatatatatatatatatacacacaaatatacatacatacattcatacacacacacacatatatattctggattctcacattcttgttctataacaaaattgaacaaacagtaatgccaatatccttaacaaacaagggtatcaatttttagctggatggtagccttaattctggcttcgaacctggtagatctgaatcaattgattatataatgctatcagctttgattattgcatatcttatctttttacctttaagaatttccctgcccttttaaatgcatttctcattataactgtatgtgtgtgtgtttgtgtgtgtgtgtgtgtatgaatgtattatctcttgcaaattaaacactgaagcctatttaatacatactgtcttttttagccagttttttttttctttttttttccatttattattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgagtgttttgttccctcttctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgccctccaggtccatccatttgtttagccagttttaaacccttcttcccttcagttatttttagtaaaccaggagataggattgggcttgggctcaggaactctctctcagcttcagtattatgatattgaggtagatggtcccttgacatcaggggttgtcctgtatactgtgggatgttcaggagcacgcctggcctctgcctgacagattccagtacactcctcgttatgacaactaaaggtagctctagatatcaaatgtctctataatgaaagtcttttagatacatgtgtgcacatgtaaatgtctgaatgccatggagtacatacagaggccagaaaacaagtttcaggaatcagttgtctcctgtgggtaccaggcttgtgtgagaagagcttcttttaactactgagacatctcagcagccttccaaatggcttttgcagggagaccagctggtatatatgatgtggtagagccttttagctttatgattatgttctttttatttaaaagagagcagggcctactctttgtaggtgcagcttcaatgccatttcttccatgaagttttctgcggctctccttttctttgtcttaccacaagcaacattttctcatttatatcttccggtgtgttgtttttaatttgagggtatgggctttctttattttcaatttcagtttttcttgaatgaacaactatttgggaatatcagattagaaactgttaaatgaatggttttaaatactctttttgttgacttttcaaatccatctactagaagaacccctcagaacttgaatttctggattaagaagaccaatataggtcatctaaatcatttgtcgatgtagtctaagatagaaacctctttatgtatatgtgaaatagctatataggaatacttggaggctatatttgaaagacacagaaattaatagcttaagctgtttgagttttcatatagacattttatcacgtttatattgtgtgcatgtgtgccaaagcatgcatgtggaaggtgagagtacaacttgcagaagtttgttttcttattttgccatgtgggtcctagggattgaacatgggttgccaggcttgatgccaagcacttttgattgctgagccaatctcacaggtccaaagacttttttcttaaatcaaatagaaagcttctaggttattaaaaaaagtaaacagggatagcagtaaatattttatttaagtaacctagaatatttaccacactttaagccaggtatcaactcctccaacaataagaaacacattttaattatatcttatatatatacacacatactagaaaccagtttttcacttagtatttttctgtatacattgaacttcgttatttttcagttatctttgttttatcttaaagaatagccattgcctagtacatttgtctaatacaggaattggtcacgaccctaggatttgaaaagcactagtaataaatatcgagattatctgcctctagagtatgtcactaataggttgtgttgtcattcttttgaaataatgtcatttaggaattgagccaacaaagacattaggataccttaaccagagcattttaaatttccaactactttgaattcctatatcttgacatttctactaagtatttataaattctactaagtatgtataaattattgtacccaaaagagcttttctttatttgtattcaagaattatattaataaaacttaggagagaataaaaacttaacagatatattatgtgaggttcagaaagtggtatcaaacactccatgcttttataggcatgtaaagggggagaaaactgtatttatagaagttcctggtagatgaggactggattttgtgttatatcagaggttattgcacgtggtagaaatagcaataagttggatgatgaatacttgtacctgatacttaaagatcatttttattcaagataaagtgagaggttttaaaattagatattaaagttctggcagtgtaaatgagatacagtactttagttctgtgtttatgaactgcagtgtattcaggagattaatcagaaacttgtgtgtatgatagctatgatagaccctgacactctaacatgaggatgttaaccttgggttactaggtttactgagagtgcagataatgtctaaactacagaaagtagtcaccatcaaaatacgtgaatacagttatgctcaatataaacccttctttgtagaacaaaaacatgcaatagcattttcaaaataaatattttacttacacaattaaaaactatttgtatatcataggcccaggtgtaatcctttcttgtctaaatagaatgagagctcaggatgttaagttacagccaggcgccacaaagcctcaaagtaagcatagactatggctttgtctttttaaactgcagcttcttctatggaacaacgtagaatttaattactgtagaaaaaaaattatctaaaaagataagtcagcttgtgatgatacttggcaaagagccacatgccctagtcaagtattatgtctgccagtcttctaagtcaccagaagtctcatagatgtcatacattttcagttgagaaaagagcaaaagggtatctttaaattttctcggattcctagacaactgaaaagaaggtcatttcagagctggagatgtgagtaaaaatctcctgttcccaggacacatagaccatattgagatacattttttcctccaattttaaatagacttgaattttttaaatttttcattggatattttatttatttacacttcaaatgttaccccttttcctggattcccctctgcaaccccctagcccatccccccttaccctgcttctatgaaggtgcttgcccactgcccgcccactcccactcaccgcattccctacactggggcattgagccttcacaggaggatcttcttcctcccgttgatgacagacaaggctatcctctgtagactttcatacttaagaacagatttagttcgcagaagaattgagaatatagtacagagtttccaataccttgtactcagcttctgctcttattaatagcatatattagcatggtgtttttgttataacatgtacctgtagtttgcactttattcacttttccttgggttttaaccaggtctggtttttttccttgtgttttaagcttccatacaggaaaatatgtaacttttggttgttatgtctcctttttcagagtcttctttttccttttgaggccatgacaattttgaggtgaacatggcgatcgggttctttgtagagcattcctcagatgtgttgctcgtagctgggctggggttatggatggttttagaggaaggctataaacaaagtaccgtttgatgctcttttcaaatatccagagtgctgtcaatatggcttatcattgctcatattgaccttgattcacctgggagaggaagtgtttgccatgtttctcttctataaggccaaccttttgtcttcatcttgttctgtatttttgggagatgtatctccccctccccaattattttagcatttccttttaccagtgtgggcttatttagtttatactctggttcataatctaacactactttattttgatgtcctggttctttcagttttctcctgtgttactttgatatgaccctatcattatgggtcgtcttttttttgaatacttctttactttctggcactacaagatgcttcaagctgagcaggtgagttgactcagtggttaagagcatggacctctcttccagaggtcctgagttcaattcccagcaaccacatggtggcttacaaccatctgtaatgggatctgatgcccttttctgctatgtctgaagatagctacagtgtactaatatacataaaacaaataaataaatcttttttttttttaaaaagatgcctcaagcccatcatgtataatccttgacctagttctagaatcatccattcctctatagggctgtgattcattctgttagagaatactactagaaacttagcttgtttctagatgttctagatgtggtcattccatctagatacatgactttccaccttcgtagtactgagaccctttaaagcagttctttgggttttattgaccccctccaaccataaaattattttgttactgcttcataactgtaactttgctattgttatgaatcataacgtatatatctgtgttttctaatagatttgaaagggctgttggacacccaaaggagtgcaagcaaccctctggttgagaactcctgttctagattctcctggctaggattttgtggatatattttaccatacacacacactgaagcttatgttccaatatttcagcatataggttatagataacaaatacataatctctttgaaatgttttagaattaaatttaacatggatatgcttttatttgtttctagggttatatttaacttgaaatgtttttcttgatcatttaaatggaaatgctatttgggttttatttcttttgagaatataataaaatatgggctatatgccagaaatctgtgactatttgaaattagtttttactataatgaaaatcctataggatgcttatttcagaaattatcagaggatccttttaggagaaacaagtgatcattttctttatctgtttttacatatgtgtgcaaaaagtcctgaaattggaaatatgtctttgaaagatctgctttttaaaaattcctccaatagtgtacacttcctgtttccatttagtatgaaaagttcagtctagtgcaagtattcctgtttaaacaaaatttattttaaatttccctttaagagttaaggcatcatcagaatcttgccagctagcagaacaggaaaccactggctaagagcatagacttctatttacatcctttgtgacttgttaacactatgcatttgcctttgtgcctcaattttcaaaagaccttaaaagtcctctcacaacaaagcatattttcctttaaacctaggaaatgcttgcctcaccagtcaatatcgtcagccagggtattctccagtggtcttttactgctactgagatttgttcatgggataggccactgtgctgaatagctctcctatcccaagacagtcttgatataatgaattactgatcctcagattataatataccattagacatgctaaactgattctgtctttataacacatttcagttaccacaactccagaaggtatgcaaataaatgaaccaaagacagaactcttttatttgtggcttctagtgggtagaattggagtggattaaagtggcttcaggcagttatttcctatagttgccagatagtctaactttgaaaagtttaatgttgaccttcttgtatgagttatcctattttaaaatgtaatttacccttaaaaatcattgtcaagaccaaatcaaggatatctataagctagatttggcctctcagaccattggtttgcaacctctagtgtaattattttaggtagtgaactaacgttttagcagaggtagaacactgagccataatggtataatcttgtatctttgctgagcttacaaaagcctgtagaaaccaaacacttaggtatcaatgccattttctagactgtagggaattgtggttcgacagagccttcggggcgctttttcagaacagaagtcactgtaggtgtgggcaaggccagtcctcctgattagggagatggctatgcaaccagagaacctttctatgatgccactgctaggcatagtttctgtcctcctaatcttccatcaaaaattaggagtcccagtcacatgtagcatatatcaataattccagcacttgggatgtttcgacagagagaccattgttagtcatagtccagtttattagtcatagtctagtttaggctaaaatgagaacccctgtctttaaaataaacagggctagagaaatggctcagtggatgaagcacttgcctcagcatgtggtgactgatgtttggatatctagaaccaacgacataaaagctgcttgtaatctcagcactgaggagactagacagaatttccgaggcaagctagatagctagactacctggaatgggtaagttatgggttcggcaagaaatcatgttaatcaaaaaggaagcacaatcaaggaagacgtgtgacatcagctccaagcctccatacatgtgtacatacacatagcacactcatttaggagtttacaaaacccaacaagaaataaaggctcaacaaccttagaaagtcttctggtccatgtgatcctatctgttggattaactttttagtgaacaaaatggaaattattttaaacattatatagtattcaagaaagtattatatttgagtgttttatgccactatgaaacactaaacagtaccattttggtacttatgtaagggaatgcctaaggcagaatagcaagcattattaagagtacatgagcttgctgaccagagtcatatctgtgagtatagcagaaccttgttagttgtttaattgctgtgtttctttagcagaacagtagtacttggttttccctaatcccatgttctgtctagtgtcaggtccttggttgtattgtactgtcaggcatgcgttccatctcatggccttgaatttaatcacgtagtggttggtgactcccttgtcttttgtgctgttactgtgccagcatattatgcagacagctaaccattgtagagcaaagggttcatagctgttttgatgtttacctgtctgcttgggtaacatgcagagtaccttctagtaccatgaacactagtcagtaggagtgaaggctctagataggtaccagctcaacttctctgtcgtattcagtgagttatataactgttgtcgtcagcaatagggctttactgttggtttgtggagagcaaccaataatagccttggcaattgcctgcgttattttggggttggggcgtctgtgaggccctggaggcagaaagagtgtaaaagtcagtggggatggaaaacaccaaggaaacaagccttctagatacaggaagactggtgcacataggaactcacagagactgtggcagcatacaaagtttcaagctaatggggtccacagccctgaaagaggaagtggatgcagtctccccccatccttagccagaagttatctttacctgacaaccactcacaaaagaaaagtaagttttctccagcagagtctcaccaattatagaaaccacatttaaatacagacaggatctgtccagcagtagatggccaacacaactgagtgatgtgcttggcatgcttttggttttgttggttgttattgctgttgttttgggtggtggcacacacctttaagcttagcagaggcaaagataggtaaatctctgtgggttaaaggccagcctggtctacagagcacatttttttttctaataatgctttttctgggtatatttcctttaaccttgcaggcctcttacttccatattacggtttctggttttgtgttcttattgctatatgtgcaagtgtgtgtacatctgtatgtttctcgtcccttttctttggctctttttttcttgcttttttttttcaagttacctattcgtgttctaatgagaatattaaaggattatagattttgctggatggggagggggaaaggaattgggggatgggaaactttgatcagaatagagtgtatgaaaaatctgtttttaatagaatagtgaataaaatataagcactggaaaaaaaaaaagacatgaagaatcccagtacaaaagggcatcttctctagcgctgcagttcatataacctgtaaaatcaactaattactttgttcaagaattctttctttgcttccagcgttctacctccccacatgcccagaactccctgtttggatgagtaaccaatgaaagttcactctcatttttgtcccagccatagagagacagaaagtcatctctgagtatgtacactggaattgtaaaagatatctaccagggacagtgtgtaaaacagactttgtagaatgcagattttagatttgagttaggattttaccctaagtatattctctgaattcattttgttatttgcaaagtggaggtaattatagttacccttgagggcatagttgtttagtaaatgagatctaataatagtgataaattgaatggaaagtttgtgctgacagagcactctaactctgaacatgcatggagcctgtgctgtggcacttgaaaccaattctcgtcttctttctcataataagaaaactgtgcggactttgcattgtgagaacgtctaagtagggtcaggaaattatttaaaagtggtctttttgagctattatgaaatcttaaacaattggatgcttaagaagttcttcattaaaatttcagttaaatattcatgacttgttttggatatggcagtccctcaatggttagaaagttgttcctatttctgtaaatacaaatttgattaaactcattaaatttgttccattcctcttaatttcacttataatctcctaaacacctagtctctgctaggctttgtacctagtcaatagtaaacattgaaaagttttacaggttgaatctctttaaccccaaatgcttaggaccagaaaattttctggattctagtttttcttcatttttgtattgtttgcacagaatttatgttctgctttaataatctcaattggaaaatctgaaacttgaaaagttttaatgcctgaaactgatgattttgttgctgctaaaaaagtttcagtatattcacacaatcacaacacacagtatgtatatatattttctgagagtaggttgcatgtcctttactgccaagaagttttacggtacaatttataaacctaagtatttttttgtgcaaccacagtagagttattggtgtaaaatgtttctcttttcaaccaataagcttaaggagatacttggaagatgatatagatatagatatagatcccacttttctctcaaattttccctgaaattagcattcattagtgatacatcaatcaatcctatgatggacgaaagtgttcccagctctaacattagcctgtatgtttaccatttggattctcctgtgagtatatgtgtgtgtatttagcttttcatcatctgtgtgaatttcaggtgcttcatttctataggcctataattcatttgtgtccctcctcccatctttcccttctaatcagagagactagagccccattccctggcatccccccactctggcacatcaagtctctgcaagtctaggcagttcttctccaactgaagccaaacaagacagccagagttagtggaatggattcacagacaggcaacggcttttgagatagctccccattctagttgttcaggacctacatgaagaccaagctacacatctgctacatacatgcatgggaggcctaggtccagcccgtgtatgctctttggttggtgtttcagtctcagccccaagggtccaggctagttgactcttggctttcctagggagatcctttccccttcagagccctcagtctatcccctaactcttccataagagtacccaagctccatccactgtttggttgtgagtctttgtataagcctgagtgagctcctctgtggagcctctcacaggacagccatgctagatttatgtctgcaagcataacagagtattgttaatagtgtcagggattggtgcttgaccatgagatgggtctctagttggaccattccctcagtctctgctccatctcccctctttccatttcttgtaggctgaataaattttggatcgaaagttgtgggtaggttggtgtctctgtagctccactggggttcctgcatggctacaagaggtggcctctttaggttccatatctccacttggtctcagctaatgtcaccctcattgattcttaggagccttccatatcccaggattctttgcatgtccttgagacgcttcccaccccccaccccctccaggctgtagatttccattcattctcatggccatctggccatctcccctgtctctccccacatctgatcctgaaacctccccatcccctctcccacccacttttctccctccatctgcctcctatgactattttgttcccccttctcagtgagattcaaactattttgtcctaatggcaatgtcctttgcctggtcctcggtgttctgttcaggaatttgtctcctgtattaaagaattcaaagctattctcactttctgttctattagatttagtgtatcggattttattttgaggtctttagtccacttggacttgagttttgcgcagggtgatagatacagatctatttgcattcttctgcatgcaaacatccagttagaccagcaccatttgaagatgctttctttgtttacattgtatggttttgcctttgtcaaaaatcaagtgttcatgaatatgtgagttcatgtcagggtctttgattaaattacattgatccacccctctgtttctgtaccaatactatgcagtgtttattactattgctctgtagtatagcttgagttgagggatggtgattcctcccaaagatctggattgttttagctatcctgggtttttgtttttccatatgaagttgagaattgctttgtcaaggtctataaaacattttgttggatttttctttttaatggaaattgtattgaatgtgtagattgcttttggtaaaagggccatttttactatgttaatcctgccaatccatgaacatgggagatctttccatcttctgagatcttcctcagtttctttcttcagcagcttgaagttcttgtcatataggtctttcacttgtttggttagagttacaccaagacattttatatagtatttgtggctattgggaatggtattgtttccataatttctttctcaaagaaccagctcttgggtttgttaattctatgtattgttttctttgtttctaattgattgtttttaggcctgattttgattatttcctgccttttacccctcttcagtttgcttactttttttgtaaattgctggtatgagtactttctaatttctttatggggcatttagtgctttgacctttcctcttagtactactttcattgtgtcatataatttggggtatgttgtgccttttattttcattgaattatagacagtttctttctttcttccctgacacacagatcattcattgagtagagaattgttcagtttccttgagtgtgtaggctttctggtgtttctgttcttgttgaagtctggctttaatctctggtagtctgataagatacaaggccaaggtgttatttaaattttcttgtatttgttgaagcttgctttgtgacagactatcttgtcagtattggagaaggctccctgaggtgcagaggaagggatattcttttgtgttttggtgggaatattcttctttggttttttgagacagggtttctctgtatagccctggctgtcctggaactcactttgtagatcagtctggcctcgaactcagaaatccgcctgcctctgcctcctgagtgctgggattaaaggcatgcgccaccataccctgtttggtgggaatattatgtagatatctgttaggtccatcaattcagaatatctcttaatttcattatttctccattcagtttttgtctggatgacctatcagttggtaagagtgggatgttgaagacacctagtattaatgtgtgggatttgatgtatgctttaagctttagcaatgtttttctttcccttataaatatgggtgcatttgtgtttggggcatagattgtcataattgagatattatcttaatagtttttttgatgagtatgaactgtctttccctttctcttttgattgatgttggttgaaagtctattttcttacatattaaaatgagtattgcagcttgctttttgggcccatttgcttgggaaacttttttccagccctttactctgaggtagtgtctgtctttcttgcttatgtgtgtttcttctatgtagtggaatgctggatcctgtttgcttatccagcctgttaccctgtatctttgtattggggaattgaggccattgatgttgagaggtattaaagaccagtgattttaacttcctgccatttttatgttgttgttgtttgtatgtatgtgcgtgcatgtgtgtgtgtgtgtgtgtgtgtgtgtgtgtgtgtgtgtgtatgtgtgtgtgtgcttgtttccttgttttcgctggtatggatttacttatgtattttcttgaatgtagttatcttccttaggttgatgttttccttctagtactttctcttgggctgaatttaagaatagatattgtttaactttgatgttgtcttgaaatacctaattttctccacctatggtgactgagagttcttctgggtatcgtagtctaggttggcatatgtgcttatctagaggttgcaaggtacacccttctagataggagatcctttgttgagaagtcaggtgaaattctgattaggtaggcctttatatgttaactggcctttttcccttattttctttaatattgtttattagttctatagattttgtgttttgattattatgtggtgagaggatttactttttctggttcaatctaactggtgttctataagcttgttaaatgtgtataagtgtttccttagttttgagaagttttcttttattttgttgaaaatattttttgggccttggaggtgggagtcttcaccttcttttattcctgttattcttagggtacgtcttttcataatgtcccagatttccaatatgttttgtatcaggaactttttagatttaacattttctttgactgatgtctttaatcatatcttctacacttgagattcttgcttccatctcctgtattctgttggcagtgcttgcatctgttgtccctgtcctcttccctaggttttctatctccagggttacctcagtttgtgtggtttgttttgttttttttttttattgcttctattttcattttcaggtctttgaacagttttattatttccttcgcctgcttaattatattttcctgtattattttgatcagtttatttgttttctctttaattaaaggcttttacttgtttgattgtattttcctgtatttcttaaagggatttattcatttcttcttaaaggactctatcatctttataagattggttttaaggtcattttcttgtagctttggttgtgttgagatatccagggtttgctgtagtagggtagctgtactctgaaggtatcatattgccttttgttgattgtaggctcaactggatggctttggtccctggatgttctgttgtagtaggtattggaaggggcctaagctcgatgatcctggtgtggcagacctctgatgtgtatgcttgggctgtgaggttcctgatcagcagttctgatgatggtggcctgacacgtgtcaggagaatggggattcagtggagatggcaagctgctcaggggagctagggtgtcccagaggactcagtaggccgggaaagtggatgtggatggaatccaacgtgtatttttgcagatcatcaggtctgatgaagatgggtggagaggtggtgggatgctgtgttattatctttttaaaaatactaatattgttggctattttacatcaaaagaaataaactgaatgtatctgttttctaacattggttccaggtataattatttcattttcttgattttaataattgatggtgtcttaagtaaaatatggaattagacttaactaaacttttatttattttagaagaaaatgacagagtgtttggaagattattacttttggaagtcctgctaatatccatttcctaagagatagttgaccaacattgactctggcatggcgcaaaacagtccacagcttgatattcaggttctccatgatcttcgacaacgttttcctgaaattccagagggtgtggtatcccagtgcatgttacaggtacgtttcctgaaagtgatgttagagttggcatgttagagtacttgttagagtactacatgtgctagtgcatgttttataggatttctcagacttagtggtggtgttgatattgtggggcaggtaactctgactgtaagctctttctcatctttcctgagccctacccactgtataacagtagggtttttacagttttgacgatggaaaatgtctttctgaattgctaaatattccacaaaaggtacaatctcacccacttaaaatcctcctaaattgggaagaataatcacatgtagaaagaaaaattccccagcaagaagaagtagtggggaaaggtgtttgctgccaagtctgatggtatgagtttgagctctgaaaaccacatgataaaaaaagaacctatccccacaaattcctctgacctccacatgcacactccactctccaaggaggaaatcatttttaaacaggttgccaataatccttgaatccttagagttcaacttttctttgatttgctcctaggttgtatgtattctgaggaagctctctacctcagaactatgcccctattccccagagatgcattttaaatcccaaatgtaaccttaaattctgtagaaaaactccttactccctcttttcagtttttagttcataagtccttactaggtataaatttgagacaactttcttttgttcagaaacattccctttgtcttgttctcaacactgaaatcttttatttcttagttttggactgtatttttactcaggagacaacagataaaacaaccattactgatgagtcagttaccttggcatggtatctctgctttagattgtgacatatccctgtttggttgacatggggagcaagcagtacatgatacacagtctgtattcatgttcacagtcccttactacagtgtgagaagctgaagatgcagcagaactctgtagacagggatggttaattacaagtagagaccagacaacccaagcaaggatttccattgtttacaaattctttactaaatgtaggcctttgggcccaaggttattgtgctatatgtggttgctaacatctgcgcactcctaatctcagctctttaggtccacttatgtttatgggttaagaaaaagctacttcctaggacaggaaaacgaagccagagttgaatcttctagttggaaccgttttctagaattgactttctttacttgtcttaggaccccttttagctccaacatggttgtaacttaaatttggcctttccttatttgtgctatcgtggcctttaactaagggaataaaatgtaaaattcagctcagtgaacactgtcctaaatcttttcctcctcctccttttttttctctttttttttttacttcaatcttttacattaacagaatcttagtgtggacattgatacctactggctccaggaagtacctacattaaccttctatgtgatggtacatgcctgtgatcaggaggctcatgcaggaggagtgctgcaaattgtggttagcttgggctatatatcaagactttgttttaactcctaccatccaaaaagcatttgtatatacagtgatgtacatgagcctagtagtttgcatctgaaacacaggccttaaatcctctggactatcttcccttaatttacatcatttagagaggtatgaaacattgttcctttagttttttttaagaagtgtttatgtctttaaaaagattatgtgtgcatatgcagaggccacaaaaggacattatttgcccgagtctatcacttttcactttattcctttaagtcagggtctctctttaaatctggaactgagctgatagtcagcatgcctcagcaattctcctgtctgcttcttctggcccaggcgttacaagcacagcatagccacacacagcttgctatgcgggtactaggatctcaactcgggttctcatactctcactgagccatatagttcccttcttaaatatttttacctgttactaagccagtcgcccagggatgtaatccccactttttgggagaatgaaacaaaagagttgcaagttagaggacagccaggggaacttaatgagactggttcaaaaatgaagaagatggtgggggctataacttagtggtagaatatgtataaaggtctaggttcagtgtctagttctgcatagaaaattatgacccttgtatccaactaaacaacttggaactctgattactctttgacatttttattctttttttatcaagacatttagcaagtcaagtatgacatttgagtctcctctgtagtgttgtttctataatagttctataacaatactatttccatagtttgtatttgtggtttaaatttgtctgtatagaatttactcatatatttttactttaggcatgcctgtgaatatgttgacagactaactttctattgtttgtattagggtcctttttgtaagattactattaggcttacagatttgttatgtaaagaataaggtttcagggttattcacaaaaataccaaatactaaagtatgttctcccctaattttatacatttattgaagttttgaaatagtttatttttatatatatttttctttccagtatctgttactgccccattctagttatcagtctacctgaattctttggctgcagatttgcttcatttttattttttaaattacttttattttatgtttatgagtatttttgtacatgtgtgtcttataccatgtacatacctggtgcctacggaggccagaggagagccttcagtccttgggactggacttggatagctgtgagctaccatgtaagtgcttggaattgaacctgggtcctctggaagagcagccagtgttttttcctgctgagccatcttcccaggcattccagacttggttttaataggtagcttctcgcccttgctcagcatgattcaagaagagaaaataaattttgcattattaatttatcctaaacttcaattagtacttttttctatagtacttggcacgtactttatttaaggcaaataaagttacctatgtttttcatgaagcaaattctttaaattactagatttaattttgcaaatgtttgcttgactatggggtttttttttttattagcttcctaaatttccagtttagtaatgtctttgataacacatcctttcctttgaagttactgtgtagaaggacactggaacttgagagtaggaactagaattggttacatggttagcttgttcagtgcctcttatgaagtatgccacttagcactcttctttctcagcatctggaaatgggaatgggattgtagatgaactctgaatttgtctcaacactaaacatcacttcattgcgtgtcctgtggtaggcttaatatcttacttgggtcactgcagaagtaaagtatttcccttcatttttagtaaaatgaacttatgtataataacatatgtttcagttacagagaaattcatgtttgttaagaattcgttaatcatttcaaaagtggtgataatatgtgttttactctaatagatgagagttctgtattttagtggaaccttacaatgtttgaaaattttttaaaactaagaatttgattattgtccattgaaacttcagttgcagttactatctgcataactaaaaagctatttcaaatatattaaatcactgttcagctggtacaaacttggcatagtgaatttcattaaggcagtctgaatatggttgcttgtaaattctcattaactctggcaaaatcatgaaggcatgagtcaaactatagaattttgcttgttgctcatttttctttgtttaaatctttgctaatgatatacactaatgttatatgatgataaatttggatgaaagaaaggaaaagagtaacattgtttaaaatcttcaggaatattacttttttcattttgtgattttggtactttttgaaactaaaggatggttattttcattttcatagggttaaacagtaatgatggatgttaccgcaagtgtgaatccaagagtagcacaacattttaaggtgttgagctgcagcaagtgtagaatgagtcctggatttggaatgagaaaacttggggttgagtcacaatgttcattacatttctgtagcagtagtggtagagctagtaatgcgagctaaatgtttatactttggattgtttaacatcccttttgtaggacagatgccaatggtgggctttatggttaaaataccactcttgacttattctgtgacagtatttatgtaactgacttccattcttaagctttgttaattttcccaatgttgtttgtaccatttctcccatagaataacaacaatctagaagcctgttgtcgagccctttcccaggagagcagcaaatacttgtatatggaataccatagtccagaagacaatagaatgaatagaaatcgccttttgcatattaatttgggtattcattctcctagtagctaccacccaggagatggagctcaccttaatggtggtcggacactggtacatagctcaagtgatggacatattgatcctcagcatacagcaggcaaacagctgatatgtttagttcaggaaccacactcagctccagctgttgtggctgctactcccaactataatccgttttttatgaatgagcagaacagaagtgcagctaccccgccttcacagccacctcagcagccatcttccatgcaaacaggaatgaatccatctgctatgcaaggtccttcaccaccaccaccacctccgtcctacatgcacatacctcggtatagtacaaatccaattactgttacagtgtcccaaaaccttccttctggacagactgtgccaagagctttacagattcttccacaaattccaagcaatctctatggatctcctgggtctatttttattagacagacatctcagagttcatcaggaagacagactcctcagaatgctccatggcagtcctcaccacaaggcccagtgcctcattacagccagcgtcctttacctgtttatccacatcaacagaactatcaaccttctcagtattctcccaaacaacagcagattcctcagtcagtttaccattcaccacctccttctcagtgtccttccccctttagctctccacagcatcaagtacaaccaccccagctgggtcacccaagctctcatgtgtttatgccacccagtccttcaactactccaccccacctatatcaacaaggacctcctagttatcagaaaccaggaagtcattcggtagcctatctcccttacacagcatctagcttacccaaaggttccatgaagaagatagaaattacagttgaaccttctcaaagacctgggacagcaataactagaagtccgtcacctatcagtaatcaaccatctccaaggaaccagcattcactgtacacagccaccacaccaccttcaagttccccttcaagagggatctctagtcaaccaaaacctccatttagtgttaatcctgtgtatattacgtatacacagccaactggaccttcatgtgctccatcaccatctcctcgggtgataccaaatccaactacagtttttaaaattactgtaggccgagcaacaactgaaaaccttttaaatttagtggaccaagaagaacgctctgcagcaccagaacctattcagcccatttcagtgataccaggctctgggggagaaaagggaaaccacaagtatcaaaggagctctagttctggatcagatgactatgcctatacccaaggtaaactttacactgatggaattttatatttatagtcgtgtgataaatgattgaaaatagaattgaacatatttactttcaattaaatgctttatatagtaagtgatgactggtaatgttaccaagagtaaaattattgtttcagagtcatctgttcactcttttaaaatataaagctgcaaatatgatcattgaaatcttgtaacctaataagactttattcacagatatcattcattggcaaaaaatatagacaagtataataagtattgtgaaaaggatacatgtactttggactggtttgtcaaagaatttgagtctttataatgttatatataagtgatattataggaagtagaattaatgaaataatttgtattgtctaggtaaatcaaagtttacaaagtctattcaaattttttcaaattgtaccagaatatatgagagtttaggatactttcaatatttgagaagggaactgactataattgtgattcagaatgcttaatgttaagccttcatttcttaattttgtgtgtgtgggtgtgtttatgaatatgaatgcaaatgtaagcctgctgtgacacatgtggagtcagaggtaccattctcaggagccagttctctcctatcaaattgtggaatttggagctgcaactcgggcctgcatgctgctgagccatctctgatccttaagcatttaacaagtacagataagcaggctctcaggaaaactaagtggtgcacaacaagagctatgaacagatgatgccattttggctaaattaaagcagaaatggttgtggcccagcattactaagaccttaaggtaaatgctgatgcccaggtcagatgagtcttatgttcattaacagtgcatgtagaattctcctataatttgtttggtggtgttttctgcaatgactttatctgtcatgctgtagccttgctgttacatcagcgagcaagaatggagaggttagcaaagcaattgaaacttgaaaaagaggagctagagcggttgaaagctgaagttaacagtatggagcatgacctgatgcagagacggcttagaagagtcagctgcaccactgcaattcccacggtaagtcagctgttgcaatatatactgataggaagatatggacattctctgttaaagccatttgattttctttcaagttctagtcctggatgaatttttaaaacagtagtgaatgcaagagatttgcccccaacagttcttgtcagagtaactaaattttttttatttacatttgcacttgcacgggattatagctattttcaaagactgacagttagaatatagtgtttattgcaagaatatatgataacaaaaggtttcataaattattcttctaagcatagactgtacttttttctaattgtttaaagtgagtttaaataagttaattactaattttgagaaagtattggtagaatttctgaaggcatggtagtttcattgtgtgtaattgtagaaattaagatgttcagcgtggacccttaatgatcttaaaagaaattactgtggtaaagagtttttatatttttagcctattggttaatgtagttgattctaataatgtcaaataactttgaaaatcattaagtctatctcctttgagatgtcaccttttctgtgatataatcaatcttttcactattcagtgttcatgtattcagtgtttatgaatatgatactgtgttaggtgcttagtacttatctgccagtgaaaagatgtagacttcaatggcagttgctttatttgctcacatgtaatgaaggaaattttccagtaactgctttatgaatgtagtcagtacatatgtcctcttttttacatcatcctggaatgactgccaaagcttcaagtgtgtagatcctgtctgttttcaagggtcttcattgtctttccctctctaaagctggggtgacctggctcttgaacatatatgcaaagcttcttgtcctcacggttactgcagctactttcttggagacttcatcctacattatagaaagaaaggaaaaaggaaggattttttgaagggaaaagaatataaggtaattaaggcttgaattccaggcagtcttttaagacacagtaagtaaagctttcgtacttaggcctgaaatttctaatgagtttatagaggttaatgagcatagagtgccgtgtagaccttgaacactgtgtcaaggtgcgtgagttttatcctgctcttacagggaacaaatagaaccatttgagaagaagactgttgaggaagaggcatattcaagaaattaacgactttttctgctattgcctatgttcctcagtttaggcattgttacaaaggagactttaattacataaagcactgagaacattacaaagtaaaatcaaacagttatgttaatggaattaagtatcctttctgattttctctatttaaaatcttgactgattcctctcagttaggaagttagcaaagggtagttaggcaacttgtaatcatttaggtgtcagtaaggtgtttgtttgtttgtttgtttggtaaggctttgttttgaaacacctggtccattataggtcctgctaaataaaccttagttttaattagaagtaaaaaactctctggtgtggcattaattagtgcttcaaatacaagcacccacagtttatataagagtttttattacggagtcattgttttcttttaaaaagaaaggtaaaccttcctgggactgtagtttatgatttataatttaaaaattaaaaatgaaatagaaaaaatagtttactaaaccaagtgtgatcatccctcacctagagaaattagagtttctttcaatgcctatctttagactgcaatcaaggacagtagggcatggctgagggggtggctactgtggccatgaaggttaagtcagcaagtggctttgcaagcccaaatttggttattgctttcactgcttgtgtcagtcgcatagcctcggatatgtaacatctggacttattttctcatctctaaaatatatatgctagaatatccatggtaagggattttctttagaattacataaggcttgttaagcaatttatacaatatccaacaaatagcaagaatctttataaactagcttggtaacaaaaatgctgaaagtttttgcttgaaatagataacacaaatctgaagcattttataaaaccaattttgttttaagcaataaggtaacatatttacagctaatttggtaaaaacaaaaccaaaataacaaaataaaaccaattaatctagtcagaattttcaggttgttaattgagtctcatttgaaggaatacccatatgggatttggaattggattacctttgctatttactagctgtattgactgcttagttaacagaggtgctagagctgtggtataatattggccacataaggaagcaatgtttgtagtgtgccttgggtgtcattaagtacccagcaaatatacaagaataccaaagagctgacacttttcctaacatgcatgcattgctactttcagatttccaagaaacttcttaccaagttttacatcaaaataggagagaaatgcttgcttaatgagactagagtgtgcattgtatacttgcagaaattttgaggagccatgaaatgatatttttcaaatgatagcaaaagtattttgatagtgtcatttttctttagcttgctctttatcacattttatgaaatatttcctaatatgtcatctctcaaaaaggtataaatatgagaaagaaatgttaatcttttgttaataatattcatagaggaggcagagttttaaagtttaccttgaaagataaaaaagattttagtatggagagagccaccctcccccaagttagttagttatccggatccatcctgttctaattgaatttgggggctactgcactgctttatgtcctacatgtataattggggccaaagcaccaagaaccaacagtgctcttcaatattggtgtttataacactagtttttaaggttccaagttgacttaagggatttctactaccttttcaaaatagcatagaaactattatttgaaaatgtcagctataagtattctattggcctacatataagtctagattataaatcatcatgaataccaatcttctgtgtaaacatggtgtacttttgataaatcaccgactcaaaaacagctactcacctcccccttgcttgaatataacatgtgtcattagtatattcgtgcttggttacaaagtatcactatttgggcccactgtggctacaactttcaattgcaaaatatataggaaggataagtccttaggtactgaactcacaaagtaggggtcacttctgtgtttctaggaggatgaaatcatccatgttgatgctcaagcatgtgttttataccattttaatatcacttggcaagcattttacatattaacatcacatactttgtccataggaatgaagagagaagagcagttcgtactaaatgtttccagatggttcttgttgatccactagcattctgagggcctagagctttttattttctaagttaaaattcagtttgatatttttcttcaaaatatttgagactgaataatgatagttatctataaagtcctgagataaatgggcacaaaacgcatgtaaaattagcagtcttcaaatgctcttaaataagtaggacgtgtaccaataatatccagaaattgctttttacgtgttgaacttttggtcccttcttgtttgtggacattgccatttattctgttagaatctcccaacagcataagacatcctatctgcttttttagtgcccggttaacctggttagtcttcgacagaatacatgttttttaacagaagcaatctttctcaatctctttgtctctatctgcctgtgtgtatctatttgtctctgtctctctctgtatctctgtctttgtctctatccccccctctccttccctccctccctctcccttattccacccctctttctgttagtaggtaatttaacattctactttgtgtagttaaaattaccctagtaattaagcttatacctgggctatgtgggaaacacttcagtatccataccattagagtgtaggcacagaaattctaaagaaattaagaatggtatgggagaattggagagatggctcagtggttaagagcactgactgctcttccagaggtcctgagttcaaatcccagcaaccacatggtgcctcacaaccatctataatgggatctgatgccctcttctggtgtgtctgaagacagctacagtgtactcatatacataaaacaaataataatacttaaaaaaataatggtatggggattacaggctcatcagaaaaagatcttttcagttactgaaaagaccctaaggattggaatggcctggacagactaacgtagaagaaacaaaggagtgtattgatgcctgatatttctctgtgttaaagtgtttcttttgatctagaaaaataagtctataaattgatataaatttgtataagttctgcttctaccacctaggagctttatacccgtaggaaatttaacctctctgatgttttctcatcaggaaatttgtgcaatactccctaccttaaagctccttttagcagaaggagtgagagaattctggtaaacctggtacccaaagctaagtaagcactaacttgtaccaggttagacaagattaaaatcatgaacaatgctaatttcaaaggttggttgttgcactttaccacaaaaacataagtaaggtattttctgtgccctgttattgcagtgaacatagatagatttatgatagaacagagttcactctgtacccggctaccacacgtggttttgttattatgtggccacatcgatgtcttcagtgtacttttgacttcaaaagcatacacagacatgttatataatccatcttatagacaaggctggattagttatcccccatcagatcaattaacatgaaagacagtacttaaatgttgggcttgataatgactttcccacaattgctattttgggtgctttcttactagcctgaggaaatgacaagattgagaagcacgaacagacaactccagataaatgttgactgtacactgaaagaagttgacctccttcaatctagaggtatagacttgattatttggtaaaccataagtcatggtgtggtgttttaacct
